United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 26

SEQ ID NO: 265 - DNA, 9503 bp, Homo sapiens
agattcaagacagtgttccgaaaagcacattggaaatcataactcatgtgaacatggaacactgggtgggtgcatgcgctgttttatccaggtttaccaggggagaatgacatggcctacatgtaactcaagatggtcgtggatgcagagacctcatggtgactgggtgcagaaaccttgtgacctgtgactgggtccttggattctgtgatctaagaccctgaggaaccatctgcatttatgccatgacggccaccgagtggtcaccttgttctgggcacagtgccctcaacttggcagctgaggctctgcttctgcaggagtgcaggtagatggggtccggctctgtcctctccctcccagggcagatgaggctctgctcctgtgggtgtgcaggtgggcggagtcctgctctgtcctctcccacccaggacagctgagggtctgctcctgcaggagtgcaggtggacggggtttggctctgacctcttcctcccagggcagctaaggggtctgctcctgtgggtgtgcagctgggcggagtccggctctgttctttccctcctagggcagtggatgccccaggcttgtctgttcccgctgagtctgtgtctcctgcctcagacttggtggtccacatgcagtactgctctgtgaatgatcctggaagggctgacccaacccaaagtacagcaggactaggagctgttggagctcaggccggtgaactgcaatttaagttatcccttgtctgtcttggtgttaaggagtggaatggaatcaagtttgtccttaagaaaataaagtgggcagctgaactctaaacctaactctgacttggtttcagtggctcagaggaaaaaccacaacaaacaaacaggaaaggaaagacttcccacccaagctaaattgttgtagggacaccagggtggatttgagcagcatcgcgaagatctcttcagctgagatgtacatcccgggaggcagcagccatgcacccagcatttctcaagctcagcacagcgggatgggggctgggagatgcttgtggggtcggtcttatggaatgggggatgttgagcacagccatgcacccagcgtttctcaagctcagcacgggggtgggggctgggagacgcttgtggggtacgtcttatgcactgggggatgttgagcagcatttctgggctccacctactacctgccggaagcacccccatttagtgacaaccaaacatatctccagatgtcaccaaatgtcccctgggggcagaattacctggttgggaactgctggtgtcatccaaagagcgtgagctttagaacaagacagacgcgtggaaccttctcacaagctgtgcagccggggggctcacaataggggctttccatggaaataaatggctataactgtgcctgcctgacctccctcagggtcccggaaagagcccctggtgagatggacgtgccgatggccacgggtgtcctctcaacaaggagatggtggctgaggggtgaggacacaggatggggcagagggcaggggtgagcagcggggacaggtctcggccgattctgagagaactcaggtgctgtgtgaactcaggggtctccgcaccgaggcaaggagtggccgtcctgccttcatgccgccagcctgggtggtgcgtgagtcagctcgggtgccatgacgggcatacacacccggggggcgtgtaaaggcacattcattccgcagggtcctggtggctggtgcccaagaccgtggagtcccaaggccagctcctgctgagcctctcctgggcacgcagacgccgtcctctccccatgtcctcatagggttgccccctctctgtctgtctgtgacctcatctccccttcttaggaggataccaggcagacaggatcagtgcccaccctggtgacctcattttaccttcttcacctctgtaaacgtcccatctccaaataatcacattctgaggtcccaagggttagggttcaacataggaatttggaggaacacaattcaggccataacttgtgtgtccttcccaaggaggggtgtggggaaggcagctttctcccgctgaatggctgagggcatgccctggagagactcagccattggctggcacctcctggcaggttggagcaggcaccttggtcctcgaggggtgagtgtggcatccacgcatcctgggggctcccatgtgggtggggttatgccaggcatgcagcgcctctgttggtggcctcctggtgtccatgagcccgtggctcccattccaagcatgagggcgataggagctggacggggccaaagggcccagtcacgtgtgcccagtcgcaggcggcttagatgggggttttgtacactcagctgtagtgtggcccacaggtttggagatggccataggaaagacagttcacaactcacagccccagaagagagtgaggccacaccgcaggcctgggggacacacctatgggtcaggaggcaggagaagagggaagcgtgggcaggagcctttgccacagtctctgggaaggagggagacacatacaaacatgcacacacatacacacataggcatgcatgcacacccatatacctgcacacatacacatatatgcacattacacatacacacacatacacacataggcatgcatgcacacccatatgcctgcacacacacatacacatatgtgcacattacacatacataaacacacatatgcacataggcatgcatgcacacccgtatacctgcacacatacacgtatacacacattacacatacccacacatacacacataggcatgcatgcacacccatataactgcacacatacacatatacgcacattacacatacacacataaacacacatacgcacatgggcatgcatgcacacccatatacctgcacacacacatacacatatacgtactttacacacacacacacacggcttaaaggaatgcagaagacatttccctgtgggaacgcacagcaatggacgataatgtttttcctcggttccagtgcctccaagagaatatgatgatataatcctggcccctttcacctgggctttgcagcttggaagaaagaaaagatattccagtttgtgcagtgttgaactatccctaaagcaagtaacaggagacgtcaaaatgtatgcttatgtcacccttatgaaaatgcctttttgttagaaattatgaacatcacccatcactaggtacaaggaggtaattagggtaattgattggcgttaaatgcagcagggactgcaaactggatttgcagagtctggtagccgtcgtggaaagaaatttattcattccttcactgaaggccataaagccattttggtttcagagcgtgcactaggccaccctgggctgagggctgcagggttcgaatgctgtaacataacggagagagatttgtttgctgaggcaggctggcattttagtattgctcttctgttcttttgatagtctccagacatatgctttggaatggggatttggtacttgaattcatgctttgaaattgactctggttgacattctttctgtattgaaatttcttctgtcaaagcctgcgaaattggcttcttaaatcagaaacagaaacatacaagctggtctcatttgttagttaatttgcaggctgctgaagaaaaaaatctttactttgttttttatggaaacatgtttttaattcacaaaaaaaatcccataaacctgccaaagtgaatctcttctttgatggcagaggagctgctcttccatctgccaccagccagcctcagcctcccttcccgaactgagcttttcacacattcccaggagagtggcagcgtgagctcccccgtgcccaggaactgggtggccgggcctccttctgccccatcgcctctgcctgcaccttctgctggtccagctcagacaaaagtaaacccggacctcaccccaggacctttcctgatcctggcccctcccgtcagccgacagtgaccttcaacacgtgtcccctccacactggcttctccaccctgatgatgctaccactcatttcatgtccatctcctgtaccgaattgtaatgtcattgagaactgtggcttttcttaaattaaaaataagggtgtttattacaaaagtcatatagggttcatgtagacaatttaaaaatataaagaaaagtcattgaaaaccctgtaatcttcatctcctagtgacggtccctgtttcacatcttctggctgcttctgcacataacacagttacatctttaaaagacataaaaatgtcaagtgctttaaaaattgcttttccccctcatgagcatcttttcatcactaaatgcacattctggaatagtattttgggtagctgggtagtatccatcctgtgcttttcgccctcgtgagcatcttttcatcgctaaatacacattctggaatagtatttttggtagctgggtagtatccatcctgtggttttaataaatattgtaagccatcccctatgatacagtactgttgtcatttctcctctttccctgattaccaattccccagtccctgaccctgggctgcattgtcttggggaagcttcatggaaggaaagttgcccactctaaggacatgaccagtccgaaggcctccagtcatctccagaaagaccgggcgctccactgcccgccacctggcctgaagacacggagataagaattgtcaagtccccaaagttgtgaattctttattcttccttagtcatctttttccagtgctcaaacttcctcactgtcaggaaatgtaaaccaaaattcacacggacaaaatgtgaacaaaacattggcaaatgtacacctgttttcttaactgctgatttcttgctgagagaacctgctgtggctgaggccccaggcctgtctcttacctgacctacagctctgcagctctgcggtgtcatctgtgggacatttacattgaccatgtcattaatacccgatatggtttgtgtccccaccgaaatctcgttttgcctggcagctcccataatcctcatgtgtcatgagagggacccagtaggaggtgactgaatcatggggtgggtctttcctgtgctgttttcatgatggtgactaagtcttatgagatctgatggttttttaaaagggagttcccctgcacacactctcttgcctgccaccatgtaagacatgactttgctcctcattcgccttctgccatgactgcgaggcctccccagccacgtggaactgagtcagttaaacctctttcctttataaattgcccagtctggggtatgtctttattagcagtgtgagaagagatgcatacaatacctccaattccctttcagcgcggtctgtattcctctttgaacacgtgcagacctgggcacaaggcaccaggtcataaaggctttagaagaacccggctggagagcaccacagacaccgcctgtccagctcacggtcacagttcaggatccttgtcctgagcctttgggcctcttggaatctgggtggagggagaatctggaacttcccatcctgtccaaccctctcctcatcacagcatctggatcttctagtgtgcgtggtgctagggtgtcactgtgagctgccgtgtgcctgggccaccttgggggtgctacagctgtgatccacctgcaccgtgacccacaggggcctgcgggactgtggtgttgggtgtccgcgcctcgttactgggggactgtgtggtgttggggtgtccgcgcctcgtttctgggggactgtgtggtgttggggtgtccgcgcctcgttactgggggactgtgtggtgttggggtgtctgcacctcgttactgggggactgtgtggtgttgggtgtccgcgcctcgttactgggggactgtgtggtgttgggtgtccgcgcctcgttactgggggactgtgtggagttggggtgtccgcgcctcgttgctgcgggactgtgtggtgttggggtgtccgcgcctcgttgctgcgggactgtgtggtgttggggtgtcggcgcctcgttactgggggactgtgtggtgttgggtgtccgcgcctcgttactgggggactgtgtggtgttggggtgtccgcgcctcgttactgggggactgtgtggtgttgggtgtccgcgcctcgttactgggggactgtgtggtgttggggtgtccgcgcctcgttactgggggactgtgtggtgttggggtgtctgcacctcgttactgggggactgtgtggtgttggggtgtctgcgcctcgttactgggggactgtgtggtgttgggtgtcggcgcctcgttactgggggactgtgtggtgttggggtgtccgcgcctcgttactgggggactgtgtggtgttggggtgtccgcgcctcgttgctgggggactgtgtggtgttcgggtgtccgcgcctcgttactgggggactgtgtggagttcgggtgtccgcgcctcgttgctgcgggactgtgtgttgttggggtgtcggcgcctcgttactgggggactgtgtggtgttggggtgtccgcgcctcgttactgggggactgtgtggtgttgggtgtccgtgcctcgttgctggtggactgtgtggtgttgggtgtccgcgcctcgttgctcggggactgtgtggtgttggggtgtccgcgcctcgttgctgggggactgtgtggtgttggggtgtccgcgcctcattactggggggctgtgtggtgttggggtgtccgcgcctcgttactgggggactgtgtggtgttggggtgtctgcgcctcgttactgggggactgtgtggtgttgggtgtccgcgcctcgttactggggggctgtgtggtgttggggtgtccgcgcctcgttactggggggctgtgtggtgttggggtgtccgcgcctcgttactgggggactgtgtggtgttggggtgtccgtgcctcgttactgcggggactgtgcagtgtccgggtgtccgcgcctcgttactgggggactgtgtggtgttggggtgtccgcgcctcgttgctggggggctgtgtggttttggggtgtccgcgcctcgttactgggggactgtgtggtgttgggtgtccgcgcctcgttgctgggggactgtgtggtgttggggtgtccgcgcctcattgctgggggactgtgtggtgttggggtgtccgcgcctcgttactggggggctgtgtggtgttggggtgtctgcgcctcgttactgggggactggtgttggagtgtctgcgcctcgttactgggggactgtgtggtgttgggtgtctgcgcctcgttgctgggggactgtgtggtgttggggtgtccgtgcctcgttactggggggctgtgtggttttggggtgtccgcgcctcattactggggggctgtgtggtgttggggtgtccgcgcctcgttactggggggctgtgtggtgttggggtgtccgcgcctcgttactgggggactgtgtggtgttggggtgtccgcgcctcgttactgggggactgtgtggtgttggggtgtccgtgcctcgttactgcggggaccgtgcagtgtccgggtgtccgcgcctcgttgctgcgggactgtgtggtgttgaggactccttgccacacggggtccatggtaaggggagctcctgctcgtccaggctggaagtccaggatatgtgagtgacagaaatgagcatgcctctccctctcccttggctcctgtcctgggctgcaatgtggaagatgtcagatctgccggagcactggtgtggcatggcatttaggaatgaatacaggggccttcagccagaagacctgccttcaccaccagccacgcagatccctgctggtagtgctgtcgatcggctcacaggcaatatggacactggaaagatggcaggttccttttctgatgatataagtagtatacctcagtagctaagtattttacagcaaggaaaaaaaataccctgtctgaagaccttttaaatatggaaattttttattttctttctctgtaaacagcatttggggagattctcttctcctacatgaaaaacatgctatgttagttccttgactacagactgtgggtgatgagctagttgctgtggaaagctttggagttctctacactcagcgactgcatgctgtgttcttttgcctttgtaaacgtgagtttgacctatggagtgaactttacccagagcctctggggagctgttcaaagctaatgaaccgtggggaaaagaaaccaggtcctgacctgcagggagcagctcccgcaatggaaaccattgtgttccagttccatgactttttgctcatggctatgttgggtttccagtttcacagatggtggatggaaacagaatactggcctgcactgtcatcttcatggtttaccctcccctcagagagacacgtaacgcaaacacacagcaggcagcctgtggggccgttatgggtgatatataaaatgcacgtgggttcagttctcgaacagtcagatacacagcacaggggggttatatgtatgggctctcagctctgtgcaaggcagatatatagcaagtacatgggcccagttctgtgcctggcagatatataacaggcataggtgctcacctctgtgccaggcagatgtataacatgcacagttgctcagtttggtaccatgcggatatataatacgcacgggtgctgagttctataccacacagatatataacattcatggttgctcaagtctgcaccaggcagacacataacatgcatagttgctcagctctgtaccaggcagacatataacaagcacaggtggtcagctctgtaccacacagatatattgcatgcacaggcaggtgctgagttccataccacacagatatgtaacattcatggttgctcaggtctgcaccaggcagacatataacatgcgtgggtgctgagttccataccacacagatatatagtattcatggttgctcaggtctgcaccaggcagacatataacatgcatgggtgctcagctctgtacgaggcagacgtataacacgcacaggtgatcagctctgtaccacccagatatataacatgagcgggtgctgagttctgtaacaggcagacatattccatgcacaggtgcttggtgatatgtcaggtggaatgtgatgtggctgggcaagatccttttgcaactctgagtactgagaatttgcatgtatgatagaacttggcttctagatttaaaaccgtcctcttttatttgcttgcaattaagatataagtatacaataagataggcattttctcccttgttttcttttttttttttccttttcttctctgttcagtttctcaactttcaatttcctcttataccagagggaaataaaactaaattttagccagtgctttgtcccagctgctgagattgca

SEQ ID NO: 266 - DNA, 2641 bp, Homo sapiens
atacctccaattccctttcagcgcggtctgtattcctctttgaacacgtgcagacctgggcacaaggcaccaggtcataaaggctttagaagaacccggctggagagcaccacagacaccgcctgtccagctcacggtcacagttcaggatccttgtcctgagcctttgggcctcttggaatctgggtggagggagaatctggaacttcccatcctgtccaaccctctcctcatcacagcatctggatcttctagtgtgcgtggtgctagggtgtcactgtgagctgccgtgtgcctgggccaccttgggggtgctacagctgtgatccacctgcaccgtgacccacaggggcctgcgggactgtggtgttgggtgtccgcgcctcgttactgggggactgtgtggtgttggggtgtccgcgcctcgtttctgggggactgtgtggtgttggggtgtccgcgcctcgttactgggggactgtgtggtgttggggtgtctgcacctcgttactgggggactgtgtggtgttgggtgtccgcgcctcgttactgggggactgtgtggtgttgggtgtccgcgcctcgttactgggggactgtgtggagttggggtgtccgcgcctcgttgctgcgggactgtgtggtgttggggtgtccgcgcctcgttgctgcgggactgtgtggtgttggggtgtcggcgcctcgttactgggggactgtgtggtgttgggtgtccgcgcctcgttactgggggactgtgtggtgttggggtgtccgcgcctcgttactgggggactgtgtggtgttgggtgtccgcgcctcgttactgggggactgtgtggtgttggggtgtccgcgcctcgttactgggggactgtgtggtgttggggtgtctgcacctcgttactgggggactgtgtggtgttggggtgtctgcgcctcgttactgggggactgtgtggtgttgggtgtcggcgcctcgttactgggggactgtgtggtgttggggtgtccgcgcctcgttactgggggactgtgtggtgttggggtgtccgcgcctcgttgctgggggactgtgtggtgttcgggtgtccgcgcctcgttactgggggactgtgtggagttcgggtgtccgcgcctcgttgctgcgggactgtgtgttgttggggtgtcggcgcctcgttactgggggactgtgtggtgttggggtgtccgcgcctcgttactgggggactgtgtggtgttgggtgtccgtgcctcgttgctggtggactgtgtggtgttgggtgtccgcgcctcgttgctcggggactgtgtggtgttggggtgtccgcgcctcgttgctgggggactgtgtggtgttggggtgtccgcgcctcattactggggggctgtgtggtgttggggtgtccgcgcctcgttactgggggactgtgtggtgttggggtgtctgcgcctcgttactgggggactgtgtggtgttgggtgtccgcgcctcgttactggggggctgtgtggtgttggggtgtccgcgcctcgttactggggggctgtgtggtgttggggtgtccgcgcctcgttactgggggactgtgtggtgttggggtgtccgtgcctcgttactgcggggactgtgcagtgtccgggtgtccgcgcctcgttactgggggactgtgtggtgttggggtgtccgcgcctcgttgctggggggctgtgtggttttggggtgtccgcgcctcgttactgggggactgtgtggtgttgggtgtccgcgcctcgttgctgggggactgtgtggtgttggggtgtccgcgcctcattgctgggggactgtgtggtgttggggtgtccgcgcctcgttactggggggctgtgtggtgttggggtgtctgcgcctcgttactgggggactggtgttggagtgtctgcgcctcgttactgggggactgtgtggtgttgggtgtctgcgcctcgttgctgggggactgtgtggtgttggggtgtccgtgcctcgttactggggggctgtgtggttttggggtgtccgcgcctcattactggggggctgtgtggtgttggggtgtccgcgcctcgttactggggggctgtgtggtgttggggtgtccgcgcctcgttactgggggactgtgtggtgttggggtgtccgcgcctcgttactgggggactgtgtggtgttggggtgtccgtgcctcgttactgcggggaccgtgcagtgtccgggtgtccgcgcctcgttgctgcgggactgtgtggtgttgaggactccttgccacacggggtccatggtaaggggagctcctgctcgtccaggctggaagtccaggatatgtgagtgacagaaatgagcatgcctctccctctcccttggctcctgtcctgggctgcaatgtggaagatgtcagatctgccggagcactggtgtggcatggcatttaggaatgaatacaggggccttcagccagaagacctgccttcaccaccagccacgcagatccctgctggtagtgctgtcgatcggctcacaggcaatatggacactggaaagatggcaggttccttttctgatgatataagtagtatacctcagtagctaagtattttacagcaaggaaaaaaaata

SEQ ID NO: 267 - DNA, 2544 bp, Homo sapiens
catacttttccagggcatatacttttatttgtctgctggtttacttaattgctggtagccccagctgctagcagtagtagtctaattcctgatagggcagtccagtgcacagaagggctccttgccgctctgctcggctcagtttttctgtagctcttaaactttctccccaccccacttaatagagtacatgttattgatttggaaactggtatcaaagctggtgggagaacgagatataccagtgaatataaaagtcaagaatgacacgtttcagctgcaagaatatagcttttttattaaaaagtttttgcaccgtgtattatctggcctttgtgggcagatggaagtgatgcccatcaatatagaatgtgtaatgatgtacacgtgcaaatatgctcctggctcttagaaacgttttgatgaagcgctcgagttcattcccatgcaggccaatgcatggattctgaaaataactgaaaattagtgtctcgttcctttcatcctcaccgattttctaaagaggccaccgcaaaggagagagcatgttccaccatgatggtcctgtttcacccagtgcgtgggggtgctccagatgtgagcagtatgaacgaagacaactttcctttgatgtgggacacaacttttaccaaccttccccaaacatatcttcctgtttcctgtgggattgtagtgtacacttgtttaatgattgctaaagtaatggagaaacaaatgtgaatctggcctgcatgcttcctttccttcctcagaaacaaagtggggctctggaatccttgctgtgcctgtggaatgtgtcaggaaacacaaccctgagttcattagttgagattggcagcaaagcagccttgggtctggtggagctgtggtagtaggggtccttctagtccttaccatggagagtggtcactctgttgctttcaaggtttcccaaagccggcatttgtattcataatgtcattttgtgcatttgggttattttcgccaagttcatagcagctgtaaataagaagatatttaagtctgtttttttttttttttttaagattagaggtatttctctgttttgtaacgcacatgttctcagtagggatttgtctgttgacagaatgagggctctctaaagaaacacatatattcaaggctcttcttaacatctacttcaggtctatctgccaggctagtgatgtgttttttgggatccttatccaccatgaaatctagtgttgcttgttctatatttgatgccatcttttaaagtaacaggctatgagtagtttgttgccgtccacatgtgcttttccagccattcaaaaccttttttttctaagacccaacatgcaccccttgattatttttgggttaccttattattcattgcacttatgcaggggcagtgggtccattcctgcggcattcctatgatatccaattatagtaactgtgtttgtgttgctcagttagaagttgaatgagctggagatttaatgatctagttaatcagtttataattggtaatcagaaagactgagggtttaatcagccagtgtgatatcatatgagccattggttcccagatgctggtccaacaaccacaagtattcacagatttctaggcccatctggggagattcttattcagtatgtctcaatatagactctaggaatctatcatttttcgaggttccatggaagtttctggtgcagggatgtcaaagtatgcatggtataatgactatgtcttttagtgataatgtttttcatctctgtgtgtctcagatactgctggaatgccttaactaccttctttaatggaatatgtttatatgggcattctgggctatgtgggagaaggaacctcaggctggccatcggggacctggttctagccttggttctgccactctctcaacctttcatcaggttagagaagtctaatctctgtgtaggtctaattcataaattgagagcatcagattatgcaaaaggcatttttcagctttctaacattcttcgaagagctttgcctccctaggaattgcttttgttgtcactgttcacgaacagctgttgcctcatttagtttagcgtgtgcctagcccctcaaccaaacatgaatcacggtctgcttctcaggagagctggtagctctccccgaattcaggatggcctcttttcctcttctgttactgccactaccaatcacccacaacaagaccaaagtacactgttttttttttgagacagagtctcactttgtcgcccaggctggaatgcagtggtatgatctcggctcactgcaacctctgccttctgggttcaagcaattctccttccacagcctcccaagtagctgggattacaggtgcatgccaccactcctggctaatttttgtatttttagtacagacggggttttaccatgttggccaggctggtctcaaactcctgacctcatgttatctgcccacctcgtcctcccaaagtgctgggattacaggcgagaaccaccgtgcccagcct

SEQ ID NO: 268 - DNA, 26 bp, Homo sapiens
caccactcattgggagcaacacagaa

SEQ ID NO: 269 - DNA, 6422 bp, Homo sapiens
aaaaggatattttcataaacaaatattatagtaagggctagcctaatgtatataaaggataatatatatttttaaagttagaaattgcctctaatttttaatatgtactataaaatccacacaatttagaaattttctttgaaatcaatttaaaagaaattgttttttaaaaagtatgtaagtgtttaaatatataaaatttaaatatatactaaaatataactctgaaatttaaatatttactaggatatatacataaaacagcttgctgcattgacctggggctcacacacctcagactcttgtagaagaaaaaaatcaaacaaaacaatacagtcagtgttgcaagctgcaatatagaacagtcccaatcttgccttaggttatttgttctttttttttattattatactttaagttttagggtacatgtgcacatcgtgcaggttagttacatatgtatacatgtgccatgctggtgcgctgcacccactaaatcgtcatctagcattagttatatctcccagtgctatccctccccctgccccccaccccaccacagtccccagagtgtgatattccccttcctgtgtccatgtgatctcattgttcagttcccagctatgagtgagaatatgcagtgtttggttttttgttcttgcgatagtttactaagaatgatgatttccaatttcatccatgtccctacaaaggacatgaactcctcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagctgcatgatttacagtcctttgggtatatacccagtaatgggatggctgggtcaaatggtatttctagttctagatccctgaggaatcatcacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgacgaacattttttcatgtgtgttttggctgcataaatgtcttcttttgagaagtgtctgttcatgtccttcgcccactttttgagggggttgtttttttttttcttgtaaatttgttttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctgtgtcctgaatggtaatgcctaggttttcttctagggtttttatggttttaggtctaacgtttaagtctttaatccgtcttgaattgatttttgtataaggtgtaaggaagggatccagtttcagctttctacatatggctagccagttttcccagcaccatttattaaatagggaatcctttccccattgcttgtttttctcaggtttgtcaaggatagatagttgtagatatgtggcgttatttctgagggctctgttctgttccattgatctatatctctgttttggtaccagtaccatgctgttttggttactgtagccttgtggtatagtttgaagtcaggtagtgtgatgcctccagctttttcttttggcttaggattgccttggcgatgcgggctcttttttggttccatactaactttaaagtagttttttccaattctgtgaagaaagtcattggtagcttgatggggatggcattgaatctgtaagttaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctattattggtgtataagagtgcttgtgatttttgtacattgattttgtatcctgagagtttgctgaagttgcttatcagcttaaggagattttgggctgagacagtggggttttctagatatacagtcatgtcgtctgcaaacagggacaatttgacttcctcttttcctaactgaataccctttatttccttctcctgcctaattgccctggccagaacttccaacactatgttgaataggagtggtgagagagggcatccctgtcttacgccagttttcaaagggaatgcttccagtttttgcccattcagtatgatattggctgtgggtttgtcatagatagctcttattattttgaaatacgtcccgtcaatacctaatttattgagagtttttagcatgaagggttgttgaattttgtcaaaggctttttctgcatctattgagataatcatgtggtttttgtcttgggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttgtattgattggaatagtttcagaaggaatggtaccacttcctccttgtacctctggtagaattcgtctgtgaatccatctggtcctggactctttttggttggtaaactattgattattgccacaatttcagctcctgttattggtctattcagagattcaacttcttcctagtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctcttttttttctttattagtcttgctagcggtctatcaattttgttgatcctttcaaaaaaccagctcctggattcattaattttttgaagggttttttgtgtctctgtttccttcagttctgctctgattttagttatttctagccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttcttccttcatttcgttatgtacccagtagtcattcaggagcaggttgttcagtttccatgtagttgagcggttgtgagtgagattcctaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtttaatgttgacagtggggtgttaaagtctcccattattaatgtgtgggagtctaagtctctttgtaggtcactcaggacttgctttatgaatctgggtgctcctgtattgggtgcatatatatttaggatagttagctcttgttgttgaattgatccctttaccattatgtaatggcattctttgtctcttttgatctttgttggtttaaagtctgttttatcagagactagtattgcaacccctgcctttttttgttgtccatttgcttagtagatcttcctccatccttttattttgagcctatatgtgtctctgcacgtgagatgcgtttcctgaatacagcacactgatgggtcctgactctatccaatttgccagtctgtgccttttaattggagcatttagtccatttacatttaaagttaatgttgttatgtgtgaatttgatcctgtcattatgatgttaggggtgattttgctcgttagttgatgcagtttcttcctagtcttgatggtctttacattttggcttgattttgcagtggctggtactggttgttcctttccatgtttagcgcttccttcaggagctcttttagggcaggcctggtggtgataaaatctctcagcatttgcttttctgtaaagtattttatttctccttcacttatgaagcgtagtttggctggatatgaaattctgggttgaaaattcttttctttaagaatgttgaatattggcccccactctctcctggcttgtagggtttctgccaggagatctgctgttagtctgatgggcttccctttgagggtaacccgacctttctctctggctgcccttaacattttttccttcatttcaactttggtgaatctgataattatgtgtcttgaagttgctcttctcgaggagtatctttgtggcattctctgtatttcctgaatctgaacgttggcctgccttgctagattggggaagttctcctggataatatcctgcagagtgttttccaccttggttccattctccccatcactttcaggtacaccaatcagacgtagatttggtcttttcacatagtctcatatttcttggaggctttgctcgtttctttttattcttttttctctaaactttccttctcacttcatttcattcatttcatcttccattgctgataccctttcttccagttgatcgcatcggctcctgaggcttctgcattcttcacgtagttctcgagccttggttttcagctccatcagctcctttaagcagttccctgtattgcttattctagttatacattcttctaaatttttttcaaagttttcaacttctttgcctttggtttgaatgtcctcccgtagctcagagtaatttgatcgtctgaagccttcttctctcagctcgtgaaagtcattctccatccagctttgttccgttgctggtgaggaactgcgttcctttggaggaggagaggcgctctgctttttagagtttcccgtttttctgttctgttttttccccatctttgtgtttttatctacttttggtctttgataatagtgatgtacagatgggtttttggtgtggatgtcctttctgtttgttagttttccttctaacagacaggaccctcagctgcaggtctgttggaatagcctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagtttgagcttccaggctgctttgtttacctcagcaagcctgggcaatggcgggcgcccctcccccagcctcgctgccgccttgcaggttgatctcagactgctgtgctagcaatcagcgagactccatgggtgtaggaccctccgagccaggtgcgggatataatcttgtggtgcgtcgtgttttaagccggtcggaaaagcgcagtattcgggtgggagtggcccgattttccaggtgcgtccgtcacccctttctttgacttggaaagggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcagaaatcacctggcttctgcgtcactcaggctgggagctgtagaccggagctgttcctattcggccatattggctcctcccccc

SEQ ID NO: 270 - DNA, 5774 bp, Homo sapiens
ggaggaagacattccaagtctgaatctctggttaccactctgatggaaatacgcagctacaacccaatagaaggtcacatgctccagacagggaactcatctaatgatatgggggtgcaggggtgggggatcactaggagagtgcaggagtaaagaggtttctacacttatcctaacgaatgaaccacaaaagcatcatgctgaagcaaaagaagccagccacaaaacaaaggcatgctatacaagcccatttataacagaacagaatggaaattttataaaagttcaagaacaagcaaaactaatctatgatgattgaattcagaataatggttatcttggggttggtgagaagggagcaaataagaacttcatagggaactagaaatgttctatatctttgcaatgtatctatgtaataaaactgcacttgcacctcttaaatttaaacaaaatttttgagatttttcgtgaaaacggccatactgcccaaggtaatttatagattcaatgccatccccatcaagctaccaatgactttcttcacagaattggaaaaaactactttaaagttcatatggaaccaaaaaagagcccacaatgccaagttaatcctcagccaaaagaacaaagctggaggcatcacgctacctgacttcaaactatgctacaaggctacagtaaccaaaacagcatggtactggtaccaaaacagaacagaacagagccctcagaaataataccacatatctacaactatctggtctttgacaaacctgacaaaaagaagcaatggggaaaggattccctatttaataaatggtgctgggaaaactgcctagccatatgtagaaagctgaaactggatcccttccttacaccttatacaaaaattaatccaagatggattaaagacttatatgttagacctaaaacgataaaaaccctagaagaaaacctaggcaataccattcaggacataggcatggtcaaggacttcatatctaaaacaccaaaagcaatggcaacaaaagccaaaattcacaaatgggatctaattaaactaaagagcttctgcacagcaaaagaaaccaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaacaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacatttttacactgttggtgggactgtaaactagttcaaccattgtggaagtcggtgtggaaatcggtagattgctcagggatctagaactagaaataccatttgacccagccatcccattactgagtatatacccaaaggattataaatcatgctgccataaagacacatacacacgtatgtttactgcggcactattcacaatagcaaagacttgaaaccaacccaaatgtccaacaatgatagactggtttaagaaaatgtggcacatatacaccatggaatactatgcagccataaaataggatgagttcatgtcctttgtaggggcatggatgaagctggaaaccatcactctcagcaaactatcgcaaggacaaaaaaccaaacaccacatgttctcactcataggtgggaactgaacaatgagaacacacggacacaggaaagggaacatcacacatcggggactgttgtggggtggggggcggggagggatagcattaggagatatacctaatgctaaatgacgagttaatgggtgcagcacaccaacatggcacatgtatacatatgtaacaaacctgcacattgtgcacatgtaccctaaaacttaaagtataataaaaaaaaattttactctaagttccaggatacatgtgtagcatgtgcaggtttgttacataggtatacacgtgccatggtggttggctgcccctatcaatctgtcatctatattttaagccccgcatgcattaggtatttgtcctaatgctctccctcctcttgccccccacccctgacaggccccagtgtgtgatgttcctctccctatgttcatgtattctcattgttcaacttccacttatgagtgaaaacatgtggtgttaaacaattttttaaaaaatgttctgcatctcgatctgtgtggtcacaattgtatatatgtgtaaaaattcattgagctttacacttaagattcatgcattatactatatgtaagctatgcctccataaagtaccactgaaacataaacaaaaggcttttagataattactacaggtttattaaccttcagcctctgtatatttattgagaatctgctattcaataattcatccattcaacagatatttactatatagctactctgtgccaggtactattctaggcactggagtatagcaatgatggacaaactccctgcctcatggggcttgcattttagagctatgtgccagacatagtgccatgtcctggtggaggagaggaagtgcttgtggtgcaggaatgaaagaactcacagtctagtggacagacagacacaaagtcacaccgcaccatgcagtaagtgctgtgatagggcatgtggtgtcttgatgcacagcaggaaggggccacgtgggttgattgcaaatttggagagggctcccaagaaaacacaacacagcctgaggatgaagcagcagagattgcaggtgactctttggaggaggcaacagcatccttgaaggcatgtgtgcaaaggcactgccgcatggacttgaagggaatcgtcaaatatccaaatggagtttcataccatggagcttacatgaatttacagtacaagtgtggccctggaaccagtgacccaatcctgcatctaccacttgataaatatgggaccttgcacaattactcagccttgaattcttcttcctgaaaatgtgaccactgttagtgcttaattgaggttcttgtgacaatttaatgggatcagccatggtgcgttcattttctattgctgctatgacaaattaccatcaacttggcgggggcttaaataatcctcacttattgtcttatacttctgtggttctgaaatgtgaaatgggtctcgctggactaaaatcaaggtgtcagcaggattgctttcctttccggaggccgtaggggagaatccacttccttgacttttccacctttcagaggctgcccacattcctcggcttatgactccttccttcatcttcaagccagcaccactgcatctctctgactcttccatcttcacatctttctctgtccacatcctggaaaagctcttcacttttgaggattcacaggattaagttggtcccaccttgctaatccaggatcatccgaatctcaaggtactaaaccctgaatctcacaactgcaaagtcccctttacactataagcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcctctggaccaataagcatgcaaatataaaccaagttaggtgtaaatcctgggaatactcaggtctcagggaactactccaaatgatgtacaaacctagagtttccatttaggcaaaaggttctaataaagtaagacttcttcactaaatactatcagttgcatactcacacgctggcagaacaaagactgcagggtgtttcagcatctccataccaacagctagaacagattcctctcctaaccctctgtgccgtatcaaccagctggtctagtctgactcacaaatggctacagcctggtggtaaacggaactttgttaaccatttgcaaaaaattccaggcaactggggagatggaacaaaaatgccccccaaagctgcctcaatatcattaaaagttgggcagtgaggaagccaggaaatagaacacaaagcatgttgggctgagctatagaataagagacttttgggatagtgaacaaactctacctcccctattttaagcagaaatcacaaccgattttgattccacttaataatttcctcgacacttgaagagatggcaggctccatgagagcaaggatcctgccaggaagccaacagtccatctctgatgtccagtccatgtctagcacacagctgagacccaataaaataaaatgtgtggaattaaggaataaatgaatggagaggaaatcacccaggatcacaatcaagggtgatatttacattctaaagcaggggttgacaatccatggcttgtggaccaaatcctccccacagcctcttttatatagccccaaaacacagccaagccctttcctgtattgtctgtggctgcctttgtgctatagcagcagaatgtgtggcctcttggtttgccaagcctaaaatattgactatctgggcttttaaataaaacacttgccaattgctgctttacaatactttctggtagcttatcaaaataatcttgggatcttttaaatatgcagcaccttaagcccagaatctgaattttaactagtttcccaaggttcgagaatccttgcacttatagagaattgatctgatttgacaagcacgagggcagggttctcaacttttcttttacttttaagttcaaggatacacatgcagatttgttacacaggtaaacttgtgccatgggggtttgttgtacaggttatttcatcacccaggtattaagcctagtgcctattagttactttcccgactctcttcctcctcccaccctccaccctctgcaaggccccattgtgtgtttttccactctatgtgtccatgtgttctcatcatttagctcccacttttaagtaataatatatgatatttggttatctgttcctgtgttagtttcctaaggataatggcctccagctccatccatgtccctgcacaggacatgatctcatccttttcttatggctgcatagtattctgtggagtatgtgtaccacattttcttgatccactctatcactgatgggcaaatatttaggttgattccatatgtttgctattgtgaacagtcctgcaagaacatacacatgcccgtgtccttataatagaacgatctatattcctttcggtatatacctggaaacgggattgctgggttgaatatttctgtctttaggtcttcgagaaattgccacattgtcttccacaacagctgcactaatctacactcccaccaacagtgtataagcctcgatcagaatcacccaaaaggcttgttaaaacacagactgacaatccctgcccctcactttctgattcagtaggatgcatatgggcctgagaatgtgcatattttggccctatctcaagtgatagtgatgatgctggtccagaaaccacactttgagaaccacagcacaaaggttacccagtgcccttccttgtttaatagtgactcattttccacacttcagccttcagcagta

SEQ ID NO: 271 - DNA, 3321 bp, Homo sapiens
ccactgaaacataaacaaaaggcttttagataattactacaggtttattaaccttcagcctctgtatatttattgagaatctgctattcaataattcatccattcaacagatatttactatatagctactctgtgccaggtactattctaggcactggagtatagcaatgatggacaaactccctgcctcatggggcttgcattttagagctatgtgccagacatagtgccatgtcctggtggaggagaggaagtgcttgtggtgcaggaatgaaagaactcacagtctagtggacagacagacacaaagtcacaccgcaccatgcagtaagtgctgtgatagggcatgtggtgtcttgatgcacagcaggaaggggccacgtgggttgattgcaaatttggagagggctcccaagaaaacacaacacagcctgaggatgaagcagcagagattgcaggtgactctttggaggaggcaacagcatccttgaaggcatgtgtgcaaaggcactgccgcatggacttgaagggaatcgtcaaatatccaaatggagtttcataccatggagcttacatgaatttacagtacaagtgtggccctggaaccagtgacccaatcctgcatctaccacttgataaatatgggaccttgcacaattactcagccttgaattcttcttcctgaaaatgtgaccactgttagtgcttaattgaggttcttgtgacaatttaatgggatcagccatggtgcgttcattttctattgctgctatgacaaattaccatcaacttggcgggggcttaaataatcctcacttattgtcttatacttctgtggttctgaaatgtgaaatgggtctcgctggactaaaatcaaggtgtcagcaggattgctttcctttccggaggccgtaggggagaatccacttccttgacttttccacctttcagaggctgcccacattcctcggcttatgactccttccttcatcttcaagccagcaccactgcatctctctgactcttccatcttcacatctttctctgtccacatcctggaaaagctcttcacttttgaggattcacaggattaagttggtcccaccttgctaatccaggatcatccgaatctcaaggtactaaaccctgaatctcacaactgcaaagtcccctttacactataagcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcctctggaccaataagcatgcaaatataaaccaagttaggtgtaaatcctgggaatactcaggtctcagggaactactccaaatgatgtacaaacctagagtttccatttaggcaaaaggttctaataaagtaagacttcttcactaaatactatcagttgcatactcacacgctggcagaacaaagactgcagggtgtttcagcatctccataccaacagctagaacagattcctctcctaaccctctgtgccgtatcaaccagctggtctagtctgactcacaaatggctacagcctggtggtaaacggaactttgttaaccatttgcaaaaaattccaggcaactggggagatggaacaaaaatgccccccaaagctgcctcaatatcattaaaagttgggcagtgaggaagccaggaaatagaacacaaagcatgttgggctgagctatagaataagagacttttgggatagtgaacaaactctacctcccctattttaagcagaaatcacaaccgattttgattccacttaataatttcctcgacacttgaagagatggcaggctccatgagagcaaggatcctgccaggaagccaacagtccatctctgatgtccagtccatgtctagcacacagctgagacccaataaaataaaatgtgtggaattaaggaataaatgaatggagaggaaatcacccaggatcacaatcaagggtgatatttacattctaaagcaggggttgacaatccatggcttgtggaccaaatcctccccacagcctcttttatatagccccaaaacacagccaagccctttcctgtattgtctgtggctgcctttgtgctatagcagcagaatgtgtggcctcttggtttgccaagcctaaaatattgactatctgggcttttaaataaaacacttgccaattgctgctttacaatactttctggtagcttatcaaaataatcttgggatcttttaaatatgcagcaccttaagcccagaatctgaattttaactagtttcccaaggttcgagaatccttgcacttatagagaattgatctgatttgacaagcacgagggcagggttctcaacttttcttttacttttaagttcaaggatacacatgcagatttgttacacaggtaaacttgtgccatgggggtttgttgtacaggttatttcatcacccaggtattaagcctagtgcctattagttactttcccgactctcttcctcctcccaccctccaccctctgcaaggccccattgtgtgtttttccactctatgtgtccatgtgttctcatcatttagctcccacttttaagtaataatatatgatatttggttatctgttcctgtgttagtttcctaaggataatggcctccagctccatccatgtccctgcacaggacatgatctcatccttttcttatggctgcatagtattctgtggagtatgtgtaccacattttcttgatccactctatcactgatgggcaaatatttaggttgattccatatgtttgctattgtgaacagtcctgcaagaacatacacatgcccgtgtccttataatagaacgatctatattcctttcggtatatacctggaaacgggattgctgggttgaatatttctgtctttaggtcttcgagaaattgccacattgtcttccacaacagctgcactaatctacactcccaccaacagtgtataagcctcgatcagaatcacccaaaaggcttgttaaaacacagactgacaatccctgcccctcactttctgattcagtaggatgcatatgggcctgagaatgtgcatattttggccctatctcaagtgatagtgatgatgctggtccagaaaccacactttgagaaccacagcacaaaggttacccagtgcccttccttgtttaatagtgactcattttccacacttcagccttcagcagta

SEQ ID NO: 272 - DNA, 1342 bp, Homo sapiens
taatgaagcaagatcttccctctgtaagaacattacatttcttccactccatgacctggctcaagttcactatgaaaatgatcactgccagtaggaaaattcctccagaaggatttttatcacatttccctttgaagaggagcaaggaatcaacaattggcatcccttggaagatgaaagcaagttcctctgtattcggaacggatgttcctctggaatcagagtaatctcttaatggaccctgatgacataacgtggcacgggcttctcgtctgaaatggcaggttactcagcaagacagagggagagaagcagatggatgtgacagtaaattctgctatgtacccacagacacttctaagacattaaaaagtagtgcccacatttccgactcccacaacgaaacctgtgaagaaatcctgacgttgatttcaggagcatgtgggatcttgcctctcttacaatgcgggtccctcactctggttatgccaagcacagcttaaactgacccctctggttgtgagaaagtaagccaagaggagactaagattctaacaggtttattttatctactcaaaaggaacactagatctggagtctggtgaagaagattcaagctctcattctgtgacttactagcaatgacacagagggttgcctcagttgccttatctgtgaaatctaaggaacaaggaagacagtgccacatggttattctgaagacgagatcagctcctatcccttgggccactctccatctttctcattttgctctacaatagaccttgacagtttcctgtcaccagctttttccctcctcagtgtcttcgcactgtctgttccctatacctggaatgctttttcctccgctgttcccatcatcaggacctcctttttatccttcagatttcagcttaaacgtctcatgctctgagaggccttttcttgctagagcagggtctttgtccatcagtcttcaccacagctctgcttattacctcccccataacactgtccaaaatctgtaattagttttttcacctgtgtattgatgtctccctatactagaatctggacatgaaaagactgtatcctcattctctagtacaatgccaggcatttaagcatttaatattcacagaatgaatgactgtactagaaaacgcttggaggctatacagtcctatatacatataagggactatgggactatatatatatatatatatatatatatgtatatgtatgtatttatctaggacttatattctgtgtgtgtgtgtgtgtgtgtgtgtgtgtgtatgagataaaagtatatatacccaagatatttatattatat

SEQ ID NO: 273 - DNA, 1507 bp, Homo sapiens
ggcttaattgattgaaccagattcgagaaaacagtgctaaattataattttctcaatactgtaaatatttttcaatcttcagcttcattaacttctataatttgaaattatcccaattattacctgacatgtactaaaattccctaaaatggatcttgagtaacattttcacagtacgataatttttctctctgtatatatttatatagtcacatatatgcacatacattatacaagcattacttttctataactgtaaggtcagaatttgaagttgtgttttctttatctttttatttccaatacttggcatcaagttgatattcattagaagtaaaggaggaaggaaatgaataatcttcagatactaagaacattacacttaaattattattaaatctaatttgcattctcatatattggcttagcttggttatttgtaacaagaatataaaaatatatgtgactgggaatgacatgaatagaaacttctggaaaatggaatggtaaggtctagagaagtggtaaatatttcatcactggaaatgagcaagcagaggttaggttattctttgacattgatattgaagcagagagtctctataatggatagaaagttcaaagtgacctttaggatcttttatcttcaaatttctatgaaaagtatatttactttaataataaggttaagatgttggagtgcatagagtaaaaaactagaaaagaaccagatgttagaaaggagatttcttaacaaaatacggttaaagaggatttctcatattttatatggaaagaaggaactttgatatttaagtaggaaccatcttctaggggaccctgttgattaaacaggaaatctagaaactagacaaagaaaaaaagaatttggctatatgaaagttaaaacttatattgcaaaagagaacataaaattaatagtccaaataaaattcagaaaataaaatatttgtaacagagatgccagataacaaatttgtatctataatatggaaacaactcttataatttgtttagaagataacccaatggataatgggcaaaggatatgaataggcaattttggaagatcaaatttagatggtcagtaatgtttcaaaagatgctcagacttattaactgttagtgatatgcaaattaaaataacaccaaactatcattttacatgcataaggttgtcaaagattaaaatagtcaaaacacttactactttggcatggggatgtgggaagtgatttgaatacattgctgttggaaatgtaagagttattttatctcttttttggaaggcaatctggcaatatttattaaaatggaaaatacacatactctatgctccagtaattccacttcaggaaatatatccctaagaaataaaagtactggtatgtacaaggatgtttatttcagcactgtttataatatcaaaaattacaaacaaaataatgcttattaatgggatgggtaaataaattatagtatattg

SEQ ID NO: 274 - DNA, 2157 bp, Homo sapiens
cctttggccctctattgagatttacttgactcatccaagttcaaaattaaagagtggtattagttttccaaaacttcagaggtttgacagtgtcacttcaatagcagatattttctcagatactacttacctaggtaatgtaggtacttcaagattacctaggacctctaaggccaacctttttttctggcaaagctgcagcttgccacaacccacatcttgatttttctttctggagctaatatataagtagataactaaaagcagtaaagcagtagagtaactccttcttcttccagacagaagttctacatggacatgaaattgtggccttctttggtgcctggactaaaacatcctttttgttcagacccaagtgacatttcattaaattgatcatgaactttctatttgataaaaatgtggctttttagtggctcacaagtctgcagacttgattttaggaaagaggccactttcacagaactaccaaatattatcctaccttgaactgctgcccttttgctagccatatcttctaaactacctgttgtggatcatattggtctgtttgggctcagactttcacctttaaggttttgctagggataaaatgtaatatgttatataaccccaggctactgaaatctcctttgctagcatcttggtagcaactctctcattcatatggagaaattcttactaaaaatttgagtagccagcaaaagaaacgatagcattttgtttagaggatcttaagggacagtctcacatgctgatggagagggtagtcatgatgagggtatcaattcttgatactatcctcagtgatgttgctaaccccaaggatcccttagcagatcattattcaagccagtgtcaggttgtttcccaattctctaagtttgagacctgtactatcagtacttccaaataagagactatcagttatgtcctagttactcagagaatagtggaagataactccatgccctagctaaaagagacacaacaaggactgcaaagttcagtagagggctcaccagctctattataagtggttaactcataacttaaaattctgcttttaaagcagcccttcccaaagtatggtccctggactaagagtatcggcctcacttgaaaacgtgttagaaatgtaaattctacttcatatttactatgtttagcaagctgtctggtgattcagatgcacacaaaagttttgaaagcacggccttaatgtgcagtatcatccttcaccatgtaatatacaacaagtagaagaaaaatctactgtcctacaacagcattgctccagggtaattcaatgaggtattgaacctgaaagatgatccaaataaagaggtctattgttgaaatttgggcaacatgtataaatatgtaaaacataaaattgctctcatataatcacttgaggttgggaggtaggtagctgttataaccatgaaaagaccatttcagtagtttttcccctcctgttgaccctaaagctggcagccaatcttgcgtgctccccaaaccagaattattaataattaactgcttcccaaggattaacagaacaacatacctggactacatactaggactaaagagtcttcacttggttgtgttaatttcttgtagctgccataagaaattatcacaaacttggtgctttaaaacaatagaaatgtattctcttacagttctggaggccagggctctgaaattaaggtattggcaggatggtggtccctatagaggttccagggaagatcccattccttgcctcttctaatttctattagctgttgatgcttcttggtttgtggctacatcactccaatctttgcctcctttttcacatggacttctcttttgtctctcaaatctcctgtgtgtgtctcttataaaaggttacttgtcactgggtttcaggcccatcagatccagggtctctacatctcaagatctttaatttatacctataaaaaacctttttccaaataaggtaacgttcatgggttctgggaattaaagcatggacatatcttttggggggccaccatttaaccaccataccatgtggtagccacctgcatacttatggtacttatggccacagtttttggactagagagatatggggga

SEQ ID NO: 275 - DNA, 3501 bp, Homo sapiens
agatgcttcacctagaatgaatatactttttccaccttttcctcaaaactattgccttctattagtgttctgtcagaagtagctctctggtacaatactaaggtgcaagtataagctgatctactttttaaaaaacagctacggtggcatctttaaggggttttaagtcagccataaggagtattagaccaatagaggagaatcagttaaacaacaggaataaaaaaagggaagggttaaggaacttaccgaaaataaaggtataggaatttcttcctttaaaatttatttaaattttggaaatatggggtaaaaatgagtcagtgagcaggacgtttaacttgacaggcaactttatagttgcaaaccattttaaatttcacttcgactttccattatcccttagagactcgaagacctaatttagactgtctggctacactatcacagggggatgatttgtgcacttagggtatcccttggggttttctacctgtttggaaattaagatgtaaattagtattgtagtatgttagaggggtgtactggcaggcagttaatttccttaggtgaaattaatgctcagagagaaatcgtacttacatattcaggttaggctattacataggcacttcaatggagtgaaattaccttttcttctatttcatacaagtgttgtacaacacaaaaattacataatcttccatgttaataattactaatgtcaccttaaaatattgtatgctattgaatgattatgcatttactggaaatgtataccccacagggtatttaccaagtttctctatcaggcatcatcctccctcttccgccatacctggaactgctgtgttcctctttcactgtagggactaagtagatatgtattaatttttggattttcttatatttagatagtttttgaaaattttctttttggtgatcactgaagttctctgttagagacctagtggcaaaagttattttaactttgtgcttagaaaataaggacactcttcacttttacataaatataaagaggatgcaaacatcaagtacttcattaattaacaagaaaacttttagaaatatcatgtgttttgtcaccacaatgtgtggcacaatgccagcagatggcataaaaagtgtttgaaacgtgatgtgatttggttttgctttcagaaaactaaacagtttctctttggattgagcatagtatcttcttcatgtacatgtcatggattgcttagatagtttttacaagttcgttatctatctcgtaaagcccacattattgtagtttttgatacgtatctctttatttcatcattttgacatagccataaatggtatcccacatagatattcaaacaatgtaccattaactaggacatagaaatcctagtcattagctaacatgaccccacgtggaaatacaccactttatggagtggaagggcaagggaagcagatgggggaagaagtatgctcaaaaaatagaaaagtatatacaaagaaatacaagccatgaggtgaatgataaccaaacagattttttttttaaataagagaaaaaacaaaaagtaaaacagcctagatgataacacatttttgcctggtccagcctttgggaaaccagattacattctttcatctcatagtttcatgggcatgtatttttaccagggaaagagaatttgtacatgataatatttctaaatcatactctaaatcattctctgtactttcagaattaaatcttggcacacatgtagtaagcctacatgagaaggtgcagttccaatacaactgagtggttattattaaatcaagtagtgaagatccagttgtagttcatttgagagcaagattctgtgaatgctttaaatgtattaacagtggttactttgctctgcaatggcttacagtcaagagaggggaaaactaatgcatataaatattaatacatgatgatacaatcaaatactaagcacagatataactttgtagagtgacctagagaagatataattgattttgaagggctgaattttttaaaagggatcttcagctgggtttataggtaaatagaatttatatagccacaatagagagttagaggtacagaaagaaggacatttcttgaaaggggtctatggaaaccaaagcacgcataagggaatgaggactcagaagttgagaaacctgaacagagggtgcgggacagttttactttggatctgtattctgcctcttcttttcttccttctttcttagtcttccactttttttccctacaaatatttgttgaattacttgtatgtgtatctgttctttaactgtaagcagaaacccagttcatcatgagatttttcattctctcttcatgcacacagaatagttacatagatatatactgctgtgaatgtctgtttcaaaagctcactttaatgaaagtctgtttttgtcgtaggttttatgaaaagaaaaaaataaacattgatatctgaacacatgggaactagatgttccaactcaccctcttgatgtctgtaattattttattttggcactaatattaccaagcttgtttataattaaagataaatgaaatagtaaaattaactactttatctccttatttaaatttcagatgggaaatttggaattttactgtttaagtcctttgttaaatatctaaaagggctctactacagggagacggattaattaaaatcaaaattgttgagggaatataattaaaaacaaaatcttataccaacccagaaatcccctccaccaaagtaatagaaaaagaaaacacttttactattaagcattaaaccagaatgtgatgaacattacaggcaatccactaagattataaaaaccaaaagaaatctcacttttctatattgccaagtagatgtagccaagagtgggattacacacatgctttcaagataaacaacaaccagtcctcaagtaaaaggacttgacagccccatcctaaattcttcaggtaattggggtgatcatctgtgttagctaattggctttctctgaggagaaacaaatttctcatccctttatgacaggaagaagttttgcaacttggagcaagggtaaccctgaagttaggctcctaccctcccataggaactgggagataggggagctttctcccttgatgtttgcatttcaaaaagatagcctcaaggttcttgagaaagcatttctgagttgtgaggctaatgggaggcttagttagccatcattaagatttacataaattctcaaagaacaaagaaagaaattctaaaagaaaagggagggtagaaagcagtctctatctacccttgttttcagcagagagatttgaataagaggtatatttgtccttacagtgtaaaatgaaggaaataattgttttttaagaaaagtagtcagtggatattttgggttacctgagtatattgtcagtatattctaaaacaaata

SEQ ID NO: 276 - DNA, 1381 bp, Homo sapiens
gggatgcctcttaaattcataaagggaatgtatggttgaaatagcagatcagaaacatcaggaaagacatttgagttggatccatccttcaaagctctgcaagactctgcaagctgtattctagcacttgcccactgggtggagccaatgagctgttaaaaaaaaaaactcgtttaaataaacaaatggcaatgctaggttccatcgctttcttcatcagagccctcccgcaggctagcagggccaaacacattccttcctctctgagagtgtggccaaaatagcttctacccagggtgctctttacaatgaatttgccattgctggagttactgaatgccctgtgtattaaggcaggccactaaagaactccaaaacgtgtattaaaaggcttccgctgaggtgatgagaagcttctgagaaagttcctggtgactgtgcttggcttgtatatgaagattttcaaaaacacctgaatttttcaaaatgtgtttttaacagaagatcaaagtagaatcttggttgtggtcactcggtttcatttgttttaaaataaagcagtaattgattctatgaagtccctggttctccactgtcaacaaaacaaattccatcctctgaagcctgtcaaagaaagaggacccatcgccccctgctcacctcctgctgaattccctcccactcaccacaccagccaggcaaactagacttctccaggtctccaactggccagtttctagtggtttctttcttatatctggtaaatattttctgcccttctctgcctggcaaattttgacatcctttaagatgcaattgtcagctcctttcttgggtatctccatcactttgcacacatttgcattctatcacattggaattcatcatttcatttttgcctgaatctgagaagaacattaatattttttagtatattaatgtatgatgcatattttattcaaattgtataacaggatgtatggtttgatccagttattttgagaaaaaatataaagaaaaatatgggtccaacatgataaatttatctttgggtgaatacaattgtgtatgttttctgtttctaatttttttgtcctttgcggagtctgaagttttagatatttttgatatgcatgaatttttttctaagaaaacaagaccggttatttaaaaaacaaaaaggaaagtagacagagactccaatctgaaatcatatttcactttagaaatgaagttaaaatgacatttgcctagtttttgtggggacggtgggggtggatgaaatcagcctgtcttttacataagatactcaattttttctgttctgatctaaacactttttaaatttaaatcttctttatgtacttgttagcagttggaa

SEQ ID NO: 277 - DNA, 1910 bp, Homo sapiens
tctctgaaaaaacttctaatctacaaatgcatgctttgtatttcaggcagacattgtagaatgtatttacaagaataggtgactgcctacacaaattcttttggtctaatcataaaagtaatattgtttaaaaattagaaaatgttatcattatcacccataatcccatcaagaaataatcactggtaatattttgttgtgttatcttccagtcttttttctgtgtgtgtatgtatatagttttgttaaaagtacaattagagtcatactaaatattcagtttgtatcctcctttttgtacttgacataagtattagatattctttgaacaatgaatcaccatataaccatcacacagactcagcaattatcaagacaaagtaatacttagatgcctcttcttgtacatatctttgacagttggtcctgacaattttccttggctaaattcttaggagtggactaaatcccatttacattacattttacattaagagttcatgaacactttgcattatactccacaatagatgtttgtttcatagaaaatattgaaatgaaatgaatgagcactatttgtcttgcagtgttggtacccgttgcacacactgagtttcccagaagtatgcatgctgccgttagaaaaaaatggacacaggactcaagaaccaaagctataaaaaggaattagtagtcttcctttgagtatagcagtggttctcaaccctggctgtgcattagaattatccagggaacataaaaaaatagaatggcagtgtctcacactagaacaattgaatctgaagttcctcagatgattctaatgtacagccctggttgagaaatactggcctacagaagtgattctttaagtgtggtctccggaccagcagcaccagcaatatctgggagcttgctagaaatgcaaattcccaggcctcaacctagcagcactgaatctaacacttggggacaagggtccagcaatctgtgctttaagatgtcctccagaaatcttgatccatgacaaattttaagaaccacaggcctagaatattcctggctcaaggatctagcttgcttaaccaagtgggaagtctggctgaagatttacagaatctggtgtctgacttgaactcaagtctctcgtctcccatttattagctacacgatcttgggcaaatgacttagcctctctgaggctgtttcactgtgaaggacataaggatcttaatagcatctaccttgttgggctgttgtgaggattaaagggaaaataatgaatggtattttccaaaaggtagaacttgataaaatttgctattttcattagccatcagagaactattactgtggtcaggagatcaggaaggaagcctccgaggtggagggagacaactgatctgtcagtctgaacacccaaaacagatgtttgtttcctaactcttttccaggcctaggcttggatttagattacacctgctgtgacacaaatacatgaatctcccaggatgagacgatgagtcattctctcaggagctgtcttcacactacggaagtgctgaaaatacacggctagagagccgggcttggtcatctggacctcaaaactgccaggggtgggaggaaggggagaagggaggggaccacccttctaacacctagaccagtgttctcaaacgggagccctgagaagcacctggagtgctcactgaacacagactgctgagctgcacccccagagtttcagtgagtctggggaggggtctgagaacttgtgcttcaaacaagttcccaggtgaggtttatacaaatctgaccacactttttatgctaaattgaaaacactggcaaagttcatgaaactgcaaggcaactgaactgtgacctataaaaagttttaaaaacta

SEQ ID NO: 278 - DNA, 16545 bp, Homo sapiens
agagtggatctttaactgaatagaagagattgtgttttgaaaatggaaagcatacaggttatttttgttttaggaaggagacaccatgaatatctcaaagctttagagaagtgaaattcttttagaaaaacaacgttgtgattaaacaataaaaacaaaatataagcaccattcttgccatggtttttgttatttctaatacaaattatatgtaatcatcaagctggaaagggcactaaagatcttttagcctaccttctttttttaggtgagtaaactggagaatatagagatttttcaagaactgggaagggtctgagattttaggctatttgcaaactaactagttagcttgtcacggtttcatgaatgctggtagaaaatgcaagactcctggataagaggtgaaagacagtttcttttttctttctttcttttttcttttttgagacggagtctctgtcatgcaggctggagtgcagtggcgcgatctcggctcactgcaacctctggttcccaggttcaagtgattctcctgcctcagcctcctgagtagctgggactacaggcatgtgccactgtgcccggctaattcttgtatttttagtagcaaagggtttcaccatgttggccaggctggtcttgaactcctgacctcaggtgatcaacctgcctcggccttccaaagtgctgggattacagacgtgagccaccgcgccaggccgacagtttcttatacacggaatgacaataaccaatgtatcagcatctgtatatccaatccttaagccccatttcccacaggggacataaagaaggctccctgatacatgtacaggcagagctgcatggcaggaggagagccctgcacttaggacccaggaccttttccaatgggtagaaggcaagtcggccctttctcctggagggtgatttatctttattacactagagagtaagcaagctatcccttttctctagagggtgatactgcctctatcttctcaggctgtttgctttccaaacaccttcaaaaactttatccagaacacagggcagtcagcacttcactgtcaagatgcacagaaatgtgagagattcatagagaattatttttcagcagggatgagtcacttgtagaagaccacacagttgtcttcaagctgagggttcttttcacatcattatgctgtttccccataaatacctgaagccacatcagcattttcatgatgcgtagattcctattttctggaaatttgttttttccattggagaggcaaactttgaaatcttcataataagattcatgaagtcaagacagtttatgctgtttctaaatatccaggttgttttactgcctcccttgcttctgggatcagcattggcatcccagttttaccttggatagaatgtggcctggcattgcttaggctgatggaggcagtggaggtagttaagaaggagatggaaccaaatgtccagtaagtctgaatacaaggtaactcagcatcacagatgattttcctgttttctcaatttttctaatatttgtcaccagtctaaatgtacaaagtcttagggatgtagatgaaattctgtggcttacttacaacacttaatttatgactttaattacccatacatacttcaatcacatatgcaattatatggtatgttagtgaaattgctctttctcccgtctcctgaaaaagtgttactcaaattctacacatgcatttgcgacatttagagccattttggggccatctgacgtggttttccaggaccatcatttctacattcatattaagtttatttttaatacagcagctgttgtttctgtgcataaattttatcttaaatataaatatattagaaagctttgtttttacatctgtgttgtgaatatttcatgatctctaaaaattaacaatgtagtttgtggcttttaaagacaatatttaaaaaccttgtgaatagtaacttccaacggtggcaggtataagggcataaccctagcgagtaatcctaaatccaggtcacatttctttgccccactttctatcaactcatttaactgagctccagagcatctcaactagaattagcttagggcatttcaagataatgcagcttcttcaaaagaaagggtcctggaccataagtcacttcctaagaacttgaatatagaaaaattccctttttactaagagatgatcctcacctgattatgcatgtgatattagcttaccttaactaagtaatttacaattctaatcccattttttctcatcaaaataggaaaaatgtatatactgctggtgtctgagagtagttatgagtgttagataaaataatgaatatgaaaatctacaaaccataacttacatttgtttatgtatttgtttatgatgttcctcccctgtcattctctatcttgattgttggcacccatatccacccaggcacctaaatttcaaacctggaaagagtctttgatttactccccctataaaccattatcaagtcctgccaaatttttaccttagtatatcctcgtctttatggtcctcttatcctaactattgccttgttctggctttaattcattgtgtcttggcaggctctatgatcacctgagagcctctttttcacacagccttcagagtaatcgacataaaggtgaatcaaattgtgtcactcttaaaattaaaatcttccagtggttgacatttgcctaaacacacccaaagtgcattcagtaattccaagttctataaagaaatctcctcttaataagtaattccaggccaggcacggtggctcatgcctgtaatcccagcattttgggaggccgagacaggtggattgcttggagcccaggagttcgagaccagcctaggcaacatggcgaaaccatctctacaaaaattagctgggcatgatggctctcacctgtagtcccagctacttaggaggctgaggtgggagaattgcttgagactggcaggttgaggctgcagtaaactgaaatcatgccactatactccagcctgggcaacagagtgagaccctatctcaaaaataaaaaacaaacaaacaaacaaaaaaggcattccaggaccaggtgcagtggctcacacctataatcccaatgatttgggaaactgaggccaggagtttgagaacagcctgggcaacatattgggaccctgtcccctgtctctacaaaaagtaaaataaaaagattagccagatgtggtggtgtatacatgtaatcgtagctacttggcaggctgaggcaggaggactacttgagcccaagagtttgaggctacagagagatggtgccagcgcactccagcctgggcaacagagcaagattcttcctgtcttcacaaggaagaaaagcattccataatagaaataattagaaattctgtgtaatcgaaatttttattgctgaaaaactcttatttgcatagtaaggccttataggagtcctagaataaaggcatctctttgtttccccaaaaatgtgatattcctaaatgaaattttttttgtttggcaaaacatctgttattgctctgagaaaggcacacatcaaaacgcaagcccataaaataaagcccaaactcctaaacatggtccagaggcttcctttcatgacctcgacctgcctgtttctctctctgcctttgacctctcctgagcccccaaccccaagtgctcgtaactgttagcagagtttgcaagaaaaagagagatatgttggatgtcctccaaaattgaggtgtagtctacactcttaaaattgtagtaagttgtaatatttattagttataatttatatttaaaattgtttttagatgataacatatcaccttatctttctctttgacacatgtagatgtcatcaggctatttgttctttggaggtagcacatacattttaaaggactaaattcaacaccaagattgaaattttggttgatattttaagagtcagtatattggcataccatacagattcatatcatggagataacagatgggaaagcggcataaggtatgcctaatttatcaaacctaggtagtgttcatatctcaggcatgcatatggaggaaaggcctgaattatgtcactgatagttttaccaagaagtacttacatttatgagattgagagttgaagctaattaatgatcttatacctttttttttttttttttttagtactcaaaagatccaaagttagtagtttgataattaggctgtacttcattttcagacagaaattagacatgattaggaatgctgaagcactgggcaggtcagttgctcatcattattaaagccatttaatgcattttaatggtggttgataaggtacaaaatgctacgtaagccaaatgaaaaagttttattccattatatgttaagcgtagatataaatgagttcccatttgcattttttatgcattagttcaaaaaattaaacatttctttcttatatatgagtaatagaatgtgtaatttgtaagagatgggcactgctgaagccagcacctcttcacactgtgcacctcaggattctcagacacaaattgttatgtaatagaaaattaaggaaaagatcttttcagcatttgtgtggctgaagaatcgtgctttaagctctaagaccaattgcttgtgtaagtggctcacatttattaataatataaaatgataatctaggtctactgtcttatttatgctaggcttacagactttgttaatttatagaggtaaacaaacaacaaaagagatagtgcatagtatagtttctggtgaatattctattttgttagccatgttttgaaaatattctatggccgggcgcggtggctcacgcctgtaatcccagcactttgggaggccaaggtgggtggatcacgaggtcaggagattgagaccatcctggctaacacggtgaaaccctgtctctactaaaaaaaatacaaaaaattagctgggcgtggtggcgggcgcctgtattcccagctacttggaggctgaggcaggagaatagtgtgaacccgggaagcggagcttgcagtgagcggagatgtgccactgcactccagcctgggtgacagagcgagactccgtatcaaaatatatatattactagttcccatctactttagagcaattcttatattttaaaattatttttcataaataacttagtgttgggatttgaggataccaataaataccatcctttttatgtacctggtttagaaaccattgagacacagttacagacagatggagatcaaaatattccttttgttaactgataaggagctattggggcttgtagcttatatgtgatgtcaggtcaagtggatctactaacacgttctgatacacaggctaacctgaggatcagtacttgggagggaggtttgaacctgcagagcagagagacttcctcaggatcgctgcctcgctttggtccaagggaagaggacagatagagaccatgtctcccatgctccactcacatgagaggaccaatggctgtcatccaccaacagatagctcattccactactatgaagagtactaagaattagacaagagccagaacaggtcttttgttggaagccagagtaatagcagcaagcaccttttatgcttcctaaacctcctgatgtggacaacacatgtagtttatggtagggctacacagacagcacactaattgatgatgccactgccttgtattgtcttaagggaggcaatgggaaacatagtatgtctttattctatttcttgtgtaaaaagtagatggaaatggatgggaacatccttggttgaggggacagaggttgatttcaaggctcttattacataaacggtaaaagaggagaggtcctggtgttaagctcatcagcgtccagcaacctcagccacaatgtgtgtctctgacctactcagggctgtccacatcagaaaactggagcataagacagtctctctccaaatgctcttgtcttggaggtgttcccaggcttcaccccatgcagccacccaaagggagagactgccaggaaggcggggaggaggcatctgtcctgattattgagtcaccaggtagctattagtggtcatccctggttcttcctgtgactgtgtgcacattacatggaatctccaagtggatgggctggttactgattgagactcctaagaagattgtgtctaaatccctgattatgtcatatcaaagcaaatggtatcaggatataaccaggaaggtttgttaaaggtgaaatcactgtttcataacagcttttgaaggcataagaaagccaaaatagttgataaatctcatggtgattctggacaagcaaggatcttcactgtcctcttaatgaagtgtaatgcaagtagctaacatgtttagaatgtgccaggcagtgttctaatagcctaacatgaattaatgaatttaaagtaaattagttcattttaagtctcagaaaagcccatttgggatgattactactattattctgttgttttgaggtggacagttctgtagatacctgtcaggtctgcttgattcagagtcgagttcaggtcctgaatatctttgttaattttctgtctcaatgatctgactaatattgtcagtggggtgttaaagtctcccactattattgtgtgggagtctgagtctctttgacaatctctaagaacttgctttatgaatctgggtgcccctgtattgggtgcatatatatttagggtagttagctctcttgttgaattgaaccctttcccattatgtaatgaccttctttgtcttttttaatctttgttggtttaaagcctgttttgtcagaaactgggttttgttttatcttcctattatgaaagagggaatgaggttcttagagggctaaatagcctactgacattccccagctaaaaaaaaaaaaaaaaaaaaatggcagaaggacaagagccatctctacagctggagcaccaaacccccgcatcacactgcttatcaccaacgcagtagaatcactggtgattcctactaagctgagtccaattctagaaaaaaatctgtgacttgtgtttgtttatttagttttaaaggaaatacaactaataacatttattaaaagcaatttttagtgttggatttgatttcagcaacattttagcaaatgctcatttctatatgacctgatcttatgtttatggatgatttgttttgctttgcctttgaagtttatatttgaagtgctaccaaatttatttagttgtttacttctttgtgtgttggtatttccttccttccactaatagcgtaagctctgtgaaagaagtgctcagcaatagtaggaattttttaagtgtttgtagaatgattaaaagaatgaatgaatgaagttaaaaagttaattgtttatttagcttatagtgacctggtatctttataaacatagtctacatagtcttaaatggagaactactgttaataactcaattgttttagaaagatgagacaaatgaattatttaaaatccttgcaggtctatgattttgttaaacgaaatgtacttaatgactcatattcttcatataagtgtgtggttaatgattcatatttttaacacaagtatgtacttatttatttttaattgatgtaaaatgaaatgatcagtgaagagttgtgtttaaaaatattttccttacaattcccaacagctttaataataagcagtctcatgcttgtttgtttttaactccagactttgtatatatgatttcctctccctataatgctcaatgcattccccttcatcttattagctcctttttatcatttagatattagcttccacatcttttcctccaggaaacatttctaggcccttcaagttgggccaagtgtacattctctgctacctctctggctgccttcataatgcagtgtagcttactggtcttactggatggtttccccaaacccatattgttctcgatgttaagactctctttagcacctagtacaggagcagacagagaaaaacataaatattgaatgagttgagtgaataaatgaatgagcatcaataactaagaaagtgggcatgctataagaattattctcaagtaacagtaaatgagtttgtaaaacagaataggagccccaggcaggaatcagagggacacatttagactgccctgcatagctcaaatggtcataatggtttcaggcattttgaaagctgggcatgtatcatcagctcatgccacgtaatttccaaccttctatgccaatcccagaagcaaggagaatgaacataaaaccagggaaaatgaataagaaacacttggtgaggaaacagcaactgcaggaagggcacagtgagccaaatgtaaggacagtttcccaggtgggtggagaaacccatgagacattggaaactgtaagagaagcaggcaagagaaactgcagaacccaagagaaactgcacagtacaccaacagcagcaaaagtgaaggacaccacaaggtagtgataccacaaggataaaggaatagtggaggagagcaagatagtattgctaaaagaaaaacttcagccgaattaaattcaaaggactttaattgagcaatgaaggattcaaaaatcaggcagcccccagaatcacagcagattcagagagactccaaggatgcctcatggtcagaacaaatttatagacaaagaaagtaaagtgagatatagaaatcggaagtgaggtacagaaacagctggattggttatagctcgggtttgccttatttgaacgcagtttgaacactcagcagtgtgtgactggttgaaatatggctgctgggattggccaagactcccgagattaaggtaatgttacaggcgtacactcctaaattaggttttcagtcttgtctacctattaagttaggttgcagttcatccacaaggactcaaatatagaagtatggagttcttctcagtccatacttaagtttgctgtaacagtatgactagtattatgtgcagagggcaatacagctctaagagaaacagttataattgagctctgttctgctgcagtcaatagaagtttcctctgacacatacttggtaacgctgttacccttcgtttgcctttgtgcatacctaagacatcttccaggacttttgattctcttgataatgagtcagcatgatgatgggccagggtcttgtaaggagagctcactttttggaatggatcttcctctagctttgttattctcagctcagatttcatcctgcctgagcccttatagtagaacagtaggtagctacctaacaacgtctgagaccctggacattccgcctttctcctcaacacacagttctttaatgctaccctgatagctgttttcttcaaggacttaggtgaagctgcagactgtctcatcaaatgagtgtgtcatcagctctctgacaacatattgtagagtgcttctcaaatgttaatgatcattattggggtcgataaaatatattattcaaaaattacaatacaaaaaaagtatgttacaagtgccttaaattgtcagagaaaggagaaataatttatacttggagtgactaaacaaaaactccaaggggattagatgaaaattatgttgtttctgtccaataagctaccccttgagcaatctaacatttatcataaattctgttggtgaatctgctatctcagtgactagctctatttgaaagaaaaagatagtttctattttcaagcagaaaaatatgaattacttgtctaaagtattaatagaaagatgtttaatcagtccttagtctctttctattgtgcaatacagatgagaaataatttcaaaaacgatgtggaaggatgcagtgtgccatgctagggtgaaatggttacccagaaggcatctcttatttggggttccttctctgtatagatgcttatgtgagcttaaattttttcatgtatgcttttctttaaagcccatcagagtataagaaaaactgaatgtctgttagccatattaatgagtgaatgaatggtttcctgtatgtgttctgttgtaggtccattaaatgaaagcactgaaacaaattagggctttacttaatgtgtatattaattggctcaagcctattaacatacaaaaagttaattagcaagtcaggacttgtagtaatgtcttaaaggtggttgtaaaacttatgtaaaagactttttctccaaaccattccacttctctaacttggaaagtttatgtaattatgaaatctgatcctaaaggatgtagcaaaaccagtggtctttcttactaaatttgttggccctgcacctagcctccaacatttttataatggtgcttctctttcatggagcttcaaaagtcattacaagaaattctactcctttgttcttccctttttaataattaaaaaaatcatctggctgggctgggtggctcaagcctgtaatcccagcactttgggaggccgatgcgggtggatcacaaggtcaggagaccgacattctggctaacaccgtgacaccccatctctactaaaaacacaaaaaattagcagagcctggtggcgggcgcctgtagtaccagctactcctaggctgaggcaggagaatggcgtgaacctgggaggcagagcttgcagatcgcgctactgcactccagcctgtgtgacagagcgagactccactacaaaaaaaaaaaaaaaaaaaaaaatcatctatgggatattttacttccatagtacacttaagtttttcttgcctcaatcaattaaaatatacatttgttaaaaacctttatttgcagagtaattgtccaagctgccctttaggatgaatcagtagagcttaaagatgatttgttacaatattaaatctaacaagcaactgatttgtaattttctaaagatattacggggtgaagaatcaaaatggacagcatctagaaatctgtcaaaatctagatgccttcttattacaacttacttcattttaatattgggaagttagcttaacttcaaaagattttgtctcataatactctattattattagtttgataaatttcaagtatacagaaaagtatagagcaaatatcccaaatacctgtgtgtcttttgccagtttcattctctcctgtcttccacattgcagcatttggtgtttattttttccaataatctcttagtgtttcactctatagttatagactcataaacaatatggtattgtttgcatatttaagctttatttaaatattagtacataaaatttaaatatgtgcagtataacaccattattgctttttctgctgaacataatgtttttgatatttatccatattgttgtatgtagtgctagttcatttactttaacttctatgttgtattctatatagaggaatgaacatttatgttgtttctaatttttattcttataaactcttgccatttatgcatatcatcttgtacacatgctacaagaatttctctaagcttatcggtgtgaaattgctaaatcatagcatttgtgcagatcttcaacttcactaagtctggagctttcagtttgcacttatccctccaggacatagactgcatattgcactgataccaatcagttctttctcactataaaattttttttttaatcttttgagtgtgaagtgatatccagttgttgacttaatttgcatttgtctgattagtgtgagcttgagcatttttgcttatttgctttatgtattttttaaaaattttaagggtaatactggcctcctaaagtaaatttggacgtattccccccgcttgaatttttcaaagtttaagaagaattggtattcgttcatctttaaatgtttcatagaattcagtgctgatgccatctggtgctgtgcttttctttgatgtaaagttctaaattacttattcaatctccttactcactattggtcttttcagactttctatctgttcctaatttagtctcagtaggttgtatgtttctaggaatttactgttttattttaagtcatctagtttgttggagtataattctttacagcagtcttttgtgattctgtttccttttttttttttttttttattgaggtggagtctcactctgtcacccaggctggagtgcagtggtgtgatttcggctcaccacaacctctgcctccagggttcaagcaattctcatgcctcagcatcccgagtagctgggattacaggcatgcaccactgtagttgattaatttttgtatttttagtagagacagggtttcactatgttggccgagctggtctcgaactcctgacctcaagtgatcagctgcctcagcctcccaaagtgctgggattaaaggcgtgagccactacgcccagccgcttctttctatttctgtggtatgttttaatgtctcctttgtcatgtctgagccttctttttattctagttaacctcactaaagtattgtcaattgtcaatttcatttttattttcaaaaaacaactccagttcattgatcttttctattgtttctctagtttctctttatctctgctctgatctttattttttctttcctcgtactaactttggattgagtttgttttttttcttgttccttgaggtataacacttggttgtttatttgagatttttcttcttttttaatgtaggcatttatagctacaaaccgccctctttgaactgcttctgttgtagcctataagttttggtgtgtaatatttccacttttgtttgactcaagatattttttgatttttctttcaatttattttttgactcttggttatttaggagcatgttgtttcatttccacatatttgttaatttttcagatttcctcctgttattgattctcattttgatagcattgtggtcagaaaagatacttgatattatttcagtcttcttaaatttgttaagacatgttttatatcttaacatatgatttatcctggagaatatttcaagtgtgcttcagaacaatgtgtattctgctgctattgaatggaatgttctgtgtgtatctgttagcattaccataataacaaataatgctagcttaccctgataccaaagccaggcaaagacagtgtaagaaaaaaaaaaatagggtgatgtccctgatgaacatagatgcaaaaattctcatcaaaatactagcaaaccaaattcaaaagcacattaaaaacaccatacatcataatcaaatgtgatttattttggggctgcaaggatggttcaatatgtgcaaatcaataaacattatgcattacattaatagaacaaaggacagaaaccaaataaacgtgatcaatagatgcagaaaaatgttataacaaaattcaacattcatttatgataaaaactctcaacaaattagatatgatttagtatgtaaggattgcaccttaccacaataaaggtgcaattttatatgtgataagcctacagctaatatttatgctcaatggtgaaaaactgcaagttttctttttaaatttatgcacaaagcaaggatacccactctcaacactactattcagcataataactggaagtcctaatcagagcagttaggcaagagagagaaataaaagacctccaaattggaaggaaagaagttaaattgtccttctttgcaaatggcacaatcttatatatagaaaaccctacagactctgagaactagtaaatgaattcagtaaagttagaggatatgaagtcagcatacaaaagtcagtagtgtctctacactaatgaggaactatcataaaaagaaagtaagaaaacaatcccattaaaaacagctacaaaaaataaaatacttaggaataaatttaaccaaggaggtaaaagacctgtacactgaaagctcagcaacactatgaaagaacttgatgacacaaataaatggaaagatatcttatgtccatacattggaagaattaatattttttaaatgttcatactccccccaaggagatctacaaattcactacaattgctgtcaaaatcccaatgatattctgtatataaatagaaagaacacttctaaaattcatatggaaccacaaaatacccaaagacaaaaaagaacaaagcttgaaatatcatagtacttgatctcaaaatctattatgaagctataataatccaaaaagaatggtatttcacaataacatatacaacagtagacagaatagagggccaagacataaattcatgcatttacagtcaactgatttttgacaaatgtgttgagaacacacacagaaaggatcatctttttaataaatggtgttggaacacctcaatatccacatgcacgtgaaagttgtcagaatcaaaatgaaggcactggtattaaaaaccaccacaaatacagctagctggggaagggcatgaaggggggcttctccggaacaaatgcctgataacaagaactatcataaaagattctgcaaaaaacaccttgtgcaaaaggccatcacaaccttacacacacacataagtcttgtggacatctgcctatcatctgtttgtccaaactcagactggtatcatacttgttattaatacatgtagtcaaggataattatctcaaaactattatttaattattctcattttttctttaaaaactttttcttgttttttttttttaacttccctgaatatgcacgtggcttactatggcacatgtattcccattgcaatgcctattctaggaagaatattattttcttttagagagtctcccttgcagtttgttatttattgacaaaatggtgtcagaagttaaaccaaagtgagctcacctaggttcaataggtggctcctggaatcatgtaaggtagcaattgagccctttgcactcttcatttccatgagtcaccttttctgtgctggtaaatctcctctcagattcttttacttcttcctttgttgagttctttttaactttattcaagatctgatttggctataaataaggctgccctaaataaaggaccttgtatccgtcttaagactatgaaagttttttctgttgtttttgtggcaagccctttctggtataaagacaaatgtccttctggttaagtactctggtttttacagaatttacattgtgtctatgagggtgtcttttttggtgaattcacttttgattctgcataacaggtttaatatttgtttgatctgcatacctgggttaaaatgtttgtgagtattctgattttggtttcattttggttatgcatgtctgtaaatgatttgactccttttcccttgcatgtttctgaacatttccaagagcaaaaataaacattctaaatggtggacatggaatggccaacagagcagtcatactaccatctacaacacctgttcaaattactgacattccctgagagaatttataggaatgtctttgctcttgagagaataatgagaaatggaattggattcttaaatattaaggcataccaaaactttctctgactcctgatggctacatagattttcctcatgcatgttttcaaatccataaccatcagggggattatttgaactccccccaagtctgttgtttttttttttaagagaattgtaactatacagttaacagatagagccttccaggttctgcctatctcactgtttctttgcctgcctactttgaatctgctgacttttctgctgatgttgagataaacttactgcttatggcattccagccaagatagaaaaaaaaagtcttaaagaactttgagattaatgccttacaaagtacagtagttccatggcaaccaatacctagatttctttttgagatgttaattttggcttgcctaacagttccttagtgtgatgaagcagttagttgaagagttgatattttaaaataaaagagctatttaaatgtttataaaagttaccaaatcaacagtgtcaaattattgaactcagagaaatagtataaagtatctctgtcagcattgaaattgctgtatctgtcacacaaggtctagaaattgctgaagaaaaaaataataacttaaaaaaatgtataatttcttcctggccacattgactacaaaccagaccagcaaacaaaagaataatctgttagtagttcaaggatgcttggacagtttgtttttcttatatgattcagccagtcctacgcgaaatgtaaacatttaaaaatttaactccttaaacttgcttgaagctgaaaaaagaaaatgggggggaacaaaagacaaaaagcattaaaaaatcaaactgctgtggaaattgcatacatgtatatatacacatctatgcacacacacatacacaaacacatgatcatatatgtattcctctagtaatttgtactgaagta

SEQ ID NO: 279 - DNA, 6506 bp, Homo sapiens
tgaaatttagagtcaattctacccagttatatatgttcaccttgaaattcttctaatttcttttttaaaaaaatgttatgggtatatagtagctgtatatatttatggggcacattagattatttgatacaggcatgaaatatgaaataagcacaacatggaaaatgaggtatctatctccttaagcatttatgctttgagttaaaaaaatccaattacattctttatttaacagttaaattattgactagagtcaccctattgtgctatcaagtactaaggtcttagtcattcttttaaactattgtttgtactcattaaccatccccacttccccccatcagactcccgctctggaaatcatccttctactttctatgtccatatattcaattgttttgatttttagattccatacagtgataacatgcaatgtttgtctttctgtgcctggcttatttcccttaacatgatgacctccagttctacccatgttgttgcaaataactggatctcattcttttttatggctgaatagtactccattgtgtatacgtaccacgttttaaaatctgttcatctgttgatggacacttaggttgcttcaaatcttcccacttttaaacagtggggcaacaaacataggagtgcagatatctctttgatatactcattttctttcttttgggtaaatacctaaaagtgagactgctggatcatatggtagctcaatttttagttttttgaggaacctttaaattgttctccataatggttgtactaatttacattcccaccaacagcatatgaggtttcccttttcttcacatccttgccagcatttgttattgcgtgtcttttggaaataagacattttacctgtggtgagatgatatctcattttagttttgattttcatttctctgatgatcaatgatgctaaacacctttttcataagcctgtttgccatttgtatgtcttatttgagtaatgtctattcaaatattttgcctattttttgatcagattattagattattattataaatctgtttgaattccttatatattctggtgattaatcccatcagatggatagtttgcaaatgttttctccagctttttatactgggacctatctctctctttagctctaataatatttcctttctatatctgggtgctctcacattgggtgcgtatatatttaaaattgttatatcctcttactgaaatgatccctttgtcgttacatagataccctctttgtcactccctatagtttttgtcttgaaatatattttgtctgatataagtataatgactcctgttcttttttggtttccattggcatggaatatctattttcagtctttgtgtgtctttataggtgatgtgtgtttcttgtaggcaacagatcaatgggtcttgtttttttttttaatccagtaagtcagtccatgtcttttgattaaagagtttagcccatttacattcaatgttattattgataagtaaggacttactcttgccaatttgttatttgctttttggttgttttgcggtctcttcttccttctttcttttcttcttgtcttcctctagtgaaggtaattttctctggtgacatgatttaattattttcgttttagtttttgtgtatccattgtatgttttttggtttgaggttgccatgaggcttgcaaatattgtcttataatccattattttcacgtgataacaacttaatactatttgcataaacaagcaagcaaaaagaaagctaataaaagttctataccttaccttcctatccttgctttttaactttttattatttctatttatattttattgtaattgctatgtcttgaaaagttgttgtggttattatttttgattggttcactattttgtctttctacttagaataagagtagtttacacaccacagttacagtgttatagtattctgtgtttttctgtgtacttattattaccagtgagttttgttccttcaggtgattatttattgctcattaatgttcttttctttctgattgaagtactttctttagcctttcttgtaggacaggcctggtatttatgaaatcactcagtttttgtttgtctgagaaaatatttatttttccttcatgtttgaaggatgtttgcactggatatactattctaggacaaaagttattttccttcagggctttaaatatgtcctgccactctctactagcctgtaaggttttcactgaaaagtctgctgccagacgtattggagctcctttgtatgttattcttttcttttctcttgctgcttttataatcctttctttatccttgatctttgggagtttgattattaattgccttaaagtagtcttctctggataaatctgcttggtattctgtaaccttgtacttggatattggtatctttctctatgtttgggactttctctgttattatccttttgagtaaactttctactcatgtctctttctctacttgctctttaaggccagtgacttagattttcccttttgaggccattttctagattgtttaggcatgttttattgttttttattcctttttctcttctgattgtatatgttcaattaggctgtcttcaagctcactaattattacttctgcttgatcaattctaatattaaaggaatctgatgcattctttgatataccaattgcatttttcatctccagaatttctgctttattctttttaattatttcaatcactttgttaaatttattgatagaattctgaattctttttatgcattatcttgaatttctttgagtttcctcaacacagatattttaaattctctgtctgaaaggtcatacatctctatttcttcaggattggtccctggtgcattatttagttcatttggtgaggttatatttttctggatggtgttgatgctagtagatgttcttcagtatctggccattgaggagttaggtatttatcatagtcttcattgtctgggcttatttgtagccattcttcttggggaggctttctagatatttgaaaggacttgggtattgtgatctgagctgatggcatcacaagcccagtaactctgtgtttcttgcagactcataggaatactgccttgattatcctgaatcaaatctgggagaattctcaggattttcagatactcttgttctcatcccttactttctccaaaacatacagagtctctctctctgccctgagccacctaaatttgggagtggagtggcacaagcacccctgtggccatcactactatgactttgctgggtcagacctgaagccaacacagcactgggtctcactcagggcttgctgtaaccactccctggctactgcctatgtttacttaaggccctgaggatctacaatcagcaggtggcaaaaccaactaggcctgtgagcttcccttcaaggtaacaagctcccccaggccctggatgagtccagaagtcccatctgagagtcaggaactagagtcagaaaacttacaaatctaccttgtgttctattgtattgtggctgagctggcactcaaaccacaagatatagttcttcccactcttctctcccctttccaaaggcagaggggcttcatgtcgtagccactgctaccacagacccatggggagtactgccagactacctctaatgttcccttaaaacccaaggtctcttaaatcagcttgtcatgaatgcttcctggactcacccttcaagacggtgaactcccctctggcccagggcaggtccagaaatgctatttaggagtcaattcctggaatcagggacaccaagagcctgcttggtgctctgcacccctgaggctctgctggtacctaaggtgcaagacaaagtcccctttacttttccctctgcttttctcaagcagaaggagtttcgccccatagccaccacagctggtagtgtgctgagtctcatctaaagccagcaagcctcagaggctcacctgaggcactcaaggtagtacctggtattgctgcttgttattcagagcccaacagctcttcagttagcaggtggtgaatgctgccaggactgggtcctttccttcaaggcaacagggtgtgcctaggaatgttgtctgggaggtaggacctcatgactctgcccagtgccctatcctgacgtggctgagctggtttcctagaagcaagacaaagtcctcctgaatcttgcccctcctctcctcaaacaaaaggaagggatctcttttggagtggcgagctgtgaagtgtggagttaggggaggggaggtgccagcactccttttgctgccctagctggtgtctcagtatgtcacatgacccctcggtccactgtctctgggcctagttcagcactagaactcacctaagagttgcagtccttgtggcctagactgcatttcaagtttacttgtagacacagagtgtagtagcccttagcagggaggtttgcaggcactcaaattctgacctgtggcatctgcaattcctctctggctagggctgatttagataccttcatgggcaggcatcagctgggtttggtctggttttcttttctgctctaacaagacagcactgagttcagtgacacaattgctgtgttgtcactcccccagtgcccagagctgctcttagcaccacactgctgctgctgccagggatagggaaagggtggcatctgtgattctagacttttttttaatctcttcagtgcctctttcagcaatattaagttgaagccaggtgctatgattgctcgcctgatttttgattcttatgaaggtgttttctctgtgtagatagttgttaacttggtgttcttgctgaagggatgatcggtggcgttttctattccaccatcttaccccaactctcctgaaattcttctaatttaaatgagaataggttatgtgaaaattcacatttttattgttgggaaaattctaattttgtgggtttttgcttttttttctgactctaacccattctccaataccaaatggaggtccaacaactccctttaattctgacactacctagagctagcatagaccccacaggttaagggctcagttccacaagactacgcctacatctcattccagctacaaatggggtctccagactactcacacttctgtccagccaactaaaaattcaggggttctctcgaccactcctcaggtttgataactccctaggatgactcacagagtcctggaaagcactttgctaaagattactggtttattacaaaggatacaactcaggagcagccaaacggaagaaagcccaggacaagatatgagggcgaggtttccatgccctcttgccagtgtaccacgggcagcactttgatgtgttgatgtgttgatttgttccaacccagaagcttcccaaacctcatagttcaagaggggtttttgtttgtttgttttttgttttttaagctttattacgtaggcatgcttgattaaatcatcgtccactggtgattcattcggtctccagtcccctttcccctcccacttcaggagtgaggctgaaagttccaaccctctaatcatgtggtttcttcctttagcaaccagctcccatcttgaaaagatccaacctcacggtcctcaaaggtcacctcattaaaataaactcggcaatatagtttggatgtcctctccaaatctcatggtgaaatgtaatccccaatgttgtagttggggcctactgggaggtgtttgggtcatgagggatttctcataaatggtttagcaccatcacattggtgatgtcctgatgatagtgaatgatttattgggagatctggttgtttaaaagtgtgtggcaccttctccctctctctcccttgttcttgctcctggcatgtgatgcacctgctccacttttctttctgtcatgagtaaaagctccctgaggcatcctcagaagctgagtaaatgcaagtgccatgcttctacagcctgcagaactgtgagccaattaaacctattatctttgtaaattacccagtctcagatatttctttatagcaatgcaagaatggcctaacacactcagataaggtcaaaaggagctccttattaatgataaaagacactcccattacccaggaaatcccaaggcttagaagctctgccaagaatgggcacagatatgtacgtttttattagaccacactaatcatgcaatctttaattactaacccattgagaaaagagctcttggaaggactctgacactaggtcataaagttaaaccagaatgagaaagatactgaatataagtgcaaagaacttgaagccaagtaaaaagaaacaaaggcaacagcttgaaggactgctgggtaccaggcaaatttactcagggagcttgtttcctcctaacatcagtctcccaaagagtgccctttct

SEQ ID NO: 280 - DNA, 1440 bp, Homo sapiens
cccactgtcgatactttatcatcattactatcccttttagtaacttagtaaaaaagcacctctaggatctttcaacttactaaagacttttcctagaggaggagacaaatctgattctgcaaactttttttttttttttttttttgagacaggatctcactttgtcacccaggttggagtgcagtagtgcgatcacagcacactgcagcctcaacctccccaggctcaagtgatcctcccacctcagcctcctgagtagctggaacgacagtcatgtgccaccacgcctggctaaattttgtaatttttgtagcgacagggattcagcatatttcccaggctggaattcctggacttaagtgatccacgtgcttctgcctcccacagtgctgggatgatatgctgcaagccactatgcctggctggctctgcaaacttttacttctatgaccctttctttctcttggtttctccttgacacttctccccaatgaacccatggtgcaatatgggagttggtgccctaaaagtgactacctcctaaaatcactcacactcaattattagtaaagttcaaatgacaacttttttatgataattgtgttttaaaagaaaatctgagggatagtaaaaacaaaaaaaaaattcatgccagaatttcaggcaagcaccagttgagaatgtatttttgtgtgagcagggtgttatcagtaaggttcaacatgttctacataagggactggaagctctgcccgggatgtatgagggcaatcttgcctggcctaaaggttggactgtaggtagcacaggacttccgggtttggagatttagaggataagtctaggcttcacccaaataccaacaataagaacttgagtagttcctgggacctccctgagcctaagtataaaatgaggacagcaacacatatctatactgccatgctgttataagaaataaatgagataagaaatataaagccttaggagtcaatacagtgcaatggtggagcatgagtattgcagagtccgattggttgggttcaaactctggacctgacactaattaagggttaatgaccttgtgtaagcttttaatctctgtgtgcctcaatctctctatccatatgataagggatacaagacctttctcatacagtggtttaaagatgagagtaaataatatatgtgagaacacaaatagaagagcatgcatatgaatagcatttaatgctcagttaatgaggctcttatcaaagtgacagagggcctccatgtaatcagagaagggtccacttaaggctctattggcatttgctgaaggatcaagacttgctgtattcctatctatgaatagacctatggaattaaaacccagtacaagcattttttttttctacttatatctatgtatgctctttctctcttgccttcttgata

SEQ ID NO: 281 - DNA, 6086 bp, Homo sapiens
tagataccaagataagcaatagatttaggttttttgatggaattctagtggatgccttggctctctttgtcctggatctagggacactctagtcagattctcaaattttttcttttttcttttttgcacattcatggcttgaataagggtaagagagcccgggatagatgctaacaatctttcagattgttatctgaaatagatatcttgagatatgctgttagtattttcttcaaggcatgccatgttgttagcattttcttcaaggcagcccatgattaggccagaggaggaggatgccgctattcacttctaacctccatccttgaattatggtaaatacagaagatgcttgctggtcagaagagagttgactcattatgtcaggtagtaaaccaaaaattttctccctttatgatgaaagaaaacgcagataaaagcatgaccaataaacaagccataagaatggggaaaacagtgatgacacggggttagtgctatagaagttcccagaaaggtgtttgaaaactctgggcctataaatttaattatgtactattatttactaatattatatactaatatttactttgtttggaggtagaaacgctttactatccacttgtctttagtgtgaacactttcttaggaagcattaatgaaacacctaatactacctgcttccatggcagtccaaaattaagctctaaagattgaggagtcagaggtaaaggtcggtaggtttttctgtggtcttgacttcttctcaagatatctatttgatttccagtaataggaagtggctcccaattacatctattcccagggtccctccctattctcttgtcatcttgatttcagtttggcctgattagatggtactaagttttctatatggtaatttatattacaagaaaaattggtaaatggtgggatactgcttcaaatctgcagcaatataggtaggtgtctttggtgaggttttgtttgcaattataggattccctagatggggactctttcatgaaaaatcataacagcaagtggttgaataaaggttatttctagactgttttctccagactaattagagtagtacaagggccaaccatacagcctcatagtttcaagggtgctttgggagtcagatggacttgagtttaaatcttgcctctgccacataaaagctttgtgagcttggacaagtcatttacttctctcagcctcagttttctcatctgtaaaatgagataattatggcatcttatagaattgttgcgataatttcagatagtctaaatataaagcatttggcaggccaggcgcagtggctcacgcctgtaatcccagcactttgggaggccgaggtgggtggatcatgtgaggtcatgagttcaagacgagcctggccaacatagtgaaatcccgtctctactaataatacaaatattagctgagtgtgtggtggcacacgtctgcagtcccagctactcaggaggctgaggcaggagaattccttgaactcaggaggtgggggttgcagtgagccgagatcatgccactgcattccagcccaggcaacagagcgagactccatctcaaaaacaaaacaaaacaaaacaaacaaacaaaaataaagaaataaagcatttggcacagttcttggcacttagtatctagccttcattattagtcttagatggaaaactggatgcctcaatagacctggccaggacagcattcccacagtctccatcaagtcagcaagctttatcagctttatctctgatatttctttctagacagttcctctcctttttcatcattaccactactgctgtagacctgggcactaccttctcttagttggattttttggtaatacttatacacggttgccatgtagttctcataaaacttgttttgttttgttttgttttttcccccactgctcaaatacctgctctagatccctggtcctcagctttgtacttaagactatgatttggtatgagccagttttatcaatttaatcatctattttttattttcttcacgcatttctccccaaacacacatatcatccccaagccaataataattcctttcaaagtactttttgtacttttggtcttatgtatgtcatgttgcaatagcttttcaagttgattttcgtgtgtgtgtgtgtgtgtgtgtgtgtgtgtgtgtgtgtgtgtgtgtgtgtgtgtgttctcttgctttcttttagttcattccctatgtgaccaccagattaatcttttatataataccaacctgacctcgtcactcttctgaaccagagcgatttcctagtgcctttaggatcaagttaaaacttctacatcagctggatgcaggaggtcttctggggcatttttcagcctcaactcaactgtcactcccactatactgtgcaattcaactatattgattgctcttgagactacacatatgccaagatttctcactctcatttcttgccatccgtgctatttcttttaccttcctatttcaaaacctggctaatgccactcatttatcaggtctcaccttagtactccatcctttcaaaggcatttctgattgccccttccctctgcccacagcttgaattaagagctcatccctgatttcatggtagtttggaaatatctttttagaaacctttatcatgcaaattgctcattttgattttctgactgtctcctcttctaaaagaaggcttacttgcagtattttttaatctttgtatttccatagagcatgacactcaataaatatatgagtgtgtgaaaaactgaataaatgtgtgtatgtctgtttcttttaatagagtaagttattttagggaagggccaatgactcttttctgcttgtaggctccacgtttcctagcatggtcctttgtatataatagttgatcaataagtagtgtctgaataatgatatacatgtctatcttccccagatcattctaagtttttcagcaaaaagattgtgtcataagaattagatagcctccagcacaacgaattacaaatacttcatactctaatgcacatgtttaatttttgcttggagttgaacttaagttatggtgccttatgagagagtcaggcagcttctctgtactacataagcatgtactcgatgaagcttggggtcaaaaacctggaaactaagtttagttggaaatttaaatgctggagactggatgcatcctaggagtggattactagtattgatactcctagacaattttctattcttatttggttctttctccataaacctgaccagtccatgtatagcaagcctcaaaggatgcaagccttgttctggtgttttttattgcaagtcaaagtctatcaggagctgaggaatgagcagcagtgggagggtgtattaatttcctgtggttgctgtaacaaattatcacaaatttggtagcttaaaaatagtaattttattttctcataattctggaggtcataagtcagtttcactgggctaaaataaaggtgttaacagggctgcatgtcctcttaaatgtcaaggagagaatctgttgcttgactcttcccatttctgatagctgcccatattccttggcttgtggcccttaatctctatctccatattcacatcatctctctgtctgtatgtgtgatcttcctttgccttcatcttataaggattcaagtgcttgcatttagggtccacctggagaatacaggatagtctcacctcaagatccctaacttaatcacatctgtaaagactcctttccaaataaaataatatttacagtttccatggattaggatatatctttggggaacattattcagcctactacagagatacctttctctttttgtagattcaaagtgcttgatcttctaagaacattgtttgcttacagacatatttcaggagtaaatgacttccaaactgatggtccgttgaaaaaaagcctggggctgctgtcaggaaaggtctaatttaggtcagcctaatgccactgaacagatgtatatggcaacattcccaactcccattaggaaaataagccattaattaatacttattgaggagctgataagtaactggaagagctggtctgagttctggacaaggaatcagtgacaatcagtttccactgtctggctgttgtgggtagattgtggtccatctctgtaggataaagtgtgcacagttggcttggcactcactcttctgtgtccagcagtagctcttgccatctgtcttatcaagagaataaaaatgggtctaagttgtcactgggagattactgagtatcagtggacactatgagctcgagtgggcaaccccatgcaaggttagagcagggacttcaccaatgtttgaattagggaacttcagtacctaaaattgggatgcagatgtttcttgacttcttcatgtcttttccacctctttcatataatctaagggggatatggaccttggaggagtcttcctcaaggctttggcaggtgctcctaaacatgcttcatccatgcctacttgagtgtaatctgctatcttaagccacaggcaggagagatcaatttttctagtaacttcttttataatccagctagctgaagaagtgtgatcaaagaatcttaaaagtgtgatcttgaagaatcttagtttctcttctgttgtagagagaggatagtaatagttgctaagcctataggctctgaagccagacttatctctatttccatgctggctccactacttaatagctgtgtgagcttaggtagataataaaatctcagattcccagttttctcaattgtaaaatgaggataatagtaaccaatatatgcaaggtgccaggagatattctaagcatgttacatgtatttaaccttcttattctcacatcaaccctatgaggtaaatgtactattgttatcctacttcaaagatgggaaaactgaggtacagagagattaagtaacctgtctagatcacacagtaacaagtcgcagaacaagaatttcaactcagagtatatgcttcaactcagaatatacttcaactcagcatatttgctgttaactatattttatgctgcttcttgtgcctcagattgtgaggatcaaatagggtggccatctattccaggtcaccttggaaagttctgggtaatatctcctgtccaggtgaattattaatagtgcctccttcttttattctcaaaggtattgtcacatcttggtttgaatatatttcacatttggattaaatagtctttacatgtgaaacactaagaacaatgaccaacccataggaagctctctgttaatattagctatcactgtttctactactgccatcaccaccactgtcaccatcacccacattcatcccaagtctgggacccttagggttaggggattaacccaagttctgcaaaggcatgtcatgggagccactgttcccagttcccacacccgtagcagacattgctcgttgatcacagtacaacagtcttccttacttagtgtcatagacaaccattcgtgatagatcacgtttgagatgtgaaattaaaattatttatcacacctagttttatttaatctcagaatacaaaatcccagcgtatggagaatctgaatttagtctgagcttgtggttttatatgaaaacttatttgattcctagaagtgataatgaatttgggacctctttagacatcctatgtcccttttctccaatatttctttctacctatttctctattatttctacctcttcttttatataaatataaaagaaatttaattcatcagtttcctattctctgcctataattttatatgttataataaaagactattgaaatactaccaaagtggacacaatataaataaggcaacggagtgagtcatcataggaattacagttggcacccaagatcaaaggcttagaaaatctatctttaaatgtgatttgtgtaactggtagtgaaattcatttcaggttgattttgcatggcataagggacatctagtggtgat

SEQ ID NO: 282 - DNA, 7088 bp, Homo sapiens
tcttccacagattttcagagagatgatttattagtccaaatttgagcattgaaactagcctatattctaagtttaagaaaactgtaattttcatgtttctttcagttcaatacaatttatatattgaatacaaaagagattttcacttattgatatggctttctaggtgtttaaattctaactcaatattttaaggattcagtaatagtagggtttccatttctacatggtaggcattctctagtttacttttcctcttctttctgtagaaattaactatttttgcttcacagtcatttcatgatagacccgatttcttacactgaaattcattttaatgtttggattgagcaatggtttgctttggtcttaacttttatttattgaggtataacttacatacaatgaaaatctcaaatcttacatctactgttcaatgagttttgacaaatgcataccattgtggactccatccacatccctataacaaagcagggaactttttcaccttttcagtaccctgtaaaagttacctcatgcccaattctccccttcctctaagcaaccactgatctgatttctatcaccatagtttactttttcatgttctagaattttataaaaatgaaatgatatattgtatccttttcttgtctggcttctttcactcagcatactgtttctgagactcagcggattgctttttaataatataattacaactgagtctcaaagatttgaaaaagtcagaatttcttataaaattggacattgtggtttgctacctgctgaatgatgaagacgaataatgtacttcagtgccctgagatagtttttgtctactgtaataaaatatttccagtcttctctgtttttgcattcttcaattattaccttgaagttttaatgttttttaaaataatgaattggcctaattgtagcctcagcacaactactaagttacacattcaataaaaagactttttctttgtaatgttatatgttaatggtcagcctcctagatactgatgaagcccatcaatttctactgatagttaagatcaattaaccaattagttacccattttcatttttcctgtatattctttgtagatcacttactaaaatgattttctaagaccttcactttcttaagtaaagaaaaacaatttgactgagacttggccatttagctaaaatctaaaagacctatttaatttaaagtataagtcaagcagagatcttatcttctgtccataaataataagaatgattgtttttcgctaagtggaaaaagtgagatgaggcaagaagttgaagaatgcctagccaggtagcatatgaagcctacaagtttccagctgtgggtctgatgaaaaataatgagacatctgatggaacttaggatcttatttgaaaaataagccatcaagtactttaactttctggtatttcaaaagtaaaaacatatactaatcacttgtttttatttcacttatttgacactacacatctgtcttagtacaaactcatgtttatgcaatgagatttattagactgatagttcatatcttagccccttttcatagagaatcattgaaaaaaaaactgttcactgtgagaaaactctctcccctcactactgatcgcttatagtaccaattcagtatatgagaagacactatttttacaattattcacatccttaagaaaataaaactctataatttaaacaatgggagtataaaggtattttagaacgtatttgtatatgttaaaacaacagcatattaaaaatttaccttgagaaggccgggtgtggtggctcacacctgtaatcccagcactttgggaggccgaggcgtgcggatcaccaggtcaggagatcgagaccatcctggctaacacggtgaagccctgtctctactaaaaatacaaaaaaattagccgggcgtggtggcgggcgcctgtagtcccaggtactcgggaggctgaggcgggagaatggcgtgaacccgggaggcagagcttgcagtgagccaagatggcgccactgcactccagcctgcactacggagcgagactccgtctcaaaaaaaaaaaaaaaaaaaaaattaccttgagaaaaacaagcaaacacatgaacctaaaaaggcaacagcagatatagtgttgattgatccactgccactccagaattatttatggtagcaaaaataataattttcaatttgatggattcttatttaagcagactcattatactttttggaaaataaaatattaacattcaatataatatgactacctcagtcactttagctccacaggtgattgggatagcgctgctggcctgaataataaaatggtaataacctcagttagaacaaataattgttttactagttcagatacacttaacattataatagatgccctcataaggtgctatgtataaatcctttttttgaaaaaaagcttgaatcatcatgtaaatgttttagggcaactcattgcttagagaaatcctttgaagttttcttttataatgcaaaaactcctactgccttatctgttttgtaaattaggttgtattcgtaccagttttgttgaaaagtgaaacatccttctaagcatgaaagttttagaaataatgtctaagtatatctaaagtagctattataggacataaatgcattgatattttagtggatctcagtctagaggtgagaagagggctaatcataataattgggactgagtgtgttagaattacacatctttcccctgctctgataaaaaatatcctgccatagagagtcactgatactaatcagagcatgtcatatctttcagatatttggggacagagaaaaaaaggtgatgaattacagtactagagatactatagcctttaaaataaatattatatacttttggttctacatacttttaaatgaagatggtccatgaagtaagttatgatcaaaactaatgcaagggcttacagcctaagaagaaagtccagaatttagagaatggtgacctgtcttttcttggcaactaatattatgaacatcaatttctcatcactttgtggcttcaagaaattctcccatcatagagatgaatcacctttcttccaggtcttcaaaaaaaaatatatatatataaaggtctgtgggagataagcttagaaacagtggctgaaaaggagaaaaattcagatttcagtcctcgggggtttgcataacaaatgatgaagtatagttttatagctcatctaagtaccttggtgcttcttttgggtacaagtccctgtttattagacaggcatggtgacttctagatacattcttccaagacatcaagataattttacttcttagttttttcacatgttaggcaattccaagattaatcgtgtataaacttgtttgacacttgaatcaatttttggttttacataaacggcattatttcatgcatacctcagctgaaaattggcagttatgtattagtgcttgattttctagaccagtattaaaattaccttccaaaaatgtttcagttgcagaaagtattggtggccaacaggtcttccatgagtcgggacacattagccagtgtcaccctttctctagccagtcagttctatgagaatggtattggaagaacagacaacctacctgcagcacttgccctgtcctgttcatattgtggacaatcatcaaaagataaaagggcatatgaaagatttatggtaaatgtcttccattttctctgccttgagtacactggagttagctttcattttcatagttgcttactatgaatgtcttagatgtagcatgagaaaatcttatattttctttttgtctagaactctgctgttcaatatagtagtcactagctattacataattaaaatatggctagtatgaataagcagataattttaattcttatttcagtataatttccatttaaatttaaaaactcaagcagtgtaaaatagttttcatcaaacacaatttttgttctaataaaactatatttcacctaaagcactgaaaatttagcattgagtttcagtgtgctgttaagtataaaaatatactagattgtaaaaacttcatatcacgatataaattatctccaacaatttttatatacattagatgttgaaataatattttgattatattgggctacacaaaatacattattacaattaatttaacatttctttgtacagtttttaaatgtgaatccttggaaattcgtaattgcatatgtggttcacattatgtttctcttggacagtgctgagctagtacattctgaaatatgtagcaattatttctctatggcttcataaagaaaatgtcaatccaaggctgaggatttatttatgaaaatctaaagacagccggttttcctgatggttcatgccgtgggggaacgggtctctttcccaatatataagaggacaaatcttgggatgggttttttttttttttggtcttttatgacattctttaatgatttctcctgtgcttgccattctgccttgtacgtaatacaccctttctagcaatgggtttaaaggtttttccttcctctcctttttgagctgtaaaatatgcattatggggagaggtgagctgatagttgagaaaggtcattaagggttcagcctggcttagtcggaaagatgtgaattcaaattgttattctcccagatatatactaacatgaccttggggaaattgcttaacttttctaaattttagtttgcttcatctgaaaaaggtacctaatagggaagttttagatattaaaatcaatgaaatttaaaagaatcaagaaatatgataatgcctagtatataacaggccctcaaatgtgttctgaaccaagagatccctgtaagagttaaagaaacaggaaagaaacacgaaaagcggctcaacagtcaaagacaggttaattttgcagaataaacctgagaggggcttctggccaatttttggacaggagcactctctcttacagactaagagtatttattggttttagggcgagagagctttatcacaggcttggaatgtttctgtgtgggggagaaatttatggtggggttggaatgtctctgtttggaagggaagttatcctggggctgacctgtctctggtcggggaggggtttatcttatggttggaatgtttctggactgggatgttatttgtggtttatggtcatgctgacgttagccattaagctgatgccctttggatttaggcagtttttgatcaaggggaactttagaatggtggtgcttgtccaagatagccatgctcccgctgtgtcaatccccaagttttaaatgtgtatctttacttagtgacttatggagtcgtaactattaggacacatacagcagtaagtctaaggcatataccagcttatcagatggatcccctacctggcaaagggaagatcctctttctctactaccttagtccttctttttatactctgtgcagcttttcagttcttccacttgcattaaaattagattacctcttagattagatcaaaagattgtccctggttgtgagaagaaagaatactttaatctagcactaatcccttaatacaccattatatttgggtacattttttttcctagcagaaaaattatttttcagccttctcagaagtactaaaagtcctttgccaacatcagcccagtgcaagttaacctgttatgagatttgttttgtgctttggaaatgcttgtcagacaagctttcaacattgagatgtgtgatttaaattagtttgcataagaaaatgtaatgccagggacaaatttctctctttatcccttcttatactacaaaacagacaaagagggttaggtggttgctttttagtatgcgagtaatcacttgggattcacagaaatattagatgcagtgttattagtgaaaccttagttccctttatagatatgtcttatgtcccatttgtaatattattattgttgttaccatacgcaaactttatttcttagtttggatgcttggtctcaaccagacccattacctccttatcttcctatctcttagggtcacttcatgcttagaggcaacttgttgaaagtggaggtcagcgtgatcctttttcttagaagacatagccctttcatggaacttacgtagctgattcatagcctgagtcagtctcttggatctgtgaaaaaaaggaaaaatgaaccagacatggtgtttgcagtcagtcttctttgaatataaaatatataggcagaggaaaaaattaaaccaggcagattaacctcaaggcataaagacaaatgctaaaatgtactctaacgtgaagggttaagcattccaagatgcccgttggaaggttctttatccaacacttctctacccattccaaccccagtgtaaacattaaataattcttttaaaatttgaatactcaaacaagaaagtaaagcatggaagataatttttaaatcattatgtagtgattagaggaagaggaataaagggtaatgtgagattttagaaataggtgctttgaatagataaagagatattgcaaggatagatgaactcactatcgtctttgcagtatagtatcgttggtgcagaggatttgggatagaaatccagtctgggggccgagatgtgatcattatgtgcaatatcatcttcaaaaagtcaggtcatggttatcagtttgctacaaagaacatcttagtctcatttcctgtccaaggcaggaattttcccctgaacattcctgacagaagataacctgttttgtgctctaatcacccagtcttctaccagaggttgaagtgacattttggctccattttctcgtattttatgcaagaagctgggaattccagcatcttactctgctcatcagggatcctgagggagctggtaatatgcagaaaggatgtcaaagggccatgttactaatagctgtggaagctccgctatccacaaagcagagattatgaaacagtctatactttggct

SEQ ID NO: 283 - DNA, 1025 bp, Homo sapiens
tcttccacagattttcagagagatgatttattagtccaaatttgagcattgaaactagcctatattctaagtttaagaaaactgtaattttcatgtttctttcagttcaatacaatttatatattgaatacaaaagagattttcacttattgatatggctttctaggtgtttaaattctaactcaatattttaaggattcagtaatagtagggtttccatttctacatggtaggcattctctagtttacttttcctcttctttctgtagaaattaactatttttgcttcacagtcatttcatgatagacccgatttcttacactgaaattcattttaatgtttggattgagcaatggtttgctttggtcttaacttttatttattgaggtataacttacatacaatgaaaatctcaaatcttacatctactgttcaatgagttttgacaaatgcataccattgtggactccatccacatccctataacaaagcagggaactttttcaccttttcagtaccctgtaaaagttacctcatgcccaattctccccttcctctaagcaaccactgatctgatttctatcaccatagtttactttttcatgttctagaattttataaaaatgaaatgatatattgtatccttttcttgtctggcttctttcactcagcatactgtttctgagactcagcggattgctttttaataatataattacaactgagtctcaaagatttgaaaaagtcagaatttcttataaaattggacattgtggtttgctacctgctgaatgatgaagacgaataatgtacttcagtgccctgagatagtttttgtctactgtaataaaatatttccagtcttctctgtttttgcattcttcaattattaccttgaagttttaatgttttttaaaataatgaattggcctaattgtagcctcagcacaactactaagttacacattcaataaaaagactttttctttgtaatgttatatgttaatggtcagcctcctagata

SEQ ID NO: 284 - DNA, 8433 bp, Homo sapiens
aactatatttttcatgcagtcatttcagtcagtatcaccatctaggtttcctctagggaccacatatcaatgactcttaaaatcactgttgtgcaaggtgagtgggaaaggaacaggatggtagagtttggattggggaacagactttgagcactgaacagcaggcagcattgctgttggcagagtaacggagaaggcgctgaggcttacccatgccatcatggcaaaaaatagcacggaaacagctggtgagctgtcagaatgatcttaaggaggaaatgtgaaatgtttctgcttggtgcattaatcgagagttatttggacagaactgaattgccaggggaggaacaagcaaggtggtaactcacccttccctgccctttcatctctctgtaatacggttctatgtcatgggcctccttcacatacacactcccccagttgtccattactcccaccctctccgtcttacccacacctagagatatgtgtgcacacatccaaagagataacagaaaaaaaatccatttgaaatgcttacagatatttcaagacaaaatttaaagagatattggacagattagcaattatgacttttttaaacttttattttaggttcatgtgaagttttgatatataggtaaactcatgtcaccgggctttgctctacagatattttatcacctgtgtatgtaagccttgtacccaatagttatttttttctgctcctctccttcctcctaccctctaccctcaagtagacctcagtgtctgttgttcctttctttgtgttgatgagttctctagaaatctttgtgattagttgtagttgagtactaatgtggctttgttttttttttcatggagttgtttaaatatgtgtcctgattaatttttgttaactgttatactaagacttttcaccatcaatgaattcagtgaagggttgaagggaagaagtgcaggaaaggagaacacacaaatgagaatgtcagtcttgactgctgggtgaactttttttcgctgtagaagatgaaacaaattgagggccaacctcttgaatcaaattgcaaagtaactttctgctgggaacagtttgagtaacccgaagtagctaaggtcataaatatttttacaggtggctaaggaaagagcatttgcagccatggaatcaggtgttgttattttgggtgtgaccttgaatagaggctgctaacttttggcttctgtttccgataataaatctccctcctccccacccccaccatcagccccaaggaaagatgaatgactcaggtgcttcagagacttcccaagaagtggtttcagtatatgcagcaagtggacatttagaatggcacagttatccatataggaatattgttgaggcagttcatcttgttgtccctatagtgtaattctttggagtagaaagcaaagagcaataatttgtccaataaatgaaataaggaaatgaagagaaaatttacataagccagggaggccaacttaattttctaaagtagtgaattgactttttttccttggattttgaaataaatggcaataaatccagttgtggggtagagttctttgctttcagtgatagcttaggaacattctgcagattgttaggattgcttgtatgtggttttaaatgaatgaagctgtttctatacagctattttcagaaattctatgatctaaatgttttagattcaggcaaataaatacatatctatattgggagataaggtttttgctcaaacaagcaatgagtagttttcccattcctaatgtccacactatcttgaccactaccaagaaacactttttgcaccatgatgtgcaaaccatgtatttcttatcatcttgatgctgttgctcattttgcttaagttttaaagatttggcctttctctttttatgttgattaccaagagtgtctttgcaaagtcctttatgcagtactcaaagtatgtccatgccatttagctcctataaagaaaacaagtttttagccttcctaggaaattaagtttcctacaaaatatatgctcttcaaaagctctctcggcttcatttcaagcatggaaagcttgctggtgacttttgttctacttgatacggcatatccattcttgagtgaggctgagtacaaacagcattatcctgatgtaaaggaaacaaaaataattctaaccactaattaactaacagcaaagagactgatagtcttaaatggaaagaatacttccatggtctagtttctagagaacactaccaggggcttgaaggtaagtagcctctactggaggctaagggaagctaaacacttaagttttcttctatattatcagttgctgtttagaataaattataatctccacgtttttttttgagacagagtctcgctctgtctcccaggctggagtgcagtggtacaatctcggctcactgtaacctccgcctcctgggttcaagcgattctcctgcctcagcctcctgagtaactgggattacaggcgcacagcacctcgcctggctaattcttctgtatttttagtagagattgagtttcaccatgttggtcaggctaatctggaaatcctgacctcgtgatttgcccacctcagcctcccaaagtgctgggattacaggcatgagccaccgcgctcggcctcttctttactatagagtaaaagttgcatggtcgttttcttgcatttgggtcacagcttcagaaggttattaccaatcagaaaaaggttttgagtcttttatttcctaaaactgagtgtattcgttattgtctaatgacacagcataacaaaccactgaaattcagtggcttatcataccaaatatttacgcccatgtttacaggcctgcaggttgactgaaatttggcttgtctccgctgggctcagcatgttggctctcctttggactgcaggtcagctaggattggctccaggctgggattaggttcagatatgctccatgcatgtttttttctggggctcaaactgaagggacagtgtctatccagggcttagtctttcatggtacatttctgcagcacacaaaggctccctccaaatgcagcaattccttcctcagcggtagtagtccagacagaaacagttttggtggttgcttgagttctcccagttgttctcctgtcattttgcaggtcaatctgcttcattataggaacattctactggagaaaaaagtctatcattattcaaaatatccctccttatgcatacttcccactgcttagatgtctatactcagaaaagttactatgtggtttttctttatgggacaatactgcgtgatcgtggcgttcacatttctccctccaagtccttgcttttctagtttctgtaatcattcctcaggtgacataaaagtattttccgaagttttgccattttcatcacacaatattgtggacaaattaaagcctattgatgactttattaaagcagggtatttaccacaaattaggattctctgcattttgcctgactcctgcagagcacagagaccattcttgtctccaatagcaacactcttctattaatcaatcaagagctgacatgaatgtttttatagagattctgttccacttagcgatcctattgaacccctggccatgtggtatccccacagctcttcttctgaaatcccattttgaccaagccatccaaattatacacttagactgtaattgtttcttttccataaatgaatttacattcatcttaattcacattcgttgagattttttctctgtttccaagtctcttcacagcatttgtattctgtcattcaatacatttcctccaatacatcatatcacattcatatgcaatatgaatgaacttgtaacaatatctctctttttttttaattcaagccactgatacaaatattgaccaggtaggttgtaaaggacatggttctgtggccagccctgcaagatctccttatctgtttgtttagtacaccatgtatataatgtgtaagcctgcctcagttttcttcatggtggcctcagagatatcactgaagacctatctgatgctttgctgtgatttttattccctgttcacgccattctcctgatttcctgtatagtaactatattctcaagaagatgagattagtttgatgtgactattctttgtgaagctgtactagctaattgcatttcctcttagtttctaaaacccagaggtcccaaagtcaaatgctttgcagccaggcaagtaacaaatgtctgggtcagaagctgggtattattcgtcatttcatgaacagaaatatatatcctctgagtagaagactctgccagcagaacaaaattcttctgttagctaatttcactagccatcatatgatttagcttctgaagcagcttgctgctctgttattcgtgtgaactcatatcctttctcatttggaaagtcaagaccacatgggtacacctcttatcacaagcttcgtagagaccacaaagatgccactttagtcccaactcactaaatctcctctacaatgtctctaaaaattatccaatagtgttttttaaaatatatatcaaattatgctatctcaccacatcacagtatagctgctactattcctcctgtcttcctgtctcagaggaaaaatttgcttatcaccttccacagttgagtctacctaggtccttggcctcctgcccttttatcttttctgagatctcatgccatctgttacctcatctctattttatctgttataattcctctcctctgcttcttccccagctgctcagaacatactgaaatatatgtaagattttgggttttttttctggtcattttgctcaatgacttcctaataccaactgaagagagtttatatttcttaatacaacattgaaagcctaacatgatttggcctcaacctacctttttttatccagtaaaattcatttctctctaatgtatactatattccatccaaactaacccactgattagacttcatttttcttttaattactgctttttgctgtgctggtcccactgcttagaatgttatttcctcaaccttatttctgtttcctacatttgttgaaatcctagatgtccttcagaacccagcctctgagtcacctcttgcaggaagccttccttgctttccctagcagaacaacaatttctactgaaaccctgttgaattttgtctccattattgcctttaccaccttctatgttttgacagctattttgactatgtcttatctacccaattgtaaacttaatgaatacccacactgtatcctatttatctttatatctttagattgcaacacaattctttgcacatagtgtgtgccaaaaaatctctattgattgatggtgcaattctgatatttattaataatgatcaatctaagtatttatccaaatcaacccaatgccctatattttgggacaattacccttgagatttttataaaccaaattcaccccatgtaaaacagatgaaattaaccttaatttttatctgatgtgtaatggctaattggctaaatttctttcataaatattacatatgtactattttttatctctataagtattctagtttgtctagatgaagaaacagaggctaaaaatagttaaacaaaaaattacctgtttcagagcttgaaagccagatctgtccatggaaatctcctgagagaagaaggtttggggatgcatataatgagagcagagaactggataaagagatgtctggatctatttttggctgttgtttagatttactttgtgactgaaggaagtttatctgaggctttcccatttgtaaaactgagattcatatacaactgtgcaaaatatgtgtccctttacttacctccctctaagagattaatgagatgatactcaagaagcactttgattttctctgatgaaagaaatggataagtatgaaatgaagcatttactacttctatcgaaggtttttaagatggcagcctttaaaaattatcaaagtgaaagctaaaggaagaaacagccgtgtacattttaaatcaagtcaataattattgtagtgcacctaatgattctctgatatgtgttttgtgcattaaaatttaccaagcacttttacatatattatctcatttgatccacaaaactatcctgtgaagtatgtaggctaggtggtttcattaccatttttgaaataagaaaactaatactcaggccaaatgacttggtcactgctgctcgactcatgtgaaacagtccagggttaaactcaagtttcctggattccaaatcccaattcaggtatcttgcatttctgtccacttgttaacatcatagcatgcacattggaccatctcctctgtgttcacttacattctatccatgttcaggattgagtttaaatcccatttctgctcttaagacttcccttatcactttaactgaaaggcagactttcttattccatattttttttgtccttaaatatattgtttcctggaggtctttctagtgagttggatttcctgtattccattcttccttaaaataagcctttggaattcagcccagcttccacacttcttgatagctgccaccatccatttcattcctgggactgagcctcagcacaaggattatttaaaagttaaaaatagttgtattcataatcccagcattttgggaggccgaggtaggtagatcacctgaggtcaggagttcgagaccagcctggccaacatggtgaaaccccatctctactaaaaatacaaaaatcagccgggtgtggtggcagacacctgtaatcccagctactcgggaggctaaggcaggagaatcactagaattcaggaggcaggggttgcagtgagttgagatgcgccactgcactccagcttgggtgacagaatgagactctgtctcaaaaaaaaaaaaaaaagtttttttcgtgtcggtattaatgcctggtataatacctcgcacacagaaggtgttccatatatgcctgctaaagaagtggctagactaatcaacaattatggatgggagggaaggttcagaaagtttggtgacaatactgggaaaaaatgttggcacctgataatggtggacctgggataccaggctgaagagtttgaaacttgcccttttggcaacaacagatttattggcaccaaggaatagttttgctggattccacttttgaactcatcaaattccttgcttttcttttccttgtcttttcaatcctactgggacctcctcccaccagtgccactttactggaggcttgtgatatgtatgacaggcagtaaaacccaagtgaatcaaggaagcctgttaagagcactgatttctatgatgtctcagtttgttaactaaattgcaggttgtactgcttggccagagacagctgacaggcaactctgcctgaacaagtagcatctccaaaatgacatgtgcactttagtttcattagaggcagtggtatcatgattgcctgggccattgcaataaatatggtgatcatatgtatcccttgggatttggggttgacagcatagttgggctgcactaaagagtcttactctgacataaatgacggcaaagtagatctctgggcccctcagcaaggaggcagaagttcatgttgcaaagaaagttccacgggcctactgaaatattaccaatcaaaattacaatttcatttattgacaagtcatatttaacattcttctaatgttttttctcacatgccaatgtccaaaaagctaaaccatcagctgcatgatgctaaggctttcagcagtcagcagaagcagtggtagttgcgagctggttattcagaggcagctactgtgctccacataaccataaagtgaacattttgacattcccgaaaatgtaccaacctccaagtcacaaatcctctgtagatgcctgtggattggcttttcagatcctcttaaaagccaatctgtggtggcaggattgtctgaagagggtagacttgggcttctggtacgttacagaaggcatggtttctccatctacactatgctataagacaactgctcttctctgaaaagaaactactggaatcacacttcttgtaacttctctctattcccttatttagttggtgggattggatgaaggatcttcacatgtctagtgagactcctttcttctcttcttcctatccaaagggcttttcttcctgggctgagtgtatccaggcctatttcatctttgtaggaggcaaagggaaagagaagagaactagaaattggtgtaggcagactgatctgtggccaggtctaagtgttgccccaatccgttctcccatccaactccacaagcagta

SEQ ID NO: 285 - DNA, 5079 bp, Homo sapiens
ttcagaagtgttttgatatagacatcgtctcaaaccaaatttaacgtcccttctagttggagaatttttagtggttcgatttagaaatattttcttaaaaatccacagatggggtcatactatgcacaagttacttctgaaaattggttagtttatagtccaaaagtaattaatatttgcatttaattcagtttggaattcagtaaattttagtaacattcctttgtgaagtcaagtcactggttataacaatgttttaaccatcagttgtttataatgcattgtttcatctatatataagtcatgggcattgaggaaggaaaatgtaccttcagtgaactttgaaatttagttcctcaaaggagggctattactagaagtgaacagaagtaaaacaaaataataactaagtatacagctcataaatgttcagatctagataattatgtttaatttctgcttttgcttaccatttaagatcaaacctctaggtatcttttaatctagctctttagattgttaaaatgttttatgtgaaatgcacatttagtttataagcagcaatttagtgtcctgtttccatgagacattgatattaaataaaacactagaaagaagtaatctaacttttttctcctttgtacaagcccctctttgcacctcatgtgatgttgcttactggatatcaaaaaagattagaagcagggtgatttcagatcaaagaagaagcatctgcctacccccagggtttttaaatatttaaatatttttctcgttaaaaaagtaactcaacagaactctaaataaaatacaattttaaggaaccaatgtatagtcattttaagctattgccagcaaaccaccagaagcgaggtgaaaggcaagctattatataatcacactttttccattgtattgaaagttaaattcagcttatttgccaaagaatgcttcaaatacactgaaattttacataatagtacaggctaaggcgggtggaacacaaggtcaggagatcgagaccatcctggctaacacggtgaaaccccatctctactaaaaatacaaaagaatgagccgggcatggtggcgggcgcttgtagtcccagctactcaggaggctgaggcaggagaatggggtgaacccgggaggcggagcttgcagtgagccgagatcgcaccactgcactgcagcctaggtgacagagtgggactccatctcaaaaaaaaaaaaaaaaaagtacagttatgaacctgtattattatatcacagttagactcaaatgactcttaatgacatttatttggactcatgtatattttaggctttttttttagcataattcattgactctaagatgtaatacttttcacattttatcagctttaaagtcaggatatgtattataatcaatggtttcttacaaatataattggcaaccatgttttgtttttcttagtggtatgtaaaacaatggtgtatcttaaaatcaatcatggcatcttagggtttgttttttttttttgccttttaagtaatgtttatttttcatttgcttgttttttctgttttttgatatttttaattttatgtctgtaggctattggggaacaggtggtgtttggttacatgagtaagttctttagtggtgatttgtgaaattttggtgcacccatcacctgagcagtatacactgcaccccatttgtagtcttttatccctcacccccttcccacccaccctgagtccccaaagtcaattgtgtcattcttatgcctttgcatcttcataagttagttcccacttatgagtgagaacatacaactatggaaaacagtgtggagattccttaaagaactaaaagtagatctactatttgatccagcaacccactactgggcatctacccagaggaaaagaagtcgttatacaaaaaagatacttgcacacagatgtttataacaacacaattcacaattccagaaatatggagccagcccaaatgcccatcaatcaacgagtggaaaagaaactgtaatatatatatatatgaatatatatgaatatatatagatgatggaatactactcagccatgaaaaggagtgagttaatggcattcgcagtgacctggttgagtttggagactattattctaagtgaagtaactcaggaatgaaatgaaacatcatatgttatttggtttttataacaggagatatagcttgtttatttcaagccacactcagtgttggaaaatgctgtttcttattctgtaggtccagcattcccaagctaaaagaaagttgtgtggcgctaaagtgtttggcaaggttgtattattgataggtgaattgctcataggaagagaaaaatttaagtgactatattaagaatgttctggtatttatagttctctgtcttttccattcttgagaatgtaatgttctttgtgttactctttaaagcaatggagaataaataaattgtttagtaagtcatgttgacattattccttaaaaaattgaaagagactgtatgtcccttcctcatagaatacacaaaactaaattacagctgaattaaagatttacatctaaaagcacttaaaagtaccagaagaaaatattttttaaagtgtgtattcgtatcactagagtgtggaagtcattccataatatgacactaatatcaaaatttataaagaaatgattgaaaggattgattacctcaaaatatataacaatagtctatcagaaaagatgaagcatagatttaaaaaaactggagaagaataattatgcagagataaacgtgtcagaaacaatagaatactttttttaatattttacatcaaaatgtatattctccagtccttaaacaggcattcaatgagcatctcttatgtctgaggtcataggctgggtacaagagaggtataaattaggctcaaatggggcccacaaagagccccaaatctagggttttattttcattgttagagtgtctatgtctatgtcagtaattgggattatttttaaactgaaaaactctatcccactttaaaactcctaaatagaacaagcatttatctaaccttaatatcatagcataactccttaaagtttattgactttaaaataactaaattcagtagctctcaaatatccatagtatgagtgacagacctgtaaaatctaattgactttatttggcagacacaggcaaacacatacatgtattttaacataatatgatgactacttagacataacctgatccttcaaatataactgaaaaaaaggtgctccattttgcatgatttattattgaactagagttccctttcctaggtacatggagcaaatagagaagataattagaattccacttttcttgaaatgtcaagaagggcaggtgtactctgacctcagctttaagtttaaccaaatatatagggggatttgagactgctccacatgtttctcatggaatttcccccaagcactactctctgaagagcctgaaaaagtatgtaagaaaagccttgttctctcttgacatgaagttatgctcagcctgcttattatgctagagcttagtgtctgaatagcagagaacgttttctcatccttagttatgtttgttgttctaacataacagtcttctgatcacgatgattctctataatcaacatttcttaagtgcccagtgaggtaagccttgcttctaaagaattttaaaatgtatttttagcaaggctctaaagattaagtcttcaccttgctgtcagcagttacatttttttctaaggggtaaaaagcacaaaccagaattatgctagatctccattaagatataaaacattttatggtgccgggttgctgttgacctacattgataattggaaatattacaacttattgcaaaggtactaagtattatctattataatatgtgttttgcatccctttctgtgatgtagataatattagtcctattttgcagatgaggaaaccaagactctgaaagctaaaaagcttgctaaagtcacgtggctaatgagtaataacaagattcaaaatcaaaacaacctgaccctgaaaccctcctgttaaccagtgaccttttctcctctcaaaattctgcagtaaatggaaaccatttcacatgtgtttattcattcacacctacagtgtgccagctcccagtgtagtctaggtatactatccatggtgaagaggacagcctaggtcgttgccctcatgggcttgcattccattgagacagatacatttctcagtgcttaatttagttaagtgagatgggggcgggaaagaagagaaaatagagagacagagaatcatggggttttgactttacgcgggagtcagggaaggcctccgtgaggatttgttagctgaaaggaaaccttggttgaagtgagggaggaggaaaccttgcagatatcttgggagaagagcacctgtacagaaagaacagcaagtgcacagccccctgtgctgggaataggcttgtgtctgagaaccacaaaaaaagccagtgtggctggaaagggcaggtaagggagagcataaggggaaatgggcacagagctagccacagccaactcagggaggcgttgtaggccctggtaaggatttaggactttcttttgacttctgtgataagaaaccagtgaagggttgggcttggggaagttgcccctggctgtgtggccgcagtggaaataagggaagcaggtaggatcctgccgtgacccgagagagatgtatggctgcgacagagccacaacagttgggaactggtgggtgatgacatttggggtctgttttgagaattcaggggatttatcatctcgttggtggcaggaacaaaactcatagcagcatagtgcaagaatacagacagcatcctgttaaggaccgcagtgttttctgcaacttcttccatgtgtctactgcaaattgtctgagaagggcagggcctaggaaacatggtggaagttttgagataaaaatattgcagcccatctgcatttccctgggagctcaatta

SEQ ID NO: 286 - DNA, 1121 bp, Homo sapiens
actttgttatctttctggataacacgtttgatgggtgttaaaaggtaaagccaggaatggctttactttctaacagaatactttacaaagcagtttccagcttagatacttcctcctacagggaaccttcccaaggtgtttccttggcagtgctcccttccttatcccgccactgtcccacatgtcccacctaggccttgaagggcagaacctgtgctctgttcactgttgtattccagtgcctgacacaactatttgcacagtatttaggtgctgaacaaatatttattgaatgccaaaattggttcatttactaagcagaaagaaaggaaaatattttttgttggcagtgtctgcaaagagatttgtcttttcccatgaaaattgagaagtggggacagaaaagcaagaaagtgggagcaaaagtaattgagatccacagtggctcaggagtgttgaccggtgcagggtgtggtagaagcccgttaatgggtaggggagccagatacggaggctcagctgggctgggggcaggtctgcaagaaatgggggggtgtggagaaggttaccagccgttaccagagttttcctctgcattgggaatttctaaggtgtgtttttgtttttaaaacaatatctgtactttcaaaaatatggtttctttgctgcaaggggaacacatttattttgtgaaagtaagtgtacctagttaacagtttccatttattaatttctggaatagtgttttggttacttggaatgtgtgtgtgtattttctttctttctttctttttgagacagagtctcgctctgtcacccaggctggagtgcagtggcgccatctcggcttactgtagcctctgcctcccaggttcaagcgattctcccgcctcagcctcccaaagtactgggattacaggtgtgagccactgcgcccggcctattttctttctattacaagtcccttgcgggaaagatggtcgtagctcctattctaaatgaacagaagttctgtcttagaaattttcccattttacaagtgttcaaagaggaccaaatttcatcctctttccctgcctgtgtcctggaatcagctgagaagaaagacaggagtaaggtgg

SEQ ID NO: 287 - DNA, 2632 bp, Homo sapiens
actttgttatctttctggataacacgtttgatgggtgttaaaaggtaaagccaggaatggctttactttctaacagaatactttacaaagcagtttccagcttagatacttcctcctacagggaaccttcccaaggtgtttccttggcagtgctcccttccttatcccgccactgtcccacatgtcccacctaggccttgaagggcagaacctgtgctctgttcactgttgtattccagtgcctgacacaactatttgcacagtatttaggtgctgaacaaatatttattgaatgccaaaattggttcatttactaagcagaaagaaaggaaaatattttttgttggcagtgtctgcaaagagatttgtcttttcccatgaaaattgagaagtggggacagaaaagcaagaaagtgggagcaaaagtaattgagatccacagtggctcaggagtgttgaccggtgcagggtgtggtagaagcccgttaatgggtaggggagccagatacggaggctcagctgggctgggggcaggtctgcaagaaatgggggggtgtggagaaggttaccagccgttaccagagttttcctctgcattgggaatttctaaggtgtgtttttgtttttaaaacaatatctgtactttcaaaaatatggtttctttgctgcaaggggaacacatttattttgtgaaagtaagtgtacctagttaacagtttccatttattaatttctggaatagtgttttggttacttggaatgtgtgtgtgtattttctttctttctttctttttgagacagagtctcgctctgtcacccaggctggagtgcagtggcgccatctcggcttactgtagcctctgcctcccaggttcaagcgattctcccgcctcagcctcccaaagtactgggattacaggtgtgagccactgcgcccggcctattttctttctattacaagtcccttgcgggaaagatggtcgtagctcctattctaaatgaacagaagttctgtcttagaaattttcccattttacaagtgttcaaagaggaccaaatttcatcctctttccctgcctgtgtcctggaatcagctgagaagaaagacaggagtaaggtggtcttcaattcagccagtcttcaattgttggagaccaaaatttacctttatgctgatcagggttagagctgctatgcagaacatggcttatctctgcgggcaagtggccttcctgaggctcatctccagagctgtgcagcagaatgttgccctcaaaagaggacagagggcaggactggctatgcatgcatgctcactcccttcttccagattcactgagcctgttttccttctgaattaagaggtaagaaagtaacacctggaaagatgtactttcccaaggtcacgcagatagctggcaacaggtttttctcctgggctctagaggcctttggtctgagtagaaagggcatggttatggggttggccaggccttgtgttcaccacattctgcttctgtgctcttagctttcatttctgcatctataccatggggttaaaatttctaccctcgggattcctgggagggttacctaaggtgtaactgttgaatgacctgaaccagtgctttgcactcagaatcagcaatgtaaatatcactcagccagcctggggcactttcctctatcaaaccttaccaatccttttcttcttcttcttctttttttttttttctcttcaattgaaacagggtctcactgtcttgcccaggctgaggtggaatgtggcacaatctccgttcactgtagcttccacttcacaggctcaatcaattctccagccttagcctccaagtagctataggcacgtgccatcacacctggctagtttttgtattttttgtagagatgggttttcaccatgttgcctaggctggtctcaaactcctgagctcaaagcgatctgcctgacttaggcttcgaaaatgctgggattacaggtgtgagccaccatgtccagcctcgttgttctttcttttaatcaccctggcttggcacctcagaaaacatggtgattggagtttagctttcagcagggtgggacttggatgttgactgttttaattttgatttttttttttttttttttgaaacggagtctcactctgtcgcccaggctggagtgcagtggcgcgatctcggctcactgcaagctctgccttccgggttcacgccattctcctgcctcagcgttgtgagtagctgggactacaggcgcctgccaccgcacccagctaattttttgtatttttagtagagatggggtttcaccgtggtctcgatctcctgacctcgtgatctgcccgcctcggcctcccaaagtgctgggattacaggtgtgagctaccgcacccagcccaattttgattttttaggaggaaaaaaaattgttcctaaggaagtcaagtcctaaattgaaagactttcatatattacacaaaccctagaaaaacttgggttacacctgggattgattttgaagtagggcgttgaactatgtgtcctgtttaacctcgaggagcaaatggctttccattctaaacattctcatttcttctctgggacattcttt

SEQ ID NO: 288 - DNA, 20331 bp, Homo sapiens
tgtgccttcatctaaaattgtgatactatagttgatgttaaaattttaagagatacaggagaaattttgagctgagtgtcccagacagctggctagctattccagatgtgggacagaccactgtgtttctaggtggtttttagtttgcttggggtcaaagtcttaggattacatattatgtgtacaccatgcagaattctaagctctctacataaattatttaatgctctcagacagtttgcagataaaaaacctgaagccagagagcttaagtgttttgtataaacacactaagttacagatcaagggtttaaactcaggtctctttccaaaactatagctctttatcattattcagaactgaatttctttgattattataacatttatattccttctcaacttactgtattacagtatcattattcattaaacttcctttaaaaaatcagtgtgccctaattaatgaatttacaatatgaataatagcatttaaaaaaactacagcagctgggcgtggtggctcattcctgtaatcccagcactttgggagactgaggcaggtggatcacttttgagatcaggagttcaagaccatcctggccaacatagtgcaaccctgtctctactaaatatccagaaattagccaggtgtggtggcgggtgcctgtaatcccagctacttgggagtctgaggcaggagaatcacttgaactcaggaggtggaggctgtagtgagccaagatcgccccactgcactcaaacctgggcgatagagtgagactcagtctcaaaaacaaaaaacaaaccaacaaacaaaaacaaaaaacaaaccaaaaaagacatcagtcaaaaccccctacagtgacaaatagggttaattgaatggctgagttagggtcttattttatccttactagacaccatcattgtgtgttttataaatacctcgatgctttcaaaccattttaaaagacaaaaatattttaattatgattgtatttattgattaaaaaattaaaaatgggaaacatataacattattacgctattctaaatgctctttaatggtctcatagttttctactatgtactgtggtttatttaattcgttctctttaggttgttttcctctttttttctgcctgtgatgaatattcttagaggtcagtcatcttatgttttctttagtatattttttcagagttggagattatgggtcaaacagtatatatgcacattttaaactctccagaaatattacagtgttttaaactcctactagtagtacagattgagtttcctttatctgagatgcttgggaccagaggtgtttcagattttgaagtttttcagacttggggatatttgtattatatatatttactggttgagaattccaaatccaaaaatttgaaatttgaaatgctacaatgagcatttcctttgagtgtcatgtcagttctcaaaaagtttccgattttggagcattttggattttgcattttcagatttgggatgctcaacctgtatgtgagaaggtttacttcctcgtatccttactgacaacatctgccatttgctgatgaaaatttggatttcactgtcattttaatgtgcaattttaattgttaataggatatatttttaaaattttttattgactgtgtttcttcttttatgaaatgcctgttttaagtccttttcctaaatttttttattagaggtttatatgttcttactgaattttcagaagctctttttataagaatatgtaaacttttgtcttgaatatacaggggtattttccttcaagacaaaaattttctgtttcttacatgttcattatagaaaaatcaaacaataagctaaaaaaaggtataattcacctataaccctgctacctactgagaattatttttacattttgatttatactcctgctgtcttctttctgcacatatatacactgttaagggccccattagcctgtgttttcacataaggtcataatgacattaacatataaattataaagacttggtagcttttacctgttaattagcgggatgtccttttctacctttcccatcccggaagtatttctgagagcatggtctcaaataagtttgagaatgaatgtgtgtctgctggaagctcctattcttccgccattttccagtcctccagaagtttcctgatggtccatgtctgaattagacacccctcttctttgttccagttgcacctgtaattcttcagcatagtacttcttaaactgtttttaattgcctctcctccatgctaaactttcagctcttgtagagcacagaccctatctgctgtgttcatggtttttctttatgtctgatatctgtgtgtacatagcaggcattcagtaaatatgtgttgaattgacttttgttgaattttaatactcgattggagagttagacaccttcctatttgcacactttcccatcatacatccaagtatatgtataatgtcaatttcttttatctttttatgattttcctttatggtttgcctttgatgctattaattagtttctttttaataaccagaaagataactttttgtatcctttatttgtagtacaataaagtttgttttccatgttggtattcctgaaaaatctcattttagtattagagtatgctggaatagacaatataaatacctctaaactctcacttatagcagcctaaatctgcacgtgctgtaaggaaaacatttttaaataatttgccattaaacaatttctaatttaattgtcactttttttttttttttttttttgaggcaggatatcactctgtcacccaggctggagtgtagtggtatgattacggcttactgcagtcccgacgtcttgggctcaaggaatccttctacttcagcctcctgtgtagccaggaccacaggtgtatgccagcatgcctggctaattttttaattttattttttgtagagatggcatctcgctttgttgtccagggtagtctcagtctcctgggctcaaggagattcttccacttggcttcccaaagtgctgggattacaagcataaaccacaatgcctggcctcactttttataatggacttaaatcagtttggttgttttaaaagtaccctagcatttagcacatgaatacatctcattttgattagtggccaaagtatttttgggcattgtgagcattgtactactcccaggctgcttatggtatgttatagtatcagatacatctctttggatccatgctctaagtagaattgtgttgtataccttgcttaatccattaaatttttacctgtctgtttgagtatcaccaaaagaaagttgctatcacaatgtactttctactttttaatctactctactgattcattagtacacagccatggtgagacacttgagatgttctgctgaagacaattgttacatattgggattctggaaggacagcaagctagataaagataagtcatgcttttaagagtcccatggaacatcagtcattgtgatgtgaagaaagtgataaggtaatgcatgaagcagtttgagtcactatgatgtggatggtgggaagtagccctcttaatcaaagctttaagaacgaccaagaacctaaggaatagttacttataccaccagattatgcagataatgttaataacaacaaactcatttatatatatagatatatatatatatatatatttcaaaagaatgtagcagtcccataggttttatatatagaatcagcatagtatttgattataattaatgatatcatcttaaggacttcatctaatatacttattttgaaaataagatgcaaccatatatttttgacataaattatagttatttttcttcaattcaatgctttgatattttattctgtatccctatcagttaaatgtatatattatttaaagttaagagtatacaagttaaatatctcttattcgaaatgcttgggaccagaagtgtttcagattttggtgtgttttctctttattttggaatatttgcattatatttaccagttgagcatcccaaatccaaaaatcccaaatctgaaatgctccgatgagcatttcctttgaacatcatgttggtgctcaaaaagttttagattttagaacattttggattttggatttttagatttgagatgctcaacttgtatatacagtgcattctgtacttgcatttgaatactatatttggatttgtgggtgtttttattccaaagagctcaaattcccttagtatttaaagcacggtttcctaacatttttagagatagcattgtatggacacttttataataggacaacctttaagtaattttgaaataaaaggactagtttccttttacctcctagggcttgggttttataatcttaggattagaaagggctttaaggttatctgacccagtgcattacagatcttgtggtctatctacagtgccccattaaatggctcttcagcttcagggccttttatttatcaatttaacaaataccttttgaatgctgccctggggcaggcactgtgttaggtgctggacatattacagtatatcagacatggttcttctttttagtctagttggaaagatataagtaaatacataagttgtaaagcagcacagaagaggccataaaaaagcatgaaaaaagacagagccacttaatgtcacaaagtcatttcattttacacagttcaaagtcttagaaagtccttttttctcttgagccaaatactgcttctttaggtctaaataccgcccttctccagtgatcatctttcagttatttcaagatagttaagttatatttctgattggtattgtttgtatgttaatttcttttatcttgcttaaaattggcctaaattacaatttgttaaatatttttggatcttccttgtacaaaattttttctcttggggttcatatagtgcttctagggccaggtgtggtggctcacacctgtaaccccagcactttgggaggccaaggtgggcggatcacgaggtcaggagtttgagaccagcgtggccagcatggtgaaaccctgtctctaccgaaaatacaaaaattagccgggcatgctgctgtgcgcctgtaatcccagctactcggcaggctgaggtaggagaatcacaactctgggaggcggaggttgcagtgagctgaggtcacaacactgcaatccagcctgggcatcagagtgagactcactatatgtatatatatatagcttctgtggaataaatatgccaccccaaaatacactgctttggcatattttgagatggctattcagaaaagctacagaaagaggaatagctctgaaaagctgtccatttgtgggggagatttgcatccctggtagaaatccacactaggaaagtaaacagcagacagaaatggactttctttgagaatcccttatctgccttatttggatttaggaaaaaactaactcaggaaaagagactgaaggtctgacactgttaaaggtgtgacagagaaactttttcaacaggctaccatctattctttctgagggctgctacctgagagatttcatttgtaatacaaaatagcttttgttcagcttgcatttcctcccctcacccttccacaacctgtaagctatcttcccccactctggagctccaagcccctgactcttttctgtattttctgtatggtataaaaacttcagtcatttgtcccttcttagagtctcatattttgtgtggctcccctgcacatgtgcgtgtttataaatttatatacctttttttttgtttgtttgttttgagacactgtgtcactctgttgcccaggctggagtgcagtggcgcgatctcagctcactgcaacctctgcctcctgagttcaagtgattctcctgcctcaggctcccaagtagctgggattacaggtgtccacctccatgctggctaatttttatatttttagtagagacagggtttcaccatgttggccaggctggtcttgaacgccatacgtcaagtgatctgcctgcctcagcctcccaaagtgctgggattacagtcatgagccaccgtacccggtcttgaataccttttcttctgctaatctgtctattgtcagtttgttttatagacacaaattatcaaaccttcagaagggggaggaattaaaattttctttgctcttgtatgttactttttcccccatttgcgtattcttatatgtatctatctctgtctcccaaccctctgatggaattttaaaatatctctcaagtacaaacacctcaaataatccatcagatatgtggtttcctcagaagcttctcttctggattctttcattattctgctcaagtttgcattggtttcctctcttggcatactacctagctctcctctttatacttccactttttgttattctgggaatctcttcaccagtcttctgtattacttttcaattcctgattctttgtatgtgacttgtttttctcctcctttgcctttctctttggaggcctgtaggattttctttttgtccctggtgttctataatttcacagtgatgttgtggtgtggaaatctttctcattttttgagctgtgtctttgcttatcttttttccatttgggtaacaatctagatgttttgttgggagatcaaacaaatatcagtatctgcatgttttatctcttgggccaattggttttcttagagaagaacctcataatctgctcagggagttagtttaagaccagcatcattgtgggagcccagtggtggaagcaggaatgatgtcctcaccatttggtgtacaggttttcacataatgcctctgttttcagtaccactcttcagtcccacctttagctgtttgtagtatctgtctcattccacatcttcagaggttgaacctttagtcttctgcttgtgtagaaaagggtggctatcttgctggctgtgcagtggcatagagtatatatactttttccatgtcctcctgtttttaggagataatttcaggatatacttaaaatctaaaaccttttcacagttttaagggtaaagtttgaacttcaagctaagcctataaagttctttgtgatctagtccttcctttctctattggttcaacttggttcttccccttctggatgaactaagaccacaccacaacatactatgttggctacagcccgttgaacttggagggatacaaacgcatcacatttcacatgtgatgtacccctctacctggagtgccttcttttccttttcttccacaatttcttattcttaattgttgttttctctcagtagccccgctcactttcatctactgtctgatttaaatatcttttacctgtattcctttaccacctcaaacttatctttgatagtgttaccagaaagggatattgatccaaaccccaagagaggattcctggatttcacgcaagaaagaattcctggtgagtccacagattaaagtgaaagcaagtttattaagaatgtaaaggaggccaggtgtggtggctcatgcctgtaatcccagctctttggtattctgaggtgggtggatcacctgaggtcaggagttcaagaccagcctggccaacatggtgaaactccatttctactaaaaatacaaaattagcttggtgtggtggcccatgcctgtaatcccagctacttggcaggctgaagcaggagaatggcttgaacctgggaggtggaggttgcaatgagccgagatcatgccactgcactcctgtctgggcaacaagagcaaaactccgtctcaaaaaaaaaaaaaaaaaaaaaaaaaaggaatagaagaatgccactctgtaggcagagtaggagcatgggctgcttgactgaggatacttaacggttatttcttgattatagaaactgaacaaggggtaggctattcgtgagttttttgggaaaggggtgtgaatttcccagaactgaatgttcctactctttttagactatataggacaacctacaggcattgccatggcatttgtaaactgtcatggtgggagtgtcttttagcatgctaatgcattataattagtgtgcagtgagcggtgaggacgaccagagttgacttttgtcattatattggttttggtgggttttggttggcctctttactgcatcatgttttattagtgggggttctgtgacctgtatgttgtaccaacctcctatctcatctgtgactaagaatgcctgacctcctgagaatgcagcccagcaggagtcagcctcattttacccaacccctgttcaaggtggagttgctctggtttgaacacctctgacaataatatttatctatattatacagtagtttttgatgttatttctgtgccttttccaataagccttcagatttctgaagtgtacttgaccaagtatacttgttgagtaagtttgaaggtaacaaaaagagacaaaattgtgtcttaacatttcaaataatctgtaaatctgtgcctcaaaatatattacacttgaagcatcagagcaagaggatattacaaactgaaaaccgtccaaacattcctgcttctcctgtttccaccttttctcacagagtgtacctgtagactgttgacagaatactttgttgcagtcgatgaacttgtcaatttgagaatgagtattgtgcctttgtgtttcatatgtgctttaaaacattttggaatttttcagaacatgaacacattgtgttcttatactcaataaattttctaggtcatttaaaaataatgttaaattttaatcaataccagaagtttggctccatctgctacaaaagtacaaactcactgaacacatttaaaaataataacatttaaagcttccttgcccttgaggcattttcttctgaattggaatcaggctacctttgacattggcaacttagttggatatgtattgatcgacttaagaatgttgcttctgtgtctgttatcattatgagagaacatttattaactgtctgactacatactgccctgattctataaacgagaactatgtggatgtatttggtgctttttagggacttattttaagtgtatttatagagcacatctagcagcggacagaaaatattaaactagggtatgaatggacagtgaaatagtttacatcagcatcagagtatttggtttttctagcaaatgcaaataaggaactaaagctaaatacaatagactatacttttaattgaattaattttcatctaaatttaacagtgtcaagttatcatcccaggtgaacttcagaattcaaactagaaaaatagaatacatgtattcattatgggattgaatggcatgagccgaacttgggcctataaaaccagaactttagagttttaacctctctttagcataatccgtttatggccttgggcagattcttcacaaaaacagaaaacagacaatcaaaatgagaatgacaaaggtgtggagagatctagcttttaaagcatttggatctgagaagagcctcctaagtggttgtttcttctagctctttagcaattctgttttaaacccaatttctctgtcttttatattctgccttctgctatatttatatccattttccttacaaagacacaccattgtcctttggaagcaggttttataaagtaatagatgtattggcctagaatttgaaaaattatacaaagtaaaattctttttacatacatataaaagatatttctttgataggtttattgttcactaaatcgttaacttcacattttagtatgagacatcattgaggaatggcttatgttcattgacatttggctcatatgaatatgagagattttaaatttgtgtttgtagtttatttattggagaatgacctggattttgcatcactttagtgcaggacttgttttagttatttgtgtaaagatgtgtaatccaaggatctggccaagtgatttttagatgggaagtagagaagcattttgttttttaagactgttttttgagggcagttttagggtgacagcaaaattgagagagagacagagtttttccatgtgcccccttgaccccacccttgcatagcctcccctattgtcaacaacccccaccagagtggtacatttattacaattgatgacctttcattgacgcatcataatgacttacagttcatagtttatattaagatcattcttggtgttgtacattctgtgggtttggacaaatgtataatgaccatgtatccagcattataatatcatacagagtattttcactaccctaaaaatctctgtgctctgcctgttcattccctgccaacatgtggtaaccactgatcttttttttttctatctccacagttttgccttttccagaatgtcatatagttggaatcagtatggaatcagtatgtagccttttcagattggctttcttcacttagtaatatgcatttaaggtttcttcatgcttttcatggcttgacagctcatttatttttaatgctcaatggtattctgttatctggatgaccccagtttacccattcacctattgaaggatgttttggttgcttccaagttttggcaattatgaatgaagtttctataaacatccatgtgcaggggtttttgtggacatgcattttcagctcctttgagtagacaccaaggaatgtaattgctggttcatttatggtgagagtatgtttagttttgtaagaaactgccaaactgtcttccaaagtggatgtgttattttgcatttccagtagcaatgaatgaaagtttctgttgctttatatctttgccagcatttggaggtgtcagtgttcgggattttggcaattctagtaggtatgtagtgatatcttgtttcaatttgcactttcctgatgacatgcaatgttgagtatctttttatatgcttatttgccatctgtatatcttgtttggtgaggtgtctgttagtctttggcccattttttaatcaggtttttaaaattattaagagttctttgtatgttttggctaatggtccattatcagatgtatcatttataaatattttctctctggcagtggcttgttttctcattctcttgacattgtttttcatggagcataagtttttaattttaacaaagtctatcttatcaattgtttctttcatacgagtgggttctgcctttgatattatctcagaaaagtcatcaccatattcagagttatctaggttttctcctgtgttatcttccaggattttaataattttatattttacatttaggtctatgatccattttgttaatttttgttaagggtgtaaggtctgttctagattcacatttttgcatgtggctgtctagcaccatttttgaaagggctctttgctccattgtattccctttgctcttctgtcaaaagcgagttgagtatatttatgtgggtctccttctgggctctctgttctgttgcattgattggtttgtctattctttagccaataccacactgtcttgattactgtggctttataggaagccttggagtcaggtagtatcagtcctccagctttgttcttcagtattgtgttagctattctgggtcttttgcatttctacataaagtttagaatcagttcgttgataaccactagacaatcatttaaaatttttctttatctttaatgatcctaatattagtctgtcaaagaaaaacattgccaatcatatttcactggcccttggaggaatgaaacaatgtaggaatgacgcttttgaattttgagtaaattttatttgtaaatctgttttagtactatcaaaatatgcttattttctttttctaatattattcataatctactcatatcttggaagataaacttaactctggtagcatttgctctgttttcagctattatcacaatgacaaactatgatttttaaaaaaccatcatactggggcagttccaagatggccgaataggaacagctccagtctacagctcccagcatgagcgacgcggaagacgaatgatttctgcatttccaactgaggtactgggttcatctcactggggattgtcggacagtgggtgcaggacagtgggtgcagcgcaccgagcatgagccgaagcagggcgaggcatcgcctcacctgggaagcgcaaggggtcagggaattccctttcatagccaaggaaagagatgacagatggcacctggaaaattgggtcattcccaccctaatactgcgcttttccaacggtcttagcaaacggcacaccagaagattatatcccgcgcctggcttgaagggtcctacgtacacggagcttcgctcattgctagcacagcagtctgagatcaaactgcaaggcggcagcgaggctggggaaggggtgcccgcccttgctgaggcttgagtaggtaaacaaagcagctgggaagctcgaaatgggtggagcccagcgcagctcaaggaggcctgcctgcctctgtagactccacctctcggggcagggcatagccgaacaaaaggcagcagaaacctctgcagacttaaatgtccctgtctgacagctttgaagagagtagtggttctcccagcatggaccttgagatctgagaatggacagactgcctcctcaagtgggtccctgacccccgagtagcctaactgggaggcaccccccagtaggggcagactgacacctcacatggccgggtactcctctgagacaaaacttccagaagaacaatcaggcagcaacattggctgtttagcaatattcgctgttctgcagcctccactgccgatacccaggcaaacagggtctggagtggacctccggcaaactccaaacggacctgcagctgagggtcctgactgttagaatgaaaactaacaaacagaaaggacgtcgacaccaaaaccccatctgtacatcaccatcatcacagaccaaaggtagataaaaccacaaagatggggaaaaaacagaacataaaaaactgaaaattctaaaaatcagagcgcctgtcctcctccaaaggaacacagctcctcaccagcaacggaacaaagctggacagagaatgactttgacaagttgagagaagaaggcttcagactatcaaactactctgagctaaaagaggaagtttgaacccatggcgaagacgttaaaaaccctgaaaaaagattagacgaatggctaactggaataaccaatgcagagaagtgtttaaaggacctgatggagctgaaaaccatggcacgagaacttcatgacgaatgcacaagcttcagtagccgatgcgatcaactggaagaaagggtatcagtgatggaagatcaaatgaatgaaatgaagtgagaagagaagtttagagaaaaaagaataaaaagaaacgaacaaagcctccaagaaatgtgggactatgggaaaagaccaaatgtacgtctgattggtgtacctgaaagtgacggggagaatggaaccaagttggaaaacactctgcagaatattatccaggagaacttccccaatctagcaaggcaggccaacattcaaattcagaaaatacagagaatgccacaaagatactcctcgagaagagcaactccaagacacataattgtcagattcaccaaacttgacatggaggaaaaaatgttaagggcagccagagagaaaggtcgggttacccatgaagggaagcccaccagactagcagctgatctctcggcagaaattctacaagccagaatagagtggaggccaatattcaacattcttaaagaaaagaatttttaacccagaatttcatatccagccaaactaagcttcataagtgaaggagaaataaaatactttaaagacaagcaaatgctgagagattttgtcaccaccaggcctgccctaaaagagctcctgaaggaagcactaaacatggaaaggaacaaccagtaccagccactgcaaaaacatgccaaattgtgaagaccattgaggctaggaagaaactgcatcaactaacgagcaaaataaccagctaacatcataatgacaggatcaaattcacacatgacaatattaaccttaaatgtaaatgggctaaatgctcaattaaaagatacagactggcaaattggataaagagtcaagacccatcagtgtgctgtattcaggaaacccatctcacatgcagagacacacataggctcaaaataaagggaaggaggaagatctaccaagcaaatggaaaacaaaaaaaggcaggtgttgcaatcctagtctctgataaaacagacttttaaccaacaaagatcaaaagagacaaggccattacataatggtaaagggatcaattcaacaagagctaactatcttaaatatatatgcacccaatacaggagcacccagattcataaagcaagtccttcgagacctacaaagagacttagactcccacacaataataatgggagactttaacaccgcactgtcaacattagacagatcaacaagacagaaagttaacaaggatacccaggaattgaactcagctctgcaccaagtggacctaatagacatctacagaactctccaccccaaatcaacagaatatacatttttttcagcaccacaccacacctattacaaaattgaccacatacttggaagtaaagctctcctcagcaaatgtaaaagaacagaaattataacaaactgtctctcagaccacagtgcaatcaagctagaactcaggattaagaaactcactcaaaaccactcaactacatggaaactgaacaacctgctcctgaatgactactgggtacataacgaaatgaaggcagaaataaagatgttctttcaaaccaacgagaacaaagacataacataccagaatctctgggacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagagctgaaggagatagagacacaaaaaacccttcaaaacatcaatgaatccaggagctggctttttgaaaagatcaacaaaattgatagacagctagcaagactaatacagaagaaaagagagaagaatcaaatagacacaataaaaaatgataaaggggatatcactaccgatcccacagaaatacaaactaccatcagagaatactataaacacctctactcaaataaactagaaaatctagaagaaatggataaattccttgacacatacaccctcccaagactaaaccaggaagaagttgaaactctgaatagaccaataacaggctctgaaattgaggccataattaatagcttaccaaccaaaaaaagtccaggaccagatggattcacagccgaattctaccagaggtacaaagatgagctggtactattccttctgaaactattccaatcaatagaaaaagagggaatcctccctaactcattttatgaggccagcgtcatcctgataccaaagcctgacagagacacaacaacaaaagagaattttagaccaataaccctgatgaacatcgatgcaaaaatcctcaataaaatactggcaaactgaatccagcagcacatcagaaagcttatccaccatgatcaagtgggcttcatccctgggatgcaaggctggttcaacatatgcaaatcaataaacataatccagcatataaacagaaccaatgacaaaaaccacatgattacctcaatagatgcagaaaaggcctttgacaaaattcaacaacccttcatgctaaaaactctcaataaattaggtattgatgggatgtatctcaaaataataagagctgtctatgacaaacccacagccaatatcatactgaatgggcaaaacctggaagcattccctttgaaaactggcacaagacagggataccctctctcaccactcctattgaacgtattgttgaatagttctggccaaggcaatcaggcaggagaaggcaataaagggtattcaattaggaaaagaggaagtcaaattgtccctgtttgcagatgacatgattatatatctagaaaaccccattgtctcagcccaaaatctccttaaactgataagcaacttcagcaaagtctcaggatacaaaatcaatgtgcaaaaatcacaagcattcttatacaccaataacagacggagagccaaatcatgagtgaactcccattcacaattgcttcaaagagattaaaatacctaggaatccaacttacaagggacgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatcctcatcaagctaccaatgactttcttcacagaattggaaaaaactactttaaagttcatatggaaccaaaaaagagcccacattgccaagtcaatcctaagccaaaagaacaaagctggaggcatcacactacctgacttcaaactatactacaaggctacaataaccaaaacagcatggtactggtaccaaaacagagatatagaccaatggaacagaacagagccctcagaaataacgccgcatatctacaactatctgatctttgacaaacctgagaaaaacaagcaacggggaaaggattccctatttaataaatggtgctgggaaaactggctagccatatgtagaaagctgaaactggatcccttccttacaccttataaaaaaattaaatttggattgaagacttaaatgttagacctaaaactgtaaaagccctagaagaaaacctaggcaataccattcaggacatagacataggacttcatgtctaaaacaccaaaagcaatggcaacaaaagccagaattgacaaatggtatctaattaaactaaagagcttctgcacagcaaaagaaactaccatcagagtgaacagccaacctacagaatgggagaaaatttctgcaatctacttatctgacaaagggctaatatccagaatctacaatgaactccaacaaatttacaagaaaaatgtaaccccatcaacaagtgggtgaaggatatgaacagacacttttcaaaagaagacatttatgcagccaacagacacatgaaaaaatgctcatcatcactggccatcagagaaatgcaaatcaaaaccacagtgagataccatctcacaccagttacaatggcgatcattaaaaagtcaggaaacaacaggtgctggaaaggatatggagaaataggaagacttgtacactgttggtgggactataaactggttcaaccattgtggaagtcagtgtggcgattcctcagggatctagaactagaaataccatttgatccagccattccattaccgggtatatacccaaaggattataacacatgctgctataaagacacatgcacacgtatgtttattgcagcactactcacaatagcaaagacttagaaccaacccaaatgtccaacaacaatagactggattaagaaaatgtggcacatatacaccatggagtactatgcagccatataaaaggatgagttcatgtcctttgtagggacatggatgaagctggaaaccatcattctcagcaaactattgcaacgacaaaaaccaaacactacatgttctcattcataggtcgaattgaacaatgagaacacatggacacaggaaggggaacatcacacaccggggcctgttgtggggtggggggaggggggaggtatagcattaggagatatacctaatgttaaatgacgagttaatggatgcagcaccccaacatggcacatgtatacatatgtaacaaacctgcacgttgtgcacatgtaccctaaaactttaagtataataatttaaaaaaacccatcatatttacccaaagtactaaatatttataggtatgaattgaattcagatgggatatatacacacacaatacagtattgtattgtagaaatattgatatttacattcaacaggttatgtttgtattaatcaggtttaaatgtagggtaagataaatgtcctttattacaacaatttttatggtacattaatgtttaataatgccctatctttaaattagtttataactaattctctgtggaagcattgtagaatctaaaaatctgaattaagatcagaattaacacaaaaaaattgcatctgttgccattttatgtttttgaaatggagtctcgctctgtcacccagggtggagtgcagtggtgtgatctcacctcagtgcaacctctgcctcccaagtttaagtgattcttgtgcctcagcctcccaagtaactggggttacaggcatgtgccacctcacccagctgatttttgtatttttatagaaagagggtttcaccatgttggtcaggctggtctcgaactcctggcctcagcaatctgcccgcctcagtctcccaaagtgctgggattgcagatgtgagtcactgtgcccagccttctgttgccattttaaaactaagagttaaaagatgcttttgtataattttctagaaaatatcttttatacttattttcttctaactacatttaaaatacattttaaaaagcagaaagcaaaaatgaagtctaagcaaatttcccgtgaatacatttcttttacaataaatgtatgccagttattcagtgttagaattgaatatagttagattcttgagattctgtttttaaaagacaccacagtattttgtttttatatgaagtattatggtaaatgtgatcattaccttaaatatatggcatcaggtttttaaagtggtattttgtggattttgttaaatctgtctcaaagtctattttctcatgttatgtttgaagtatgggtatgatagtacccagaaaaacaggcctttcaaaacaaaatactctacttttatgactccataaaaaatacaatctttattattatccatagactgaataaaacatcttacattttatgtttcattttattcaccataatgcctattttcaataaaattacaggtgattttaaatatgactagacttttttttttaatagaaagatcacataatggcttaagtatattccattaggagtagtatttctcttgtctttttgttcagccattggagtcccctgtgaccttgggtactttttccataggcgaactgatgcttcatgacgttctgtgttttctggtagcttgcctgttgcctgcctctgggttcgtcatcccccttatgctgacttaggcaatatttcttcagtctcttatcttggggctttgatgcatatgttctgaaggtggccacagtgactttgggtagcagcagatggtaaaccttcaggctgccaccagctaaactggtgttaagttggaaagttaacgtttgatgaagaatcagtagtgcatatgaaagaactttcactgctgaaatatcttttaattaaaaattagcatactaaaacctttgtgaatgtctgggcatttaaagaaatctacaattagttgtgttcttatagaagtatttatttaccagtttagtcttatgttacttgctcttcctaacctggttctttttcctctgtttctaccccagtttgttggtagttaagataaatcagataactacataaattgaaatataggttgtttttaggaatcttgggtgtttgcataaacaaagtatattttgaattatggcattttggattttaataactaagaagagatgtggattttaagtacaatcttcatataattctggtagatttggtctgttttcttctacctttgaaggtatttctggatcaaataggagcctgaagaactcaacctgcctcaaagagatatttccttttgttctaaattagttggtgattcttgactctgccgttcttaactttgttaactttgcagaaattgatgcagcgacttctgatgagctaaagctgtaggcacaacatattttgcttttggagttactgagcagtgggtaca

SEQ ID NO: 289 - DNA, 6292 bp, Homo sapiens
tcaaaatatgcttattttctttttctaatattattcataatctactcatatcttggaagataaacttaactctggtagcatttgctctgttttcagctattatcacaatgacaaactatgatttttaaaaaaccatcatactggggcagttccaagatggccgaataggaacagctccagtctacagctcccagcatgagcgacgcggaagacgaatgatttctgcatttccaactgaggtactgggttcatctcactggggattgtcggacagtgggtgcaggacagtgggtgcagcgcaccgagcatgagccgaagcagggcgaggcatcgcctcacctgggaagcgcaaggggtcagggaattccctttcatagccaaggaaagagatgacagatggcacctggaaaattgggtcattcccaccctaatactgcgcttttccaacggtcttagcaaacggcacaccagaagattatatcccgcgcctggcttgaagggtcctacgtacacggagcttcgctcattgctagcacagcagtctgagatcaaactgcaaggcggcagcgaggctggggaaggggtgcccgcccttgctgaggcttgagtaggtaaacaaagcagctgggaagctcgaaatgggtggagcccagcgcagctcaaggaggcctgcctgcctctgtagactccacctctcggggcagggcatagccgaacaaaaggcagcagaaacctctgcagacttaaatgtccctgtctgacagctttgaagagagtagtggttctcccagcatggaccttgagatctgagaatggacagactgcctcctcaagtgggtccctgacccccgagtagcctaactgggaggcaccccccagtaggggcagactgacacctcacatggccgggtactcctctgagacaaaacttccagaagaacaatcaggcagcaacattggctgtttagcaatattcgctgttctgcagcctccactgccgatacccaggcaaacagggtctggagtggacctccggcaaactccaaacggacctgcagctgagggtcctgactgttagaatgaaaactaacaaacagaaaggacgtcgacaccaaaaccccatctgtacatcaccatcatcacagaccaaaggtagataaaaccacaaagatggggaaaaaacagaacataaaaaactgaaaattctaaaaatcagagcgcctgtcctcctccaaaggaacacagctcctcaccagcaacggaacaaagctggacagagaatgactttgacaagttgagagaagaaggcttcagactatcaaactactctgagctaaaagaggaagtttgaacccatggcgaagacgttaaaaaccctgaaaaaagattagacgaatggctaactggaataaccaatgcagagaagtgtttaaaggacctgatggagctgaaaaccatggcacgagaacttcatgacgaatgcacaagcttcagtagccgatgcgatcaactggaagaaagggtatcagtgatggaagatcaaatgaatgaaatgaagtgagaagagaagtttagagaaaaaagaataaaaagaaacgaacaaagcctccaagaaatgtgggactatgggaaaagaccaaatgtacgtctgattggtgtacctgaaagtgacggggagaatggaaccaagttggaaaacactctgcagaatattatccaggagaacttccccaatctagcaaggcaggccaacattcaaattcagaaaatacagagaatgccacaaagatactcctcgagaagagcaactccaagacacataattgtcagattcaccaaacttgacatggaggaaaaaatgttaagggcagccagagagaaaggtcgggttacccatgaagggaagcccaccagactagcagctgatctctcggcagaaattctacaagccagaatagagtggaggccaatattcaacattcttaaagaaaagaatttttaacccagaatttcatatccagccaaactaagcttcataagtgaaggagaaataaaatactttaaagacaagcaaatgctgagagattttgtcaccaccaggcctgccctaaaagagctcctgaaggaagcactaaacatggaaaggaacaaccagtaccagccactgcaaaaacatgccaaattgtgaagaccattgaggctaggaagaaactgcatcaactaacgagcaaaataaccagctaacatcataatgacaggatcaaattcacacatgacaatattaaccttaaatgtaaatgggctaaatgctcaattaaaagatacagactggcaaattggataaagagtcaagacccatcagtgtgctgtattcaggaaacccatctcacatgcagagacacacataggctcaaaataaagggaaggaggaagatctaccaagcaaatggaaaacaaaaaaaggcaggtgttgcaatcctagtctctgataaaacagacttttaaccaacaaagatcaaaagagacaaggccattacataatggtaaagggatcaattcaacaagagctaactatcttaaatatatatgcacccaatacaggagcacccagattcataaagcaagtccttcgagacctacaaagagacttagactcccacacaataataatgggagactttaacaccgcactgtcaacattagacagatcaacaagacagaaagttaacaaggatacccaggaattgaactcagctctgcaccaagtggacctaatagacatctacagaactctccaccccaaatcaacagaatatacatttttttcagcaccacaccacacctattacaaaattgaccacatacttggaagtaaagctctcctcagcaaatgtaaaagaacagaaattataacaaactgtctctcagaccacagtgcaatcaagctagaactcaggattaagaaactcactcaaaaccactcaactacatggaaactgaacaacctgctcctgaatgactactgggtacataacgaaatgaaggcagaaataaagatgttctttcaaaccaacgagaacaaagacataacataccagaatctctgggacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagagctgaaggagatagagacacaaaaaacccttcaaaacatcaatgaatccaggagctggctttttgaaaagatcaacaaaattgatagacagctagcaagactaatacagaagaaaagagagaagaatcaaatagacacaataaaaaatgataaaggggatatcactaccgatcccacagaaatacaaactaccatcagagaatactataaacacctctactcaaataaactagaaaatctagaagaaatggataaattccttgacacatacaccctcccaagactaaaccaggaagaagttgaaactctgaatagaccaataacaggctctgaaattgaggccataattaatagcttaccaaccaaaaaaagtccaggaccagatggattcacagccgaattctaccagaggtacaaagatgagctggtactattccttctgaaactattccaatcaatagaaaaagagggaatcctccctaactcattttatgaggccagcgtcatcctgataccaaagcctgacagagacacaacaacaaaagagaattttagaccaataaccctgatgaacatcgatgcaaaaatcctcaataaaatactggcaaactgaatccagcagcacatcagaaagcttatccaccatgatcaagtgggcttcatccctgggatgcaaggctggttcaacatatgcaaatcaataaacataatccagcatataaacagaaccaatgacaaaaaccacatgattacctcaatagatgcagaaaaggcctttgacaaaattcaacaacccttcatgctaaaaactctcaataaattaggtattgatgggatgtatctcaaaataataagagctgtctatgacaaacccacagccaatatcatactgaatgggcaaaacctggaagcattccctttgaaaactggcacaagacagggataccctctctcaccactcctattgaacgtattgttgaatagttctggccaaggcaatcaggcaggagaaggcaataaagggtattcaattaggaaaagaggaagtcaaattgtccctgtttgcagatgacatgattatatatctagaaaaccccattgtctcagcccaaaatctccttaaactgataagcaacttcagcaaagtctcaggatacaaaatcaatgtgcaaaaatcacaagcattcttatacaccaataacagacggagagccaaatcatgagtgaactcccattcacaattgcttcaaagagattaaaatacctaggaatccaacttacaagggacgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatcctcatcaagctaccaatgactttcttcacagaattggaaaaaactactttaaagttcatatggaaccaaaaaagagcccacattgccaagtcaatcctaagccaaaagaacaaagctggaggcatcacactacctgacttcaaactatactacaaggctacaataaccaaaacagcatggtactggtaccaaaacagagatatagaccaatggaacagaacagagccctcagaaataacgccgcatatctacaactatctgatctttgacaaacctgagaaaaacaagcaacggggaaaggattccctatttaataaatggtgctgggaaaactggctagccatatgtagaaagctgaaactggatcccttccttacaccttataaaaaaattaaatttggattgaagacttaaatgttagacctaaaactgtaaaagccctagaagaaaacctaggcaataccattcaggacatagacataggacttcatgtctaaaacaccaaaagcaatggcaacaaaagccagaattgacaaatggtatctaattaaactaaagagcttctgcacagcaaaagaaactaccatcagagtgaacagccaacctacagaatgggagaaaatttctgcaatctacttatctgacaaagggctaatatccagaatctacaatgaactccaacaaatttacaagaaaaatgtaaccccatcaacaagtgggtgaaggatatgaacagacacttttcaaaagaagacatttatgcagccaacagacacatgaaaaaatgctcatcatcactggccatcagagaaatgcaaatcaaaaccacagtgagataccatctcacaccagttacaatggcgatcattaaaaagtcaggaaacaacaggtgctggaaaggatatggagaaataggaagacttgtacactgttggtgggactataaactggttcaaccattgtggaagtcagtgtggcgattcctcagggatctagaactagaaataccatttgatccagccattccattaccgggtatatacccaaaggattataacacatgctgctataaagacacatgcacacgtatgtttattgcagcactactcacaatagcaaagacttagaaccaacccaaatgtccaacaacaatagactggattaagaaaatgtggcacatatacaccatggagtactatgcagccatataaaaggatgagttcatgtcctttgtagggacatggatgaagctggaaaccatcattctcagcaaactattgcaacgacaaaaaccaaacactacatgttctcattcataggtcgaattgaacaatgagaacacatggacacaggaaggggaacatcacacaccggggcctgttgtggggtggggggaggggggaggtatagcattaggagatatacctaatgttaaatgacgagttaatggatgcagcaccccaacatggcacatgtatacatatgtaacaaacctgcacgttgtgcacatgtaccctaaaactttaagtataataatttaaaaaaacccatcatatttacccaaagta

SEQ ID NO: 290 - DNA, 4838 bp, Homo sapiens
ttctggattgctagtgcaaggttagggcttgagatgaaactaatgaattgtcatctaaatgcccttccacgccagtttgggactatgggctttatccttttagtacctgctagcagaaattgttttttggttttttttggcaaggggagagggacaccaaagagttttagattaggcaacaacatgatgattaaattttcaacttaggaagagagctctcatcaatatggaagagcttggagaagataagaacagaggcaggaaggctgggtaggagattgtggcatgaactccagtgagagatcaggaaggctgctcatcaggagatgaatgccacagacatcaaagagctaacaactgatgagttgaatgcagggggctgagtaggactctgaggctttttgcttggtcgcacgtggtggaccggtggtccattgaaccctctgctgtctcctcatcccaccactgccctctcctctctcctcttccctccttagctaagctcatcatctcagtaacacttctgccatagcccataacttctttgcctcttgtcctcacaccaatctagcaaaactccagccctgaatgaacacatcttttctcttctttgtgcttacacctgagccctgcacctggaaaaagtcacatttcagtgcagattggccagttcacatcatgctaatttcctagagctgctgtaacaaattgccacacatttggtggcttaaaacaacagaaatttaattatcttacaattctggggtccagaaattcaaaattcatctcactgggccaaaattaaggtgtcaacaggaccacactccctctgggggctctagggcagtggtcccaaacctttttggcaccagggactagtttcctggagaacagtttttccatgggctgcagtagggggaatggtttcaggataaaactgttctacctcagatcatcaggcattagattctcataaggagtacacaacctagatcccttgcatgtgcagttcaccatagggtttgcacttttatgagaattgaatgccgccacttacttgacaggaggtgtattagggttttctagagggacagaactgataggagatatatatgtgaatttattaagaattaactcacacaatcacagggtcccacaatcagctgtctgcaagctgaggagcaaggagagccagtccaagtcccaaaactgaagaacttggagtctgatgttcaaggataggaagaatccagcatgggagaaagatgtagtctgggaggctaggccagtctctccttttcacattttctgcctgctttatattcattgacagctaattagatggtgcccacacagctgattagatggtgcccacccagattaagggtgggtctgccttccccagtccactgactcaaatgttaatctcctttcgcaacaccctcacagacacacccagggtcaatactttgcatccttcaatccaatcaagttgacactcagtattaaccatcacaggaggtgaagctcaggcggtaatgctggctcaccccgatctcctgctgtgtggcccagctcctaacaggccacagactgggggctggggactcctgctctagggacgatttgttccttgcctcttgcggcttctggtgactgtcagcaggcttgtgtgtggctgcatcactctactctctgcctccatcctcacgtggccttctccttgtctctgtctcaaagctccctctgccactctcttttaaggatacatatgattgcatttaaggcttccagatagtctagaataaacatctcctctcaagatccttaaataaatcatatcttttgccatataaggtactattcacactttctggggattagaagtgaacatgcagtagtccctttgtatctgcaggttctgcatccactgattcagccaaaaatattggaaaaataaaaattaaaaattaatacagattttaaaaatacagtataacaactatttacaaagtattacatcacattagatattataagtaatctggagatgctttaaagtatacagaaggagtatatgggaggagtagctgtggattttgatattcacaggatgatgctggaaccaacccccgacaaataccaaggaatgattgtatttcgcggggacatttttcttcctaccatttacacttatgcaggaccactgaccttggagggcccttgacctgcctggcaatctgaccaaattactctggaaggcttgtcctcccactttccctaatgctgattcctttcattcctgacccacctatgggtcacatcacttttcccacatcattctcaacaagtgaccttgttgtgttctctatggggggaaaagaaaagaaagaaaaagaaatccctggacctggaccagaatttcttaacttgttgctaaagttaataaacctacctgcatctttcctcacttcttctcctactaaaataatggatctctccatccctgtcctgagaccatctctactcaggctctggataccactctctcctgcttcctcaggaaccttaaatggccaatcaccccacctttgttttgtagagtcagccttttcttcttgataaggtccttcccttcagctcaagttttaaaactcttccttcaggaattttccttcttaaaagaacaatttaaaaaccttacaacaaacaaaattccaccccctggccaatccatcactaagtcctgctgatggtaccttgtaagtctttctaattcaccaacttctccccttctcagcctgctatgagtccagtctgtcatcacatactcctggacgaccatagtaacctttctgcatccatttttggcacctcacaattgctctgttaagctgccttcagttgtgtgtgattggtatgtgagctccatgaggtcagggacttagttccattcatgtgttccctgtgtcctcatcatcttgaaaagggccagaaacacagtagctgttcaataaatgtttgttgaaggtattcacataatttatcactaatttcaggaggaagacaaagttccttaacagcccaaaaggcccagaaaggcctgacccctactcatctctccacctcatcttgtgtcatcttcccttgttccctgagctctagacacattggtcttctatgaacgctcccagttttctcctgccccagggtatgtgtagagaaatgtttcctcattgtttagaacattcccctctgccccaacccaacttttcctaataaataccactcagccttcagatctcagctcatatatagcaagttgcttccttggaaaatctttccttagcaccattatatgctctgttatgttctcgttgcacatatatctgtcatagaaatttcccagtaagaactgtgttcatatttggtgactatttgattcatgtctgtcttagtccattcagactgctataacaaaatatcttagactcagtgatttacaaacaacagaatttattgcttacaattctggaggctgagcagtccaagatcaaggcaccagcagatttgttgtctggtaagggcctgttccccatacatggcaccttcttgctgcatcttcatgtggaggaagggtaagagagctcactcaggtctcttttataaggacactaattccatttatgagggtggagccctcatcacttaatcacttcccaaaggttccaccacttaatactatcacattggctattagattcaacataagaacttgatggagggggctgtcaacattcagactgtatcaatgtctgtctttcccatcaaatgaggacaggggccactatattcccagtgcttagcatactgtctgacacacagagatgctcaataggtatgcactgcaggaacaaatgaagggataatggaataatggcaaggctgagatcagttgcaggaggagaaggtttagtggaagggtcacaactcagttttgcccatgttggagggccccacagctaattcagctggagaggtacactcttgtttgggaatctgggctgggagctaaggacagagggcaggctggatatctagacttaggtggttggcaaccctgtagtagatgcaaaagatgggccatataagaggattcatgtctagagatgagagggggatgggattaagggcagactgggagctcagaaaggaagacccacagattaaaaaaagatgagctaagtgtagagatgtaaaggagggacgaggttgaggggcacgtgaagcagcaggtgaggccaagtgaaggtgaaggacagactgggggtaaaatgagggattggggagaatcaggaaggtttagattttctgagaggaaaaaaatctcctgctggcctaggccaagcaggtgacctgcatgagtggagtgtgtttacctgtgtgcatgcttatacgtgtgtcatagggaacaccacaccactctcaatgtgacttcacttctcaatagattgcctggcatctttttacagcaacccaaactctctgaggcaagtaaggcaggtgtaatgatctttcttttctaggtgcaatattaagttggactcatatcctaggccaatgctctttccaccaaaccacactatttcactgggctctagccagcttgtccggagcttgaagacatattactgtcttatttcagcatttctgtctactgcagatgaaattggcctccagccagagaaaaataaaatgcccttgataaacggcaatatagtaggatcatagctttaggaaattgtgatgctccttgtaacattccccgctttttttct

SEQ ID NO: 291 - DNA, 4615 bp, Homo sapiens
aatttaatgtttatgcttactttcatagtgttttcttttttgtagaaaatgcgtaattgatatagatccagtcacctactaatgcagtgtttattagcttaaggagcttttgggctgagattatggggttttctatgtgtagactcatattatcttcaaagagagataatttgacttcctttcttcctattaatatttacaggccttttatttctttctcttgcatgattgctctgcctaggacttccagtctatgttgactaggaatggtgagagatggcatccttgtcttgttttggttttcaaggggaatgcttccaggttttgcccattcagtatgatgttggctgtgagtttgtcatagatggctcttcttattttgaaatatgttcctttaatgtctagtttgttgaggggttttaacatgaaggacatcgaattgtaccagaagacttttctgcatctattgagatagtcatgtggtttttgttttcagttctgtttatgtagtagatcgcatttatgtatttgtgattattgaaccaaccttgcatcctgggataaagcctgcttgagtgtggttgattagctttttcacgtgctgcaggattcagtttgctagtattttgttgagaatttttacatctgtgttcatcaaggatattggcctgaagatttttttgttgtatttctgccaggttttggtatcaggatgaagctggcctcatagaatcagttggagaggagttcctcctcctcaattttttggagtagtttcagttagaatggtacaagctattctttatgcatctggtggaatttggctgtgaatcattcttgtcctgggtcctttatggttggtaggctttttattactgatttaattttggaactctttattggtctgtccagggattcaatttctccctggctcaatcttgggagtttgtatgtttccaggaatgtattcatttattttaggttttctagtctatgtgcatagaggtgttcatagcagtctctgagggttttttatatttctgtggggttggtggtaatgtcttttttggcatttatgattgtttatttggatcttctctctttttctctttattagcctagctagtggtctatcatatttcttatgtcaaaaaaccaactcttgtactcattgatcttttgtatggtttttttgcctcttagtttccttcatttcagctctgattttagttatttcttgtcttttgctagctttgggtttgttttgtattgtttctctagttcctctaggtgtaatgttaggttgctaatttgagattttatgaatttttgatgtggacctttagcactataaactttcctcttagcactactttagctgtgtcctagagattctggtatgttttcttggttctcagtagttccagagaatttcttgatgtctgccataatttcattgtttacccaaaagtcattcaggaccaggttgtttaatttccatccaattgtatggttttgagcgattttcttagtattgatttttatttttattgcattatggcctgagagtgtggttggtatggtttcattttttttagattttctgaggattgttttatgtccaattgtgtggttgattttagagtatgtgctatgtacagataagaagatggtatattctgttccttttgggtagggcattttgtagatgtctaatagttccatttggtgaagtgttaagtttagatcctgaaaatctttgttaattttctgactggatggtctatctaaaaactgtcagtagggtgttgaagtctcccactattattgtgtgggaatctaagtctctttgtaggtctctaagaactcgctttatgaatccgggtactcctgtgttgggtgcatatatatttaggatagttaggcattcttgttgaattgaaccctttaccattacgtaatgtccttccttgtcttttttgatctttgttagcttaaagtatgttttgtctgaaataacaacccctgcttttttctgactgccatttgcttggtagattttcctctatccctttactttgagcctatgggtgtcattacatgtgagatgggtctcttgaagacagcataccattcagtcctgcttctttatacagcttgccactctgtgccttttaattggagcatttagccaatttacattcaagtttaatatttatgtgtgtggatttgatcctttcatcatgtttctagctggctattgtgcatacttgtttgtgtggttgctttatagggtcaacagtttgtatacttaagtgtctttttgtagtagcttataacagtctttgctttccatatttagcactcctttcaggacctcttgtaaggcaggtctggtggtcataaattcccttagcatttgcttatcgggaaagaatctaatttctcctaggtttatgaagcttagtttggctggatatgaaattcttgcttggaaattgttttatttagtaaggctgaatatagacccccaatttcttctggcttgtaaggtttctattgaaaggtcctctgttagcctgatggggtttcctttgtaggtgacatgccccttctctccagttgcctttcactttttcccttttctttcagccttggagaatctaattatgtgtcttggccatggtctttttgtgtagtatctcacgctggttctctgcatttcctgaatttgtattttggcctctctagtgaggctggggacgttttcatgggtgatattctgaaatatattttccaagttgcttgctctctccttatctcttgcagggatactaatgaattggagatttggtctctttacataatcctttattttttgagtgttttgttcattttctttctctgactgagttagttcagagaaccagtcattgagctctcagattctttcctgaacttggtctattcttctgttaatacttgcaattacattatgaaattcttgtagtgtgttttccactctatcagatcagttagagtctttttttttttttttaagacagagtcttgctctattgcccaggctggagtgcagtggcacaatcttggctcactgcaacctccgcctccctggtttgagcgattatcctgcctcagcctcctgagtagctgggactacaggtgctgggagcccaggtcaagaggcactgcccagtgaagagtagtggaggcatgtggacaagtctggctgcttttccataaagtggctgtgttgtgctagaggtttgtatcggtccccaaccactatatgtcctctcaatcccaagggcaacaggagcaagggctgcagggcagcaaaaatggtggcctgcttgctccttctgtgagctctgtcccagaaaagcacagagctgctactagcctgagagcctaggtagggggtggctagagaccccggtagggagacactgcccagagaaccatagcagggttggggacccatgtagaaaacagtctgctgcttttctgtaaggtggctgcactgtgctaggggttcatggtagtccctaatcactgtgtaccctcctgatcttgagggcatcagtggggaaggttgtagggcaacaaacatggtggcctgcctttcccactgagagctctgtcccagggaagtggagagctggtagtggcctaagagtccagtgtggggtggttgaggttctaggtcaggaggccttgctcagtgagaagtagcaggggtgggggctcctgtgtaaaacaatctggctacttttccttaaggtggctgccttttactgagtgtctacgattgcccctaatcactgagtacactccccagcctgagggcaaacaggagggagggttgtggatgtggtctgcctctccctctagaagcttgtcccagaaaagcacagagctgctcctgatccgagaattctggtagggctgtggtggtctcactagtgtcccaggcccatgggtcttatcctgcaaggtgctgcagagacgaggcctgtagcaccttgcaggataaggtctactgggcctagttactcttcagccacatggattcagcccctttcctggagacgtgagggagcctggcctcctccattgctagagctgcatctgctggtgttgaggtgcctggggatccagcactcctgggagtctgtgagtacctgagtgatggctctgccaagactccacataactctttgcatgtttgtctggaagccctggttgcagggatcatgagaaatctcctgatcctgagtccaaggatgcaaaggtccatgacagaagtgtgaatccctggggactctcactcactcactgttccctgtgatgtgaggactcctctggctccatgccacttctgggtgggcaattgtcctgtcttgctcttctctgttcactgtgggtgatgctgtttccctgataaatccccatgtttccacctggatgttctggttgaagagctagtgtccattcaccactgtttcttctctccatgagagtggtgcttattacccacttctactcagctatctcacgccaaatctctaaacttagtctttttttttaagag

SEQ ID NO: 292 - DNA, 6834 bp, Homo sapiens
acaaacattgaacactttttgatatatatgagatacaattttaaaggatatatagaggttataattttgaagtagcttatcaatttattcttttatattcttgcttttggattcttctaagaaatctttttatcatgaatgtcttgtgaattcagtcaaatccttttactgcatcaattaaaactgtattagtccattctcaaactactctaaagacatgtctgagattgggtaatttatgaagaaaagaggtttaatttactcacagttctgcaggctgtgctggaagcaaagctgggaggcctcaggaaacttacaatcatggtggaaggtgaaggggaagcaagcacatcttactatggtggaacaggagatatttgtccattttaaaattttcttcctgtgattgatttctagttttatactattgtgatcaggaaaggtacttgatatgatttcaatcagctaagatttggtctaacatgttatctgttctgaagaatgtctcacatgtgctggagaagaatgtgtattcttctgctgttgaatggaatattctgtatgtgtccgttagatccatctgcactaacatatagttcaggtccaattttctttactgattttttgtctagataatgtatctattgttgaaagtgagagtgttgaaatgccctacttttattgaattgccatttgtatctcccttcagttgtgttaatatttgctttacatatttaggtattctgatattgggcacatatgtattcatagttgttatatcttcttgatggattgacttctttattgttatttaatgatcctctttgtcttatgacagtttttaacttaaagtctgttctcttctgatataattaagctacctctgctctattttagcttccatttttatagaaattcatgttcatcccttcactttcagcctatgtgtaaggctaaagttaatctcttgtaggcagcatatagttggatcttaatttttgatccattcagccactcttccttttgtttggagaatttaaacaatttacatttaaagtaatgattagtaggtacaaatttacaatgctatttttattttctggttatttttaatggattctttgtccttcctttcttgcttgctgtgttcccttgtgctttgttgattttctgtagtgatatgctttgattcttttctctttatctcatatatacctactatgtttctgttttacaactacgatgaggcttacgtggaacatcttatacttaataacagtctatttagaaatgataacaactcaacttcaatttcattcaaaatctctaccattttacctgtcactctcctccagcacacattttatatttatatatattttatattgtgaatttattaacaaaacaacaaaatattatacctatagttacttttaatacttttgtcttttgacctttatactggacttaaagttgatttatacaccatcatttcagtactacaatattgtgaatttaactataaatttacatttataagtatattttatgcttttatatgatttcatgttactaattaacacccttccatgttagcttaatttaagatccctttagcatttcttgtaagacaggtctagtggtgatgaacttcatcatcacttttgtttgtctgtgaaagtatctctccttcatttctgaagaacaattttgctagatacggtattgttggatggcagttttttttttttctttttgcgctttgaataaatcatcccattctctggtgctgtatggtttctgctgagaagtgttctgttagcactattactgttcccttgtatgtaacaagttactattctcttactgctttcaattttttttaatgtttggcagtttgattataatgtgtctgtgtgaagctgtcttttggattgaatctgtttgggaacctttgaacttcataaatctggatatgtatatttctctcaaggttatcaaagttttcaaccattatttctttaaatgtactctctgtccctttctctctcttcctctgaatctcccataatgtgactattggttctcttgatagtgttcaataagggtttcttttctgttttttgttattttcagtgttctatagggtttctttcctcttttctattcttatctattttttgtactctgatagtataatttcaaaagatctgtcttcaagttttcaaattttttcttttgcttgatcaagtcggctagcagagctctctactgcattttttctttcattcattattcttttagctccagaatttctacttggttcttttttgtgatttctttttgttgaactttaaattttattcacgtattattttccattgtttcttgagttgtctgtttactcttgtgtcttgctcagcttgagcttccttaaaagaattaaaataattattttgaatttgaaaaataattattttgaatcatttttcagataactaatagatctccattttgttgaggtcagttcctggatagctattgtgttcctttgccagtgttatcattccctgcttttttgtgtttttagtgaacttgcattgatgtttgtatatttgaggcaacaagtcacctgatctggtctttttgaagtagatacagtggggaaatgctttcagctgtgaatggctacaagggcaccagctggatggggtgcaacatctcctgttttaagaaagacacaggtatggtctcaatgcagtttaatcagccgaagtcagtgttggcaaatactgcaggtatccatggcagaagccaaagttgcagatgtctgtagtaactgtagtggttaaggctgttaaggtcctcagtattgaaagctgttgagtttctcctattcaacttttatctcacatagggaagttccagccaaagtgattcctcttggcactaagtctgatgtgctggcacacatgcagctgtggtggtgttgggatcctggccactggtgcacagtcagcaatgctggttctgggtgcaggtgcccagagcagccatgaagccagggctctgtggtcagaggcacatgtaactgaggtggtgcctggggcacaggtgcattttttttatttggcattgacaccaatgtctgaggcctgggcatatacagattgcctatagagtgagaacctgtgtcatctttggggaatgccatgatgacttggtcccaggggtgatgagacatagtaatagcatggaacatagcagtaacgtgggtccagcgacaacagggtgtatcagaggcctgtcaggtcacgacaggggcaggatgcagagcagtagtctgaagccccagtgaaagtaggtaaaagccctgacttataacccaaggtaagagagcagtcagttatttacttatgaatatacaactgcttcatcatcatttgttgaagattatatatgtttcttagcacttttgtcaaatattatttgaccatgtatgtgtgagtttatttccaggtactcatctgttctaccaatatctaggtctgtctttataccaataccggcctgtcttgattcctgtacttttaattaagtcttaagattatatagtctgtatcctcaaactttcttatttttcagaacaatttgggctattctaggtctattatacttctctatatattttacaatcatgttttaagtttcttaagtaaaaaagaagtctgctgggattttgtttgaaattgctgtgaatttgtagatcagtttggggaaaagtaacaatattgaattttctaaccattaagcaaggtacatctttcaatttacttaagtcttctttaatttctctcaacaataattataatttttaatgtacagattttccacatttgctgttaaatttattcatatgtatttcataattgcaatgccactatgaatgttgattcaagagttccataaattttagttcagtgaaggaggttcacagtgtcgcttacaaattctatatccctactgatttgttttctctgattattctatcagttattaaaagaggaatgtttgcatactacaccttaattgtagatttgtctattttccctttcagttctattggttttcatgaattttgaagctttattataagatgaatccacatttaggattgctatatcttcttaagaaattgattccttaatcattctccctatatatctctcaaaatttcctttttctgaaatagactttgtctatattagtatagtcgtttcagcattttttaaattagtgttttcattgtaaatgttttccatcatttcgctttatatttaaagtggatttgttgtaggcaccatatagttgggtcttactttttatccactcaggcaatctctgcccataattggagtgtttcagtcatttacattaatatacttatctatgtgattgggcttaagccaaacattttctaatttgtttttctctttgtccccccactcccccttttttttttcttctttttctctgccttcttctcagggaaagattgcatatcttttaatgattctattttaacttcattattgatttattagatatacttcttttagttttttgttctcaggcttacaatatgtatctttgaattatcaaataagtagataaataaatggaatgataccacttttcatatattttaataactttacaacagcatgcttctatttatcctcctgttttttgcattattgtcataaatttacttccatatgttataaaccgcataatacattgttattaattttactttagtcaattatcctttaaagaaatgagaaaagtctttaatattaattttcatatttaacatttttgttgctcttcattatatagtggagatccatatttccatctggaatcatttttttctgtctaagatttcccttattatttttgtaacccatttatgtgagtgatgaattccttcagcttttgtttttttgcaaaaattcttttccactgcttgaaagatgtatttgctgggtatacaattttaggttgacattatttttatttcttactgcaaagatgccactccatcatcttttggtttgtatagtttcatctaatttttttaatgattttatcattttaatttttacatgtaataaatttttttatctgccagcttttaacattttctctttgttattagttgttttcagcaatatgattatgatgcctttttgtttttcttcattcttattctgcttgggatctttaagtttctattatctgcaggcttattactgtcttcaaattttgtctgtcatttatataaattggctatcattttttcaaatatgttttcttttgttcttcctttatgaaactccaattatggagttttgttttttaaagttttaaagatctcatttcattttaggtaatttctgttatttcttcaagtttactgtcttagtctgggatgttgtaaacaaatatactataaattgggtagcttataaacaacagaaatttatttctcacaattctgaaggctgagaagtctaatatcaaggcaccagtagatttgatgtctggtgagaacctgttccttatagatagtaccttctaaattcatcgtcacataatggaaggggtgaggcagctctctagggcctcttttataagggctctaattttatccatgagagctccattttcatgacctagtcaccttccaaagttcccacctcttaatacaatcatcttgggggttaagttttaacgtattaattttgggaaaacacaaacattcagaggatagcattctctattcttttctactataatgtctaatgtgcagataatgtttaaatttcatatacatttatatctctaaggcttttttatgtcttccattccttcctttgtcacatttgtattttcctcaaccttcttgattatctgtaatatgctttgaaaagcactttcattattttccatctgctagttttatcatctctttcatttctggatatgtttctattgagctattttttcctctggttatcatattttcctgattctttatatgcctgctactttttatatactagatattgtgaattttacgtttttggtggtattttgtgcctttttttagtagtgttcaactttttcctggaatgaaattaagttacttggaatctgtagctaatttgtctcactgctgaagtgacactcctatatctgctgttccatgtattaggagagctctgcagtttcattggtagtagcataaaatattcttagccttgtgtgagctctgggaattgttctgccttatctttttggtggctcttttataggtcttgagtagcttctgcacatggatgcacagattagtacacagccgaagtctcaaggacatctttctgcaaatctctggtattctctctctgtgcagtttattttgccttattagttgtagctgtttttgtagtctcagtctctcatctctgcctcctcaactaaatgagaccatcaatctctctttgagttctagtttcctgtgcccaagcctgggaactatcttcagtcactaacacagaacatttgtgaaatgtattaccttggttgctatccttctctcatcttattctatgttgcctgttgaccaatatgtgaaaactgttgtttaatatatttttgcccacttttctagtaatttaaaataggagattaaatcttttctctttaccaactttctgacaactactgcctgacttccccagccctaagctataacttctcagtatt

SEQ ID NO: 293 - DNA, 2088 bp, Homo sapiens
acctttctgcactatctgtaattcctaaccttaaatatgcatttccttattagcactgtcaataagtgttagctaaatgaggaaactatggtctgttttcttcttaataagtctgtttttagaagtaataatgaggaagcaatctaataaacgttattttttgttgtcgttgttttttgagacggagtctctctctctgtcacccaggctggaatgcagtggcacgatctcagctcactgcaacctctgcctcccgggttcaagcaatcctcctgcctcagcctcctgagtaactgggattacaggcatgcgccaccatgcccagctaatttttgtatttttagtagagatggcgtttcaccatgttgttaaggctggtctcaacctcctgaccttgtcatccgcccgcttcagcctcccaaagtgctgggattacaggtgagaaccaccgtgcccggccaaatgttatgtttttaaggaagaaaattcaaagcaaaatgctatgttgaaaactgacatgagttatgtctttttatgagctttcaattactttattttcttacccttgcaggtcagtgatcctccaaagataaaagaaaaacactgtgccacaggttagaattttttctgccagaaagctagacactgcaccagaccatctttaaagacgccgtccatatcagtcacgggctgagttgcaatcctagttttccgctgattattactgagaagcataccacatctgtcagccacaggacactgcaaatcttctactgccacagagttcagtatggcagtgacttaggcttcggcacacaagtcagccatgacaggttggtttgtagggtttatctacgcattctgatggtccctacacattttccagatgtgttgacctcataaaactgccacctaccccaggctgtgaaagaactgctccaaccatatttttcccacccctcaactctagcaacaccttgggttccctggctgggcgaccccctaagatatgaagctgggttggctgtcagtcctgagccctgacaagagaataacagcagggtggccgggcagccaggcatttttgcatccgcccagtgctgggaactgacgcattcctcgttccctggggcctaaggttctgcttggttttgggtccctgcaagattggggccctgcctactttctcaaccagtttatccttcaaccctctccctcaggccccaaaagttgctgctgaaggtccctgtcaacaggcaaacagtcaacccactacagacactcactcaccctgcctccaggccctctctctgcctggggcctcgtgttacacctgcctaaagtgcagcgcctggccttcctccccctgcctctggttaggatctccattctccctcgatcccctcttcttccactgtgacactctggtttccagatccttattcctcttccctccaggtcatgccctggcccattcttgatcaacttcgagttacagaatcagctctctcatacaagcattctgaacaggtcactggggtatggtagatacttgtagtatattttcttcaaaaagttacaaacagatttaactgaggaatcaatccaaaatcgagaatatcatctttcttggtgctgcctaggtacaaagcactttgtatatcttccgaggatgcaaagatatgacagtccccttcccttaaggagtttgaaatttagtagagaaaaaacaaattcagaaataactataaatcatccaaagcaaagaataccatgtaacacaagagaggttaaaagtgccagagtgtagaggatgaagagatcatctccaattggggaaactcaggaaaagattcatgaatgaggcagcacctgtggctgatactgatgaatgaccaggatttttatggggtaggacagaggccacagtttctgactaagaaaaagtatatttttcaaatcttctatattaaataatgagcaaatctggcctcttgtcaatatgttctttctaatcagctggctttttgtctgaaacactacattatatcacccaacactgtacagagaaagaatgccttctaggta

SEQ ID NO: 294 - DNA, 2919 bp, Homo sapiens
agtcatcgttcaacaaaatctcagtaacgtcacaaaaatctcaatacttcagatttacaaaaatctcaataacttatcacacatgctcctgtccaggttcattcattttaatcatataatacatgatgatttatttgtatttataaattatgtatactgttaatatctgaatggtaaatgacatgattcttttgattgtcattaaaataaagaggtacacctgaagcaaggtgggggcactccacttaataattgcacttaatgataatcgctaccagctattgagctactgagcacgacacggactttaaatattatcactcaaaaggttttcatggtgaaaagcaaaccatgtaaaaaatgttcattacaatccatcatgatcaaaatttcaatgtgttaagatgttatcttcagtaatagttgcaaaataattgcggtacagcatttagttctttcttccagttaagtgacaggcaaactgtacagcttcacaggttctactaagcacggacgacaatctgaaatagtccactaatgtccctccaagctcagatccctagcacatattggagttagggacttcagcccaggccagagaaaagctcagtacacacatctaaaggcttggacgtctacagatgagccagtctcaatctctctcttgcacgcacgtatgcacgcgcacacacacacagctgaaacatggctccaaagtcccatccttcatcctataataactgtctctctcttctcaagtaggatcagccaaccactaaaaagcaccctgttaattagaacctagacaatctgtctttaatctgatacaatgcctaagtagcccaaaaatgctgaatttcaacgttttgaaggatttattctatgctaataaagaactgggggccaagtgtgggggctcacacctgtaatcttagcacttggggaagctgaggcaggaggactgcttaagtgtaagagctcaagacctgcccaaggccaggcacgatggctcacgcctgtaatcccaacacttcgggaggccaaggtgggtggatcacctgaggtcaggagtttgagaccagcctggccaacatggcgaaaccctgtctctactaaaaatacaaaaattagctgggcgtggtggtcggcacctgtggtcctagctacctgggaggctgaggcaggagaattgcttgaacctaggaggcagaggttgcagtgagccaagatcgtgccactgcactccagcctgggtcacaaagcaaaactccatcttgaaaacaataaataaataaaactaaaaactaaagacctgcctgggcaacacagtgagaccttgtctctagtaaaaatttaaaaaattagccaggcatggtggcacatgcctgtggtcttagctactcaggaggctgaggtgggaggatcgcttgagcctgggaggtagaggctgcagtgaccttatggttgaaccactgcactccagcctgggtgacagtgcgagactgtctcaaaaaataaagtaaaataaagaatgatggtggtaaaatttatcctctgaagattttcagaggttttacactgagcaaacaaaataattcaatataagttatatcttgtaagagacacacctagtattaccagtctatctcttactagatataacttatattacctagtattaccagtgtatctcttactagttaagagatagaaagatagtctgaaattcccattttaccactaattacctttgaatttctgtgatttttataactactttcagcttcccaaagttcacatttcctatttgctcggttggaagtaagagagttgctatctagaggcttctgggtattccccaatttgcaaagagaatgaattccaaaagtgtattcgtggcttagttgttcagaactcaaggatgcccaaatacatgttcccatagaaataacgttgtatatgtggcagacccgttcccaggtggcccatgagatctatcacaccatgtcacaggagtagcagtcttgatccagccacacctgatcactatgcacaacagtctgaacccgagtctgctgtgtgatgccaggaacacgcctccccagtgtggcaggcagtcacctgggcatcctgagacttgtgtgttgaaggagcaggacaaaaatccatgtcggtatttctgctataatgtgatatatacattcctgaaaaatctcacatcctacaaaatcacacttgaaaaataacgggatgaaaaaggctgttggggtagaccactaaatccctctgtaactctgtaaccagagcactaaccaaaagaataattaatacctagggagatgacttggacagcctaggcaagcagcttggctgtggctgcggctgcctcgagggatattaaacacacaaatgacagagtggcaactgttggctcacagacagagtggagttctgagccaggagctatgttaaggtggacacagagggaagatgcctgctgggagcccagagtcctagaaggctagcgggtgcctgtcctggagagaaagcgctgggtgcaggcactcatttttaattttcttaaaatagagttgaaaagcgtgtctgctgcctgtgaggttctttcctttcttgctgaaggctgtaactctactccggcaattcctgctcctctggccaaagaaaaactgcttctggatcaatctaacctccaggatatactgacatcattcctctgcttttcagttgagctgactcgtgctatggacccaagggctgtagcacacagaactgcactcctaggaccagtggctgctgactcctcagagttctcacctggttagagaaggccctttccaagtctcccatttctaaaaactctgaatcagagaacagggggtagtcatcctgtgagaggta

SEQ ID NO: 295 - DNA, 19763 bp, Homo sapiens
ctcctaaagggtgaaacatctcagatgaaaaacctcactaaccaaaactcctaattactaaataaaacttaaggcattcataaacgcttgaatgtctgaaattgcaagtctatacagttgaaaatgcattttctgaattcagatatttgcccttgctacataataactgtagaatgttgagcaaattacttaaactcagtgtctcatttgtcttatctgtaaaattggaataagactagcactgcctcatagacttattttgaggattagagtgacttaataaatatcaatactcttggaacgatgcctggcaaaattattattgttttgccttgttgttatcttagataggttgtccctataccatgccaaaactattctgtcaatttgagggggaaaaattaagagtcaaaatagcaagttggtgcttgaacatttactttccttttggttattttatcattgtgtcaaagaattacaaacaacataatccctattttcaaaacttccttagccctctgatcttcccagagtcacagaaagtagtagttgaatggctttaatctagtttgtcttagtaatagaccaacaatccatcaagaaacaaatgccattctatggccctagttagatagaattcatgattgttttttcccctaggactgcattgcaacctcagacaagaatggcagacagccagcaggttctgccagctggctttgcactgctctctgggttttagagaacaggagcacagatatttttgattctgcaggccaattcaagcataatttacagtgaagaagaaaccctttaatagtgatttcgcatgtagagaaattatatttttaatataaaagaacatcacaattttttaacatgcgtgcatttgaaatggatacttacaaattatcagctaacatgggacatttctttaaaaagcatgttttccaacaattgattgcaaatccagtaaagatataaaatgacctgttggttttgagatattttattcattcatctcttcaatacatctttagtgagtgtctactatttgctcaacactggcatgactctgtattaactttattattgacagctttgatgtggcacattctgctgtaatattgttgcttatactatactaatagtggaaactattgctcactaactataactagtttaaaataaaatctgagattaaaatttagcatttaactttcttaataattgagattattgctgaaatcattatgaatgtttttagtgtagggaactttgccttgtccctcagtgtactagaacagtgcctgacagttaagagtgcaatgtaataactaattcagtaaataagtatgaaaatctaagaaatgcagaatgtcaattagaggaattatgctaatgatgaaaggctacgaaccctggaaaaaattttcatttcaaaaatatacataatattctcgaaatataatttttatttatatttaaaaagatgtgcataatttgtattaaatacatatgaatgtattataaggtaaaaaagatgcatgtctatatttaagtgtgggtggagagaaatacaatctactctatttaaaagtttctaaaatgtacttgtgaaatattaatatttttcacctaaaagagttttttcttttttcttattcaagaaagttttctctttgaaatttaatgtagcgcttaaaaatattcagtgctttgtttaatacgcaaacttagcataattggattttgtgagcctggctcttaaaacactatgtgaaaactttttctctaatacacttagttcaatatgctttatactttttatcaaaactttgtaatgaattttaaaataattttatagctagattattttataggtaacacaaaatattttccaagatgaagttctttgaagcaaagtcattaattttgttatataattgaatttagctcctactttttaatctaagttacttttagaaatataaattagaaagtcatatgaatagatagactccttattgaaagtaaagtagcattatcttgtaattgtacagtaagaccaaacgcaaatgtgacaaaccaggttaatcaaataaatggtcattgaaaattgctattaaatgtgtaagtggtgactaagagaggctgaggtaatgataattatatttccatagttttctgataaagtagatgttttggatggaaaaaatactgaggtgatgtttatttacttattattttattctttcatttaacaaatattgatttaaattgacgctttgccaggcactcttctattactaatactaaatttgtgaacaagccagataacaaaactgctctcagggaacttaaatctgggaggagaaggcagatgttaatacattataactatggtgaaatcaggtggatttaattgtgagaagaaaataagaaagaccagaaaatgatgtggggagacagggccaatttagattgaatagtcaaggaagtctcctttgaactgagatccaatgacaagatgccagccattacaagattgtgagtcctattctctaggcaaaagaaagagccaaatgttccaagggagagagctgatctcggtgtgtctgaaaaatggagagaaggcacattagagtggagcatggagaactggaggaaggaagtggagaagaggctagagcacatgcaaagtacaccacatagggccttgtaggccatggaaagaactggactgaactacaagtatcatgaattgtgaacagcatattggtactatttataattttagaaatttcttttatgtggaacaatagctgttctatactttttatagttacatgaatttggattcctgttggtgaacattcttatttcttaatttgaatactcaataccatcaaaatgcatgtaatttttaattcattgcggtttgtcagaacactagaggcaattaaaatcatttgacatagtattttcctttttatccttttacatgaatgcatttttcagttatttcaaaattcaattgaacaaaatctaaaccatttatttcactatatccttcataaaacatcacactttttaaaacttgtatggatatgtatctctatctgtttgattttatattaatccattgcttctctaaccagaaagaatagtagtgaacaatatcttttcaggttaatgatttaatgtgtcatgaaatttttcatgaagtgtatcatgaaatgtttcatgatgataaaactacttattttctaaaaacattaactttgaattgaatgtggacctcctaaaatatttttttccaaaaagaaagtcttcttccatgaatgatgaagattagtgttggttactgagttcgagattttattttggtgtagtattttttcccttttcttcattttccagacatgaatgtctgccaaacacacactgtatttaaacccctgagaagttcaaaagggattggagacagcaaagggaggtcttttatatttcaatatcctctgtaattaacatttctgtcttagcattaataaaactaagcttttgcctacttttgcttttgattttagtggttgaagccattattatttgtgcaaaaagacaatctagtaacacaagtgtaaattggagggtaatttgaagagataatttgctgttgtgaaaacaagtccaaatatttgttcatgtagttgttggcaaaatggtgatcatagaccaatccaattctcctcagacaccaactggttgttgttgagtgcttggccttcacagtagtcatgtgatcaaactccatcatacatgcttgaaacatctttaaaaatggagagtactcttaatggatgaaatgtggatgctgcctccttacctctacattcctaaaaataatctacattcctaaaaatacacttcaaactggaaaccatcattctcagcaaaccaacacaagaatagaaaaccaaacactgcatattctcactcataagtgggaactgaacaataagaacacatggacacagggaggcgaacatcacacactggagcctgtcatagggtgggggatgggagggagggatagcattaggagaaatacctaatgtagatgattggttgaggggtgcagcaaaccaccatggcacatgtatacctatgtaacaaacctgcacgttctgcacatgtaccccagaacttaaagtataataataaatatgtatatatatatatatactttaatactgattatgctgatcatataatcgcaattacacacatagtgttgatcttatgtgtgtaactatgcccactgattcttgaaaaaatgacaatacatttgtttacataaattgtaaagaatccaattgaaagcaagctcaacatatagagtagtaaaaacatgaagtgtatcttagggacatctctgtaccttccacatagggcaatataataggtcacaatttataaacagccatctaccagtgttagttccttataaacaatgatgcaaactagtgtaggtaatataaactgaaaatatggaaaagaaaaaataatttgtcagtaataacagccctcactttgaactatagcaatactattgatgaatatcagtattattatattttttccaggaggtttctcatttttctagaaagtggtagaccttgagttttttaacaaccaaataaataaatatacaaaatcaaattaaacataagaaatttaagtttatttttttcattgatgtgggtgcacacacattaactgtaaagcagaagtaaattgatagttggttattttactggcaactgtgttttgtttgatcttgacatctgatactcatgaaatttgtagcgtgctgtgaaagactctgacactattaaaaatttgaagctccaaataaacatactggatgcaccattttctgaaagtcatttgtgagattatgtactaaagcaagggtcttaatttcaagtcttaactattcaaactctactaacgtaagttctgaaagaggaattagggtcatagtattaaatcagctggatttggctacaattttacagaatcaattcttaactcagaaaattgtcaaaattcatttatcttatacctcatgtgaaagtagtatggcagttcatagaagtaaaataaaaaatcgtcaaatctgaaatttatctttcaaataaatgtagatacttttttgtgttttatcttaaaaagagttttgtgttttatattaaaaaaagagaaaaatctcaaaatatttatacatatacaaaatatatatacaaatatatattatatgtatatatatttttgagatggagtctcactgtgtcgctcaggctggagcacagtggcacgatcttggctcactgcaacctctgcctcctgggttcaagctatcgtcctgcctcagcctcctgtgtagcctgggattacaggcacgcaccaccatgcccagctaatttttgtaattttagtagagatgggttttcgccatgttggtcaggctggcctcgaactactgacttcgtgatctgcccgcctcggcctcccaaagtgctgggattacaggcgtgacccaccgcacctggataaaatatttgtatattttatatgtaacacttgttttataattatctgtacaattcaataggcttttattctttctgcattctataaaaaggttttctttattggttaaagagatacacatatattaatttcaaaaattgctgaatgaacatgatttacaatattctgaatatttaataggtatgtatatttatcataatcttgaatgacaaattataagatagttatacataaattaatttataaatgtgccaagaattttcttatagtttttgaccatattttataaaaagaaatttttgtaccttttaagctagaggacaattctcttaccccattattttttttctattaaaaaatcacatattattaaagaatcacagttgaatctgtattacagaaaacttgatctgtctcattaatggaaccaagtaactactgtattcagtaagaaaaataataatttaaacagctatatatcataacagttattagaatccccggtaaccaaaatttagtcataaaccaaatttactaatttttgtttttatagtgaaatgttacaatttaaaaaacaaactggaaacactagtgtgtattgaatttgaatttatatttttatagacaatgttttcctataaatatttgtgagattttaaattggtcatgatctgcatatgacttagccttatgatacttctatattaagttacatgtgatttatccattggaaagctaatggaaagcttagatacattgaagagagacactattaacgtgtaaaaatataaaatttgaattttttagtaagtattcaatgagcacctactctggaaaaaaataatgtactggatctttggagaacatggatgtataaaacatcataacctctattcaccagttttcgagtatctcgacctaactctgcccaaggatgaaactcattaattctagagtagctcatgatacgtaagtcaacctgaaacacagaaaaactatctttatatggaaaacttttaaaaagaaaagtgctgcaagataatgttatttgacatttgaagggaagagatacatattccattgttcaaaaatgatgcaaaatctgctccattacatgagtaatattatatgagccatagtctatacaacataaaaatacacaagtggacattcttagtgttctaataacatacatacaattttaacctgaaagatcaaattatatatataattgtcattggcaattaggcataatagaactaaatgttttagaagagattttatttttttggtaaaagatttcaaagtttaaatagaatcaactttcacttaaatccatttaatagtttgtaatattgtcctatcttgagtctcaattatcattgtatttaatcatcttataataagaaggccaaatatgaattaagcaatctcctaagatatctcataaaactgtagcttttttgttgttattgttcttacctgaatacatccaatagtaggcactgattacttggtaaggcaattttttgttccaggaccattctaatcttgagaaatgtcttcctgttttctgtgggccagaaaagtttatcatctttctttagtaacatgttgccatgattttaaagagattaattatctggggccagcccatagttccttcttagtagaagtacagaaatcccgcggggggcgggaactgacttacctacacacttccacataacatacaatgggttttgccattaagatcagctttaggagtaagaatccaccaatttcatggagaattggaaactctccctatccaaattatctaacttgtatgttgacagtggtgtcccggtggtaattgaaggaaaacagttgtaatagtaatagctaaattgtcttgaacactcactaatatcagctttacattcaatgtttccttcaaagtcatacaatttatgtttactaaaattccttaagcaggaatggttgggagaaaggtaaaccatctattcttctcccctaaccttttattacatggcatctacaatatattggattttgattttcttactgttgtttattttcattttatttcagtttcaataaaataaacctaaatacctgaacattggactattattccttttaagggaaatgacctaggaaaagtaaagatagagttttttgacctttttaatttttttttaaattacagcacattacaaggctattaaaagtgttgtaaataatgtaaaatctatttaaaactctaatatggagaaaaattactctaattatatgtgctgcagcatcaaggaagttttttcccccaaagggcttctcatatttcataaacactgatgagttttcccttcaccgaagtaacatcaaaattatatttgtaatttagaagtaagtctccttgtcagtatatttcaaggaatctgaagaaataaaagcactatttttagcatactccaatcaagccagtaaataaagatatggaatatataaatataaagaaatttgtgtatttagaaagtacaattataaaagaggttcctttcaatagaagatgatttattgaattattttctataacattaagaaagtcttgaaatagaaaaaaaaacaaaatgaaatcaaatattaagttctggtgattgattttattgtaggcttttgtgtatgtattcaaaaagtaggaagatgttctgagggaaaaatgtatttcctcatgacaagtggaagttcattcaagtatttaacaaatactggtgagtacctgccaagtacctgattctaagggctgaagatatagcagtgcccagaacagaaaaagataccaaccttcatttagtttatgggataatagagagaagcagatagatgtactaagttgtaaaatatttagtatgtcagactctaaaattctatagagaaaagaaagggaaaaaggccgtaacagcagtaaatacatgagttgtctgtgggccacaaattcatgcgacagcattcaagttgtgagggatacactggaagtcctggcctcttgtggaaattagagtaaacagaggattcattctgcctgtcttgatgcaggtcgtggacagactgggggtgtctgtcctggtgtaagaaatgaccagagtcctgccaggaagaagcagtgttctgggctctatctttactctgctagagcaccacggtatccctaggccgtattgatcattctgtcattttcaggttaacatctcatcaccaaaacatttattttagtgcctactgtgtcaaacgttatgctatatcttgtgcatacaaagaaaattaagacttcataaccgcacatgaaaagcttaattctggcactttaataatacctactgctataacttttgatgtaaattatttaaagataagattttcatgttgtatttattaaagtgtacatttatggcaaagtgtgtttagacagggaatttaacatttattgaggtcctcctcttgtttgggtttgtggtaggtgcttcaggtacattaccttataaaatcaccttaaaacattatcttcagttgggtgtcatgtttcccattttaaaagaagaaaaaaaaagatatgcaagttcataaagcaagcaagtggcaaagcagacaattgaatcttaagtattcatttattctttctgtcaaaataggatgcctgcaaaaaccaccccataaaatagattcattctgtagcttgataatattatcataattacctatacaatatggaaaaatcaattagtttatatgaaaatacattaaatcagaatatattacataatacataaatagatttatgtataaatcagaatatattacataatatattatatattagctctctgggatatcacttgtctagttaaggaccaagagattgagtttctctagcaaagcaaaatgattacgtttcggtaatgattcttagagatttacatcgtcaaagcagttctttccagaagttgcatacttattagagcattcaacactaaattcttctcttatgtactgatgaaagtatccgaagatgagctgtctgaaaccaaaatataaaatgccaagtgccgttaggtcaaacactctgatctgcctcccagttattactgtcatgaagctaccttttattttgtcaaatgaaataaaaatgtgagtttgcctatgctttacaaccaaaaaagcatcatcaaaaccacaagttcttaggacttaatagaagcaaaatgatcaagatgactgtttgtacaaagcattgatctgtttctctgctttatactttgaaggtaatgagtaatttaattacctctcaggtatatagagaaaagtttttctccaaacattttctagggtctgaagtatctgaaattgatcagccagcagccgtgtgatcacactgaaagtatgcaaattttggttttgcctaaaggtcaaaataatagaaaatcacaccaagctattaaaatcttactttatttttttgtgtgtttttctcatcttgccagttttcagaaactcaaggaaaataatctgtcaaggattcttcactatctgatcagcctgaggcaaataacttcatctccctctgcctcagtttcctcatatccacaatctccacaattccatgaaaatcctactcattcaactaatattcatggaatttcccatttctaagcacagagggtctttcttaatccattattttagttgaaatactgaatttaaaattacaaattttgaagacggatcagtttttctttttttttttaagtactggttatgttatttctaaatataatgttaccttaagggcacatggtacaacttcaaagaaaccagaagctcaggctacagtctctgtcagttttcataagaacatatctcaacaatataaaactgaacagaactcaacagttcactcttagagcagaatctgtgtcaatcattctgctctaatgatcagtacttaaagccaagatattttccccaaacactaaaatatggttttcccatgttccagtggttatttggtaatatttccactttaccctgtattacaacttctaatatttctataaataaaatagacttaatagaatattgcagtggaaatgaataaaaagaattcatggaaagagtcggcagagtccactattttggcccttagtaaagtcatgacatgtccaggtttaacctcttatctggaatatgcagaaaatcaaatattttttttacttcatttgggattgatcaggttctgggacactgatctctattatatgtttcataaagaaatgatttaacaatcagatcatgttttattaatatataattaaggcatttcaatcaaccaaaagattcctaatccctgcaggacaaagagggcatggaagttgccttttatgacagactctgtattgctcctccctgtggatatggaatgatttctgcccagaaatggctatcttaattggcattgcactgagtaaatatattacagttactgttttttctagcctccatgcattttttgtgctcccattcacaattttattaacttattgtaaatatttccaaggtgaatggttatctaatataagtgtatgattagtttaattactttatgaaattaaagtatgctatgatttatcatccatttatttacaaaacatctcagggtgagttatttctaaattgctttgcttcgtctgtttccttattttctaggtagaaaaataatttattttttttcttattacatcttcaaattgttttcggtatttataattcctttttgctcttaagattctgattaaattctaactgcaacacaaacaataaatataagcttatgctttatccatagggaaaaaaatccagggacatgtatacccccttctatccagagagaattgttatagaaaccattctaaccagacttatttgctgacatatttttcttatggttaaattttggtcctcttataatctaagcctagatagacagagacatagatatagataaagattttgtcctcattgtcctccatgaaggaaaattacagataatgactaatcaatataatatctacttgttttcttgaacattgccatcaccaaactagtactttaataactaacacctatctcaatataatccatttcacttttggttgttgtaattcattttactgcaatcgaataccatgttattctaacttagtcttcaaagtgtcaagtaccacccacaacaggttgttctttcaatttttaaaaaatgtactctctctttaaataatagtcattcataaagttatcagatattactgatgccctagtaccatctccaatattgtttgaccccttcttcctcctctgttcacatatatccagcttggcattatcagcccccaaccctgttgtttcctgctttattcatgtacatccaagaatcactacatttcatatctagaaataaattagaaattgcttcctcaccattgagtgggccccagaactatttacctactaggttgtaagcttcctaaggaagggcagttgtcatcttacatttgtagcccaaatgcctagcatagtccatgtggcatagtaggtgtttaacagatatttgctaagtaaatggatgagtgaataattggataaacaaaagcatgaacttaaaccctgacctccttgcctagttcttatagttcctttattgcatatccagtgtgtcagttcctaaacattcaatttctgcctactgccttgtactaaacctgggttaacttttttagactctaggactcaaataataaaaaggcttagggatttttctgcccttttaattgatttctcagctcatcttaaatccctagatatttacatccatctggttcagactgcaaacatttatttgttgattcattcaattggtgtatattgattttttaatgtaagttgttgaattttgcatgcaacagggagtaaacacgcaacaagcaaagcccttgccttcatgaaaattgcagtctagacaaatagagtaattagataattattgcaaaaacacgcaaagttacaactctgaaaaattctacagaagagggtaaaatataccgtgttctgagagctcatagtaaggaaacttgaccttatcgaagaatctaggctttcaccagtagtgtacatgtgagctgacaccagaaggacaaactggaaataacctagataatgtgcatgggaaagagaatccaggcaaattattgagagggcagacaagagaatgaaaagtcccctgtatgtggaagttcaggcaatgcagaaaggcatgtgtaagaaaagatcaaagtagacatagccagatcatgcagggccttttagattatggtgagattttgtttaagagtaatggaaggccactgaaaggtgttgaacaagagaggaaaatgatcagatttgatttttaaattatcatccaagcttcagtgttgtaaataggtgaaagtagcactaaggtggatgtagacagattagtttgttgtcaagatgagttttctggcttgtacaactagacggatgtgggtgttattcattgagatagaaaacacactgagtgtgtgggaaggctgtgaatttgattttggacatgaatatgtgtttggaaataaatcctaggagagatgtcttatagaaaattgaatatattggttgagagctcagagaaaataatttgtgtttaggtagtaattcaagctgtggatgtggaagaaagtatacaataaaaaaatggagagcctaagactgaaccttggggtgcgccaacatttcatgtctatgtacacgagaataagcctgcaagctgatagaggaaagactaaaataaggcaaatatgtgagagaagacctggaaagacatggtttaagagtgagagaagatgctgtatcaaaaaaaaaacagtctcctttgagatcacctaaaaactgaaaaatgtctgttagatttagtaatatggaagtctttcgggatcccagcaagggctgtttcaatgcagtcatgggaccagtcaacacaatggtgtggggtgaggagataagtaaagacaactccagcctctctgagactttttggtcatgatgttggtgacaccttgggaaagtgaggagacttaaatgctggggaaacatttgcgattgcctcatttctttcactttattctaaacatggtagtgatggagtcctagaggctccccattgggactacctactttgttaaattactaaatgtgatgaatatttgttgacaatagtacctaaaaatttgtattaatagaatcataaagtcttctacaaggctcaaagtccaacataattgatgacatcgtgtctgacttccaatattcatgacttcccaggtgagtttccatatttctgaaagttttctctgtaacacttggaaaatacaatttagaattgggatatataagaaagataatatcagggatggaatgttaggtgtatctgtcatttgtgatattttacaaagtgaaaatagatttattcatatatttttaccccatcttcttcctttcgtattctttttttcttcttgttctctttaagaaatgaatacctaatgtttattccgtactgtacaaggcactagatgataaatagaaaaaggaaattatgagataatgataaatacactgaaattgctgaaaaagaaaggctatgtcagaatgaataaagataaggttaaagagaatagcattgagaggacaggtatgatagatacttttgaatgcaaggctgagacgtggtggagaataaagcagcattgaaaaaaataacatttaacagagatttcctagcagctctgtgaaggtctaaaaataaagagagtttggttattgtaataatctggatatcaattttaggaagtgtatataaatgaaaatcattatgtaatggaagtagtctgaagactcagtaatcaacaggggcatgcaaaggtaaaggcagtgaatttggaaataacaggaactttttaaaaaagatgctttaaaagggagatgttttaaataagtaaaattataattattggcttattgggcatcatgtgttggtaggacatctaagtgttcatataataagcaggagaaaatgctcacacacttggggttgccctgtaactcacctcaaattatcactgggaatacccacttagtaactagcattttctaagagatgctctacattgataaatacaagtgaaaatgtccattgattgaaaatatgttacacatctattagatttatttacataagactggaaagttatattttacttctaattataagtaaagttatttttaatatattcacttctactggatgttattgagtctattcttagattacctaaatagaacatttcaactttgtcacagaaaatgtacacaataatcttgattttccatttaaaattcttatgaagaaggcttatttttaagaactaaattctaaattttatttctctgttcttcatagatatgttttatttaattattgaatttattttgttttctttcaaaataatttttaagcatattcattttgcatcaatctacactcattgtaaaatctaacattgacttatagctattagttaattttaaactaagcaaaatacactctttttgtcttattaattgtgtatttgagaagatccataaactttgaaaaaattctatttcttcaagaaacaatttttaaacttctatataatgaaatattaaatactttattatagttaaggaactttatatattttttctctagatctcataatgatttaaaatccatacatgcttcaaaaatgctttagtatgctcatttctccaattgtttaactgaaaaatatcctgtaatgaggtcagtgattattttttataaaatgcagaattcctcattcattctttactctgaataagtatttaagtagctttttccagtatgagttgtttgtttatgctttgcttgattgataatcagattctttacaacttttatttgatcttgtaaaatatgtgatttatttaacacaatggtgggtacatgaaatgattaaactaatagtaattacagtctaaccattaaccagtgatatagatggtgaacaaatcaaccttatgtatcactagtcacatacatggggatattggaagggtatcttgctatccaaaatatttattgtgtctctaggagtctcataaaaatttaagtatcttgggaaaaatgggtatgttgtaaagggcattgaattgggtttgccttgagaaaatcagttaatttctttaagtttcagtttcttcatttgtgacatacagataataatttttacctatttcacaatgttattctgactataaattagataatataggtaaatttatcaaaataaaaagatgatattaatgttcaattaattattcttttgatcacctatcaaattaatcactaatcaaaattctgaggatatacatatatatatataaaagtaaattttcaaaggggcattgggaaatgattgtggatcttttacattggagaaatgggtattgcagtgaagataccctggaaactatttctgtgagtgggaaaaagatggcttgtggtgctgataatgaagagtgaggtgcataactgggactagaaacacaatggaaaaattctatttcctggtttgtcctggaatctattctgataacagtctatggcctctgcacagatgttttcatatggattagccaccaagcagtttaatgcattaagcctactataacagcaacaaattataatttgtttgtattgatgcacatgttagatagatagatgatagatatgtgagtatagatagatagagcgatagatgatagataggtagataggtagatcgatagagagacagatgtttccacttaaatgccctcatttacataagtttaaatagacatatgaattacagctcaggctgatttgacttcatttatggttcctataccttttgatgtttgcctaaagatatattcagcttaagtgctatattaggaatatttatttttcttcttataaaatctctgaattcaagaatattattttgttttctatgtatttttatgtattaattcatgtaattaaatatgtacacttgtgagatatgtacacagaatacagagtttgtacatatgcagacaattataatacaaaagtgaagattacaaatgccacattagtcatacagaatgtttggggattccaaagagggtgtgatgacttctcacaggtggtgaaagtgggcatcttagaggaagtgtcttctgagctgtgccttgaaagataactagtaatctctttaaaaagatagactggaactcaactatgagctattgaacgttttaaaatagaaaggtgatgtcatcagagagatgctttaggaagattgaagtagtggcttgaaccaggtggactggaaggcagggaatgactctgcaggtaaaaatgcagtcagatcactattttaataatagatcaaaggttcccaagcactgaaccccctgctacagaagcatctgcagagacttttgaactgcaaatttccaggcccctcctcagggcctaattcagtgggtctaagatatagccccagaagtaatattaaaaacctgcagagtgattttgatgcatagccaaggttaagaaccacaggctgcaatgaaaaagctctggcctcgctgatagactcgaaggagggtgagaagacaagacaatggggtcaaaaaagaaaaaaaatgtagaaatgacacagaagatattttctttcctgttgtccaaatttcaaaatgataatttccactatttgaatttaataaaatacacttgccaaaaagtttgtcttatatatgtatttgtctgtattttatctatagatgtattgaatggttcttttcctgccatttttctcttatttaaaaaacaacaaaatttgtctgaataagcttacaatatttcttttttttctatttattctggctagaattttgaaaatgttttaaaattttatgtccttttacaattacattgatatttaaaatgactctgcttcttaccatggatatttttaagaagaaaaatatcagttgatgagaaagaaaaccactatgcttgagaccattttcagggctttgttatctacttttcatcccaaattctatatatttttattaagattccctaatgcataaggatagaaattgtatttgtaaatgctaacttaaaataccagtatttaattatgttgtgttgatagggatgatttattctagactttaatcggatgtttttgtacctaaatgaaatttagtcttattttaattaaatggtagaacatgccaaaaatgatgggtaaaactagaagaaatgaaccccaacggaagactccggtttcagttatcagttttgtagctgtaaagtagttaagctctgtggttgaacctgccagacaggcattaacattatggtataggattcatctgctgagataagattttctcttatttaactttattgaaatgtctgaataaatcactaagccaaacgtatggtttcttgtttaaaatatattaaaatcatggcataaaacaaaattctcatgtgaagtaaataataaaaataattgtgaatgtatcattcaaaacattttttcaataaaaaatgtttgaggagagctcagatttggttactgaaaccaatattcctttgataacttatttctcttttttgtttcaaagttcagactagttaaattgacttatttctctcttatcctacttttttgtagtcttgcaactaaataaatttagttattacttattgatctgttcgcttgaaccatctgacattttttcctattgtgtacatataaaataagcaaagtatcctttatttataaaggacttggttaattgtacccaatgaaactatcaaaaccttttttaattacttctaaaactctattctctgttcaagtctccgtgtttaatatttaatattgaaaccatagtgtttactgttttgctacctaatttctttttaaagactttattttttagagcacttttagtttcacagacaaaattgagaggcaggtacagagatttcctatgtacccccattctcacagattcatttcttttttaaaaatataaacttgaaaacttttctttttacaatcttaatataaattctcaaagcatttacaattgtccctgtcctttattagaaaattctcgcccaggctggagtgcagtggcatgatgatgactcattgaagccctgacctcaaaagcaatcctaccacttcagccacccaagtacctgggaccacaggcatgcaccaccatgcagagctattttttttatattttgtaggaaataaaagaaagaaagttctttcctatattgagttgaaatgttttcttatatttccaccaatagctcaatcccttgtggctacacagaacaaatcttaccctacacggcagcctttcaagaatttgaagacagttgtatttatcctcctacatcgtctctgctcttggcagtttttcatgagtcatggctttgaattctttatcatcctgtcttctgaatgtatcccaattagtttccatacccaaagttgactgtaggacccagttttagtctgaacatcacagcaaaaggaacaatgagagcacttggacacaagaaggggaacatcacacactggggcctgtggtggggtgaggggagtggagagggatagcattaggaggtgtacctaatgtaaatgacgagttaatgggtgcagcacaccaacatggcacaagtatacatatgtaacaaacctgcacgttgtgcacatgtaccctagaacttaaagtataataaaaaaatttcaaaaaaaaaaaaaggaaaaccaattttgttcttgagaataaatttccgttaacaccccttgctgcccacccacacatccccacaaacctgcctaatgagattagctttg

SEQ ID NO: 296 - DNA, 2230 bp, Homo sapiens
actataagagacactttgtgtaaagataagagggtgtcctcaatgtctgttaaacactggggagcaactgactcaccagatcacagaaaccctagggcagggaaggagggtcaggcagcccacagccacccagcctcaccaactccacatttcggagcaggaggccagtcaccctgagtcagccacggggagacgctgcagctgtaagctgtgcaggcccggaagttcaagcctcagccgcaaacaggggaagccacacacagaaacacaacagcagcccccgcaggtggaggcgtgtgcccctgctcagaggacaacaaccttcccctgcccgcaccagccaacaccgtgccacctctgctgagaacaggactggggcttccagggcaacaggaagggtttggggtggtgatgggaagaacttcccagtcctgaaagtgtggttcctttccccgaagaagccactggagcacctaaggtcactggtactttgaatcccatccagggggcttgaggcagagtcatgatgaagaactgggggacgccagccccagacagccttaaagggagcttttcagggacctctggccagtgggggatgagcctccctggagggagggagggagagaggctttctcaggccacgtgttcccttctctttccagcactctgggggttaagtcagatccgggaaagggaaatcttttcccagcaactccgccccagtgactcaggccagagggagggagacctagggaggggagagggaactagcagcttccccagctcctcaagggtcatgagtcagcagaaaggcagaaggcaccagcctgcatgcaagtgggactccatctaatcccttcttcctatggccaagtccctccttcccatccccactcaacccccatccatcccctccccatgcaaagagccaggccacagacccttgtcccacttggcccacatgttccgggaaatgcctccctctccccattccatcccgaagggaagtctccctcgaccctggcttccgcccatcaggtctgtgccctcccttccctgagggccacttggctcctcctagcccctcagcggcctttagctgaggccccgccccagctcctcctcccagttcaacaagtctccaacagctaaacccattccgtgagctctcactccatcccccaacactccccagtcccagcaggaagcaagccaaggctgccctcccaccctgggttcaccgcattcccacagcctggctggttctgaccagttgtgctgggtttgggggcctccctggggtccccagacaatccttaggaaacaaggccagttctgagtctccacagaccctccccaagcccactggcaatacaggaaagcctccagagccctgaacacccacttccaggaacgagggagcaggcaagaagggatgccggatggaagaaccagccctgcttcctaggcttcccctggcccccagaatgctccaggtcagccctctctgatccctaggagccagggccctcagactccccaccactgggcaccactgctggcaccagctggccccagtaagcccagtcctcagcagttgcgtaaatgaagcaaaacaggagaaacaggaggtgagctctttaggcccagactccagcctggagcagaagggcaggaagctggggtgcctgtggagagacagttgagggggtggcccaacacccctccaactcccccacaatttccgccagaggaggctttaaagtgtgacttcctgtgctggggctgcagagtggggaggcgacgctgagatcggccttgtggtctgaccccgatccagccaccttgcagggacccaattagtcttcctttccccctcattcatgtgtctgttcatttaatgtcaaggtgttgggggaggtcgtggcagcttctcctccaagggcccagttgagatcccatctccctcccgtgaagccaccattgacgatgtctgtttcctccaccccggctccttagacccatagtccctgtgaactcgaagcacgtgaactgaccctatctacttttggctcttatcataatatggttatgttgggtgacagatatgatctccccaaagtgaccacgaaccttataagatgagagatcaaaaaatgtcttggtcagaaagtgtcttatcctcccctggtgtcctctcagctcccagaaccagacctccagactg

SEQ ID NO: 297 - DNA, 2702 bp, Homo sapiens
ggcacatgttttcattttatatatacttaaaatctcctaatgtattattataactattgctatatttggttaaaaatttaggtttatccacgtttgcccttttcattgttctttatgccttcctgcatctttgagcttccatctgggagcggaatacacccttcagtgttgtctttaggttagactatcgatacaaattctctacatgaagtgaaaaatgttttttttctctacttcattattgaggagtaattttactggtagagaattttaggtttatagctatattccttcggcactttgaagataattccattttattctggcttctcttgattctttcaagaagtcagctgtcagtctgatacttgcacctttgatgttaatctgtcttttctctcaggtttcttttaatatgtcttctataacttttatttttagcattttttactatgttgtgcttttctttttccttatcttggtttaagtttggagatctacttgaatctgtgcttttggccaatttttgcaaagtctcagtcattatcttcttgaatatgcctctttcccattctctcttccctctcttctggataccttctatctatctaactttctggacatgcatgaatgggccccggcaacctatctgaccccatcccctgccgtactctcgttactcgcttgtctctatcttgctgtttttctaacatgccaagcatgcttcttactcctagatttttaaaaatattgcttccttagcctggaacactgttttcaagatatgtctaagactcattcccttacatgattcaggtctctgctcaaatgtggccttatcagagaggctttctctgacatttattcaaaattatcatccagacctctcctctcccatattgttctctaactctttacctggttttatgcttcttcatagcacttactacaatatgacacattatatatccaatatttatttgcttattctttgtctctctccatttgaatagaaattctgaagttctgtaagaggagagagctttttcccaccccctcctcacagttgtatcccatcccctggaatagtgcctggattagagtaaatgttcaataaatatttgtaggagaatgaatgaatgattaatagatagaagatataggaagagttctctacaggaagtaaagaaagtggagaaggcagaataacaaactaagtaagtcttttaatttgtatggtctatattttaatctttcgaatgtaaagatagtatcattgatcatatttctgttcatcaatgttacctaaaatagcaaaatgaaatattaatatgtttgaagatatagctttcattagtttaaattaactatctcatttagtttaggcatatggtccacaaatttttaagaacatttaattttaatttaaaaaattaagcctaccaaataagatgcattattttccagtgacttaatatgtatattcaagactttttcaattttttatagtataaaattattgtgattgcacatgaaaatttattatttaagcaaaatattatgagtgcttataagtacaaaggctaaaactgatatccctaccaaccacaaaaaaataggccaggcagctgggtactgcctagcctatttttttgtggttggcagagatatctctttattgtgtagatatttaaggactcatatagacccatcattttttatgggcaaaaatcccaactctggtcttctaaatgtcttttgtaaatttatttccctaaataaatcataaatccacttataatacctagacccacacaatgtgtattcgtcatagctgctcaaaaggaatccacagtgtaggtcagagctacttgatgagagaaagtcttgactctgctaataatgtttttacctcactggcacccacagtattttgccagattgcctgaagtcagcatgccttcctgatggtcatggactgttctgcttttccaggaatgtctcaaagggatcctgcctgaaaggaaagaggccatactgtgatatttcactgcttataaagagaccaagaatggcctctgtcttgttcttttagctagcttcaaacaaacttagccagcttaaaaacagaaatggaactgatgaagtcatcaacctagagcctcccgctactgcccatgtattttgtagtctagaatgaagctaataatctcaagaactgcttcctagaaaggttaaggagaaaagcatgccccatcccacttctcctcccatttcccactcttgaaatagcattgttagcatctgatgtgagccagaggagtatttgaggctgtgccatatgtccttgttagaaacactgagcttataatgactaagaaactccagggggttgtctaaaccaccaaggttataaagggcacagcatcatcacagctgaactaaaatttaatatgattcttactttaccacccatggtgacctaagaaggtggtaagggggacaaactctaaatagagggctcagttgtggctcaccaagaagctaaatatgctgttttcatggtagaatagggaagaagaaactggtaaatatttccaaatgtcatgtgtttacatatgaatctattcacttctttatttttaaaattcttctgagaagtactttagaagtaatccctaaatttaaagtatttataacaa

SEQ ID NO: 298 - DNA, 4032 bp, Homo sapiens
accttgcttcaaactaagactcgaccctggtatattaaatatgacattaaagcgttcgttactttaaatagctacatttgttgatctaatgtgtgtcaggcagaatccaatgtgtttcacagattttctttaattctcctaaattttttccccacacctttgctgtatgaacatgaaatttcgcacaaacatggtactgttctataagaaatggtatggttctataacaaatacattaaaattatgtgctactaccaaaatatgtctcttaatgtcataatcttggtaatagtaagcttacatataagtgattttccaagcacttatatttgttatttctaacaaaattatcaaaagaagagcagagtgtgctttctgttacatatgctagctgatcaatgattttgttatttttaaactgtggatgtttatcacagggatgtgagttggaattagaaaaaaaaactttcaacaacaaagtatatattttatagaatagctgccctctcttacaatcaagtacatcaatgaactagactaccgaggttggtgaaatctcattacaacagtagctgaccaatagctggtcagatatactaacaatcaaatataaatggcaagtcccagccttcaagcttgagtacattctgttctttagatggccacatgagaacagagtaaacagatcagtgctgatctgcaccctgagattcacaggctgcaaacaaaatggagctcccccccaccaagagaatttaggcacctaagttttttaggtccaaatatatggtaccataactgcaatagcaatgccaatttacaaatacgtagcccatttaaaattcatttgctcattcagtcattaaaactaaattgcattatttaaaaactagactcaagaaattaaaatggcatgcccaaggtcacattgtgagtggcacaactaagacatgaactcgtgtcttttaactcttaactgatgttctttttactcttatagagtagaataaggtcccggacctttaagaaacaccaattctggagctccactgtagacttactaaatctaaacctctgaggttgggtcttgtagtaggcagaattctaaggtggcccccccaaattcctataccccagccaacagtgtgcacatcctgcataatccctccctttgagtgtgggcaggacctgtgaatatgatgaaatgtcatgcccatgattaggttacatatgtggcaaaggaagggggttttgcagatgcaattaaggtcttaatttagttgagttgagttgattacttgaaagggagagtatcctgtgtgggactgacttcagcaggtgagagctcttcaaattagggttgggtttcttctgaagctagagaatcttccgctggccttgaagaagcaaatggccaggcagtgagccgtctatgcagatgattacatgttaaagatctgagtgtggcctctaggagaaaagattggtttctagctgacatctaacaagaaaatgtggatctcaattagccacaaggaaattcaattttgccaccaacctgaacgaacttgaaagtgattcttcccaaattaagcctctaaacagcataaactttgacctcatggccaatagcactgtaattcatgcttgagcaaagacatagtttctaaccattttaaccggtcagatcaccaacaaaaagcacaaaactgtgaaatgtgtggcactaaacagacctcaaaaaagacatttgattgcagtatgaaagctgatataaaaaggcagatcactgccttgtttgattttagctgggaatatgtgcctttttaggcaactcaaattttttgctgctctgtttgaccacaaaagctcccaaaatattgatttttagggctacaaataaatcttagcaagtaagcaaatgtgaaaaaaaaatccatgaataatgaaggaccaactgtatattgaaatgttaaccgatgttgcatttatttactatatttcctgaatttttacactgaacatgtatttttttaaaaaaccctgcattttgaaaaaataataaatttctcaattcaaccacagcaaattctgcaccttctgcctaccttatgaatagttttattagctctgtattaaaactgtatgcttacttctgaatcctttaattgactgtcgactgatgtaagacagtacatggcacataagcagtggtaaaacagagatatagacaaatggaacagaacagagccctcaaaattaataccacacatctacaaccatctgatctttgacaaacctgataaaaataggaaatggggaaaggatttcctatttaataaatggtgctgagaaaactggctagccatatgtagaaagctgaaactggatcctttccttacacctatacaaaaattaattcgaaatagattagagacttaaatgttagacctaaaaccataaaaacccttgaagaaaacctaggcaataccattcaggacataggcatgggcaaggaattcatgactaaaacaccaaaagcaatggcaacaaaagacaaaattgacaaatgggatctaattaaactaaagagcttctgcgcaacaaaagaaactaccatcagagtgaacaggcaacctacagaatgggagaaaatttttgcaatctacccatctgacaaagggctaataccaagaatctacaaagaacttaaacaaatttacaagaaaaaaatcaaacaaccgcatcaaaaagtgggcaaaggatatgaacagacacttctcaaaagaagatatttatgcagccaaaagacacatgaaaaaaatgttcatcatcactggccatcagagaaatgcaaatcaaaaccataatgagataccatctcacgccagttagaatggcaatcatcaaaaagtcaggaaacaacaggtgctggagaggatgtggagaaataggaacacttttacactgttggtgggactgtaaacttgttcaatcattgtggaagacagtgtggcgattcctcaaggatctagaactagaaataccatttgacccagccatcccattactgggtatatacccaaaggaatataaatcatgctgctataaagacacatgcacacgtatgtttattgcggcactattcacaatagcaaagacttggaaccaacccaaatgtccatcaatgatagactggattaagaaaatgtggcacacatacactatggaatactatgcagccataaaaaaggatgagttcatgtcctttatagggacatggataaagctaggaaccatcattctcagcaaactatcgcaaggacagaaaaccaaacaccgcatgttctcactcataggtgggaattgaacaatgagaacacttggacacagggtggggaacatcacacaccgaggactgttgtggggtggggggagtggggagggataacattaggaaaaatatctaacataaatgacgagttaatgggtgcagcacaccaacatggcacttgtatacatatgtaacaaacctgcacgttgtgcacatgtaccctagaacttaaaatataataataataataaaaagaggtggtagagaaatgttgaatgaatgggtgaactttatcaaatgttgagtttgctcaaactattcactccacaggacattcttcaacatgacaatagttaaaagtagaactacaaattgtgatgtgagtattctgtaaaacttcacacaaaaaattaccagttatcaccaaatcttctcagggaaggcaggtctcttgcaacggaaatgaacatttttaaaaaatacatatttaggaagtacaaatgcagtgttgttccacagacataaaataaatcttttcaatagggatcagcatgaaaagcatctgcactgctagaaccacgtacatcgaaaatttatcaaccaacatcctaaaatattttcaaagtaactgaatgcctataaaagaaggctctgtaccaatttattgcaacacaaagattatcagatagctagtattt

SEQ ID NO: 299 - DNA, 10239 bp, Homo sapiens
ttatcataatcagtatatcagaagtcgacatacttctactacacctagggactctactcactaagtacaactgtctactctggaccttatatatataacaaacataagacgactctaaaggtggagagaagaaggcagactagctaaagacctcaagatccatgatgacatgctgggttttctttttgcttcttttatcccagatttgcagtggaaaaaaaagttagcaactcagaaatgtagacaaaaacaggcaaggaaacaaaaacaaacaaaataacaacagcaacaataacaaagccctaaaaaaaacatgctctctctagccaatggtctaggaaatggccagcctatgagaataaaaacatttagacactaacagttttacacaagccaaacaccacagaaaaaaaaaaaaaaaacacggtcctactacattcacaccagcacaggccaagtggggagcttaggcctccatcttgtcaagattgtgatgagtcatcccaacaccctaggtggtgtgagagaaagccaagtggggagctgggactttcattcccaccagttggtaaccagcacttccctagtacactgtgtactatcagtgggaccatatgaaaaaccaagactcccaactcctacccatcagtaatgagtcactctttcccctccccactggggtggtttcaaaggaggcagagtggagagttagaactttcaccattgcctggtaataaggttatcttttattggaggccatcctcaacatgatgtcagtgaagaccatgtggagagccaaaattcccactcccacccagcagtaatgagacactcctgtcttcaggagtaaatagaagccaaatgaggaacacaaacttttatctacacctggcagtaacaagggagctccttccccacatatctgctaaaatggtgtcagaaaaggccagttaaaacagaaggtttaaataaaatccagagtctcagaacatatgaaaaagtccagatataagtcaaaaatcactcgtcatatcaagaacctggaagatctcaaactaaatgaaaaaagacaattaatagatgccaacactaagatgacagatgttaaaatcatctgcacagattttaaagcaacaatgataaacaatgtttcaatcatcaattacaaacatacttgaaataaatgaaaacggagaaaaaacaaagaaatagaaaatataaggaaaattcaaataaagtattacaacagaaaaatatggtaacccagacacaaagctcatttggaaaggctcaacagcagaataaatggacagagaaaagaatcagtaaactggaaagcagaatagatgttatctaatctgaacaaaagaaagaaaatagactacataaaataaacagagcctcagaaacctggaaacaatatacttaaaaaaaaaatctgacactaatattcaggtaaagtttccatacttcattcaaactggtaaaatgacaacatcagtagttatgtacatataatacaatatgtagagtaaccaccagaaactacacaaggatatacctcacaaacgctattaataaatcaaaatagaattctaggccgggcgctgtggctcacgcctgtaatcccagcactttgggaggccgaggcgggtggatcacgaggtcaggagatcgagaccatcccggctaaaacggtgaaaccccgtctctactaaaaatacaaaaaaattagccgggcgtagtggcgggtgcctgtagtcccagctacttgggaggctgaggcaggagaatggcgtgaacccgggaggcggagcttgcagtgagccgagatcccgccactgcactccagcctgggcgacagagcgagactccgtctaaaaaaaaaaaagaaaaaagaattctaaaaatgtttgcataatctttaaaggcaggaaaaataaaacaaagaattaaaaaatagaggaggagaaaaaaacagaaaacaaaaataaagtaccaaacttaagccctaacatattaataattacattaaatataaataatgtaaatataacattaaaagacagagattgacagatgaaatttaaaagcataacaaaattacatgctgtctacaagaaactctcttcaacgaaatagggaagttgaaagtaaaagaatgcaatatatacataatgcacatatcattcaaagaaaatcataagtggctatactaatgttagataatgtagacttcagagcaaaaacatatatatattaacagaaagagatattatataattataaaatagtcaatacaggaagaagacacagcaatcttaaatacatatgcaccagacaacagagacgcaaaacatatgatacaaaaactgataaaattgaaagaagaaacaaacaaatccacaattacagttggagtctttaacatgacctttggaagaactaaacagctagacaaaaaattagcaagaatatagacgaactcaacaccatcaatctacaagatccagtcaatatttataaaatattctactgaagaataggaaactatatacagtttcaagagcccacagaacatataccaagagagaatatatcctcatctatgaaaaaaaaacaaaattaaaataactgaaatcagactaagtatgttctctgactataacagaatcaatctaaaaataacaggaatgtccccacttagaaagtaaacaatacattttaaataatccatgagtcaaagaggaagtctcataggaagtcaaaatacattcaaatgaataaaaatacaacatatcaaaatttgtgggacacagttaaagcagtacaaaaagagtaatttacagcatgcaatacatacattagaaaaaagaaaaatctcgaatcaataagctaagcccctacctgaagaaactatgaaaactagagcaaagtaaacccaaactaagtagaaagaagtaaataagtaaataataaagagctaaaatcaataaatcaaaaaagaaaaaatcaatagagaaaaccaataaaacaaagagctaggtctttgaaaagatcaataaaactgaaaaaatatctagcaagactgacaaagaagaaaggaggcatgagttgtcaatatcagaaatgaaatagattcattcaagatcctaaagataacaaaagaataatgatagaatgcaatgaaaaattccatcaatataaatttaacaacttagacaaaataaactacttccccaaaaaacataaactaccacaactcatctaacatgaaatagataatttaaacatccttgtaaccaataaggtaattaaatgtacaacttaaaaaatcccaaaaaaggaatgtccaggcccagatgggttcaatggagaattctaccaaatggttgaagaagaattaacatcaactctatacaatttcttccagaaaacagaagaagaaaaacttaccaattaatttacgaagctaaaattacactaatccccaaactagacaaagacaaagggagggaaggaagaagggagggtgatgaaagaaagagaaggaaaattacacatcaacattcctcataaatattcatgcaaaaaatcattaacaaaatattgcaaacaaaattcaaaaacatagcaataatataatgatataaaaagaatcatacaacatggcctaatggggtttatttcagggaagcaaggctagttcaactttcaagaatcaatcaatgtaagctaaaacattaacaggatttatttaaaatcacatatcaaatgatgcagaaaatacgtatcaaatgatgcagaaaaaatcatttgacagaattcaatattcatttgtaataaaaaatgctcagaaaaataggagtagaagggaacttcctcaacttgacaaaaagcatcttcaaaaaacctatagataacattatatttaagtggtaaaagactcaagactttcaccctgaaattgggagcaaagcagagatgtctactctcagcacttttactcaatatagattgaactcagctctgtaccaagcggacctaatagacatttacagaacactccaccccaaatcaacagaatatgcattcttctcagcaccacaccacacctactccaaaactgaccacacagttggaagtaaagctctcatcagcaaatgtaaaagaacagaaattataacaaactgtctctcagaccacagtgcaatcaaactagaactcaggattaagaaactcactcaaaagcgctcaactacatggaaactgaacaacctgctcctgaatgactactgggtacgtaacgaaatgaaggcagaaataaagatgttctttgaaaccaacgagaaaaaagacacaacataccagaatctctgggacacactcaaagcagtgtgtagagggaaatttatagcactaaatgcccacaagagaaagcaggaaagatccaaaattgacaccctaacatcacaattaaaagatctagaaaagcaagagcaaacacattcaaaatctagcagaaggcaagaaataactaaaatcagagcagaactgaaggaaatagagacacaaaaaacccttcaaaaaatcaatgaatccaggagctggttttttgaaaggatcaacaaaattgatagaccactagcaagactaataaagaaaaaaagtgagaagaatcaaatagacgcaataaaaaatgataaaggggatatcaccaccgatcccaccgaaatacaaactaccatcagagaatactacaaacacctctatgcaaataaactagaaaacctagaagaaatggataaattcttcgacacatacaccctcccaagactaaaccaggaagaagttgaatctctgaatagacaaataacaagatctgaaattgtggcaataatcaatagcttaccaaccaaaaagagtccaggaccagatggtttcacagccaaattctaccagaggtacaaggaggaactggtaccattctttctgaaactattccaatcaacagaaaaagagggaatcttctctaactcattttatgaggccagcttcattctgataccaaagctgggcagagacacaactaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacagagtgttggaagttctggccagggcaattaggcaggagaaggaaataaagggtattcaattaggaaaagaggaagtcaaattgtccctgtttgcagttgacatgattctatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatcctacttacaagggacgtgaaggacctcctcaaggagaactacaaaccactgctcaacgaaataaaagaggatacaaacaaatggaagaacattccatgctcatggctaggaagaatcaatatcctgagaatggccatactgcccagggtaatttatagattcaatgccatacccatcaagctaccaatgactttcttcacagaattggaaaaaactactttaaagttcatagggaaccaaaaaagagcccgcattgccaagtcaatcctaagccaaaagaacaaagctggaggcatcacactacctgacttcaaactatactacaaggctacagtcaccaaaacagcatggtactggtaccaaaacagagatatagaacaatggaacagaaaagagccctcagaaataatgccacatatctacaactatctgatctttgacaaacctgacaaaaacaagcaatggggaaaggattccctatttaataaatggtgctgggaaaactggctagccatatgtagaaagctgaaactggatcctttccttacaccttatataaaagttaactcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattaacaaatgggatctcattaaactaaagagcttctgcacagcaaaagaaactaccatcagagtgaacaggcagcctgcaaaatgggagaaaattttcgcaacctactcatctgacaaagggctaatatccagaatctacaatgaactcaaacaaatttacaagaaacaaacaaacaaccccatcaaagagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggaacacttttacactgttggtgggactgtaaacgagttcaaccattgtggaagtcagtgtggcgattcctcagggatctagaactagaaatatcatttgacccagccatcccattactgggtatatacccaaaggactataaatcatgctgctataaagacacatgcacacgtatgtttattgtggcactattcacaatagcaaagacttggaaccaacccaaacgtccaacaatgatagactagattaagaaaacgtggcacatatacaccatggaatactatgcagccataaaaaaggatgagttcatgtcctttgtagggacatggatgaaattggaaatcatccttctcagtaaactatcgcaaggacaaaaaaccaaacaccacatgttctcaatcatagatgggaattgaacaatgagaacacatggacacaggaaggggaacataacactctggggactgttgtggggtcgggggacgggggagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaataaaaaataaaaaaagagaaacaagaggaaataaaaggcatgtatactggaaaaaaaaaaaactacccctatttccagatgatatgatagtctacatagaaaatctcaaggaactcattaaaaagctcatagaaacaataagtgaatttagcaaggtagcatggtacaaaataaacctgcaaaaataaattgtattttaatatcaataatgaatatatgggaagaatttaaaatgcagtactatttacaaccatgaaaacatacttaaatataggtgaaactctaacaaaaacatgtataaaacctgtatgctgaaacttacacaatattggtgaaagaaatcaaagacctaaataaagggaaagacatactgtcatgataaattgaaacactcaagatagtaaagatttcagtttttcccaaacttgtgaacaagcttgatgaaattcctatcaaaactcaagcaatatttttcatagatatagacaagattattttcaaattgatacagaaaggtggaagaactagaagagttaagacaattttgaaaaataataaagcaggaataatcagtatacctaatttcaagacttttacagctacaggaatccagattgtgtcatattggtgaagggataaatacatagcccaatggaacaaagtaaagaatccagaaacatatccacaccaatatgcccaacttacttctgacaaagttgcaaaggcaattcaataaaagaaagagagcttttcagcaaatggtgctagagcaattgactctccatagacaaaagaatagccttggacctaaattttatatctgaagcaaaaatcaaatcaaaattgaccacagatttaaatgtaagtcataaaatcataagacttttagaaaaaaacataggagaaaaatcttcaggatctagagctaggcaaagagttcttatgacatgaaccataaaaactgattaattggactccatcaaaattaaaaattttctctgcaaaaggccacattaagaagatgaaaagacaagtcaaaaagtggtagaaaatatttgcaaatgacatatctgacaaaggaaaattttctagaatagattagctcaaaatgtaaatttaaaaaattcaattagaaaatgaaaaagccatgaacagacatttcacatatttagagaatacataaatggaaaataagcacatgaaaagataattaaccattatgaaaatccaaattaaaagaacagtgagctatgactacacactatcataaaggcaaaaacatagtgacatcaccaaatgctggtaagaatgtgaagaaactggaacattcatacgttgctggtgggaatgtaaaatgttacaaccactctgcattaacagttcgtcaactttttaaaaaactaatcactcaattatcatacaatccagaaatttcactctagggcatttttaccagaaaaactaagggttatgttcatttaaaaaaaaacctgtacacaaagtttatagcacctttggtcacaacagccaaaaattggaaacaacctgatgtctttcaatggacgaattattaaataaagtatgatacatccattccttggaatagtacacatcaataaaaaaaatgaacaaactattgatgcatacaacaacctgagtgaatctccagaaaattatgcagagcaaaaaaaaaagtcaagtcctaaaaggttacatactatatagtaccatttacatactgttctggaaatgacaaaaatggaaatgaagaacagattcacagttttcagagcttaaggaagaagtggggtgggagaaaagtggtcatggctataaaagggcaatatgagaaagccttttagtcatgtaacacatctgtatattaactgtatcaatgtcaatattctattggtaatatcatactgtagttgaggatgttattgagggaaacagaaaagagtacactgaatctatcatttcttataactgcaacagaatctataactatctcaaaaaggtttaatttaaaaaaaatgtagatcatgatttagtaagtaaagcctgagattctgtatttctaacaagtcttcagataatacagattccactgctgtggggaccacaatgtaagtaataagtcattggaaaattggtcactgtaactcatcatactaacaggctaaaaataaaaaaacccatgaccatctcaatagatgctagaaaggcatttaacaagatttaacatctataaaagagaataactatcagcaaactaaaattagaaggccagttccccaacctgaaagtgtgctaatgaaaaacttacagctaacgtcctatcaaccattattgactgaatgcaattttcctaagattaggattaagacagagatttctactctcatcttttttttcaacatttcatttctagagatcctaaccaatgtaatgaggcaagaaaaaaaaggcgtacatattggaagggaagaaataaaactctctttcccagaaaatatgacagtttatgtagaaaattatgagagctaccaaaaacctactaaaactacaaagccacaggatgcaagggaatatacaaattgtacttccaaaattggtgaatttcattttgtctaagttataccccaataaatctgattttaaaagctctatagctaaa

SEQ ID NO: 300 - DNA, 3350 bp, Homo sapiens
cccgcaatgcttttgcagtctgcataggatgttagaataacagcatgcagatgaccgcgccatgtcttatcaggaaagcgtactgatgtggaggccaagaagctgctggctgagatttcagaactgggtttctaacctgccgtgggccttggacagcggctgccattcttctgtgcctccctttctccatttcacgaggccccgctatccctctacctccccaggaggtcccagcacaggcactgctcaggaagcaccaccgtgaggtgcgaagggtgtgaaggtacgaaagacaggagggcaccacaggctggcggcaccactcccctcgcaggccagccagaagccaggcagcagtgtggaggctcatcctgcctctctggctggtgcccgaccccagctcttgagccccccaagtcaccgcaacgcccaggccttgtgtttttgccgaagctcgtgcctcagagcctggctccgacgctttcctcctagaagcctcccctgatgcgtcccaggaaccctggcctctccccttgtcctcaccccatgcatcgagcgctccctggactccacccctgcgtgggtctcattcctctttgtgtcctgagggcttggctctaggccgcccagtagaggccggctggatgaatgctgatgggacggtctcatctctgtccacaaaacccctcccccacagccataccctcactgccatgtgactgtgttgacagaagtctgctggcctcagaggtctgcggcccaggaaatctcagctgccatcagtgataaacatgacctccctgtgggcgtcacctccacccctgtgctggatgggccttctcatcgatttcagtgatcatgaagttaatcagcagtcagcactcaaacacgtgcagaatcaatgacaactgaaatgattagaatccgcataaggagggcattctcatgaggtatctggggcttttgaatgttcttggatgaaaccagaaatgaaaggctgctaaaatgaaagcctgaaagccttctagctttttttttttggtatatatatatatatatattttaagtggagacgggatttcaccgtgttagccaggatggttttgatctcctgacctcgtgatccgcccacttcggactcccaaagtgctgggattacaggcgtgagccaccgtgcccggccaagccttctagctttcaagacagaaagggggaacctgaagatgatggtgtgtgtgtgtgtgcacacgcgcgtctgtgtgtgtggtgggggttagagggagggtggtcttggggaagtgagctttggcaggtgcggcctgtggaggcagccggggactggatgactgggaatctctcccgtggaggggacagcctgaagctcgcgggtgtgagctgagaataccagctcaggtgggaagggtggtggtggtgtccacatgggccagctgcgctggtggaggctgcagggcaccaggtcaccccctgcaggcagccccagctcagcccaaccctccaggtcagggccctcggggacagtggtgtgcttaaagctctgctgcccgaggaagtgggaagccggtaagaggcgtgcaccgtgcgctggcagtctcccgacactgacagaatgtcatgatccagccaacgaagaggtttaagaatgaagccaggtcacctttccactccccagtgctaagtaaggaggaatctgtcattactgagtacactgatacttacaaccaggcttcttccatttatccaattccctgcagtaagaatggcggcgacagtactttcttcaccaagctttatccacacgataaatacgctgacaatgacacgttttcattttctaacactgaagactatccagggttggccaaagtgtcagtgctctcacttacaatgccagagctgtgatttttgggggcaagattcttttaccttaaaaggcattatccaacctcaataaagcagcaggctaggcgaacatcaacagctactaacatcacaaaaagagatggacgtccacacgtgcctcctcactggtgaaatgctccagcaaaacacaacagtcaaacaagcaaaacagcaacagactctgagcagggcctgaggtctaactaccaatttacagaaatacaggagacacgggggaacgcagaaaggacaccaacagcaaaatccagatgggggacaccctccaggacaaatgactggttcttctacaaagagactgctaaggacaagaggcagaggggggacctgtagctagaaaaggcctcacgagccctatccaccaattataatgtatggagctgatttggatccagattcaaacaactacactgtaaaccatttttctttttttatgagacagggtctctgtcatccaggctggcatgcagtggtatgatcacagttcacagcagcctcgaacttctgggttcaggctatcctcccaccacagcctcctgaacagctgggactacagacatgtgccaccgtacctggctaattttttatattttttgtctacatagggttttgctatgttgccagtttggtctaaaactcctgggctcaagtgatcctcctgccttggcctcccaaagtgttggaattacacagacatgagccattgcacctggcttcaaagacattttgaatgaagtttcaaaagctagcattcctaaaccaaatcatgccaatgcagtctacaatgaggcaggtctacgttcccagactcctcaaggctcacgcgtaggtctggggcaggcacatcttagaagcacatccgtttcatatcatcaagacactccacacctgggcaccactcacagctgaactaaggccccggacacaaggtataggggcctggctccttcgccccaaagcaagacagctcctggagcgaggggtgcagacaccaccacccagcctcctccccttcacccacaggtctcacaccagggcgcactaacctcagccaacccagcccgggagtgatgtccagccgcgctgctccccaccacgccatcacctcaccttgtgttattctctgcatggcttctagtgtcagtgtttttgtttattttttattgtctgcttcctatcactagaacagaagttctgaagaggcaggcagagtccggccttgttctcctctagctggagagcccacaccagggcctctgtgcggtggcgggaatggatgaactggttccgggagcccaggacctccatgctgggcccccagaggcacgttagggttatctttcagggttatcgttaaccctaaacgccgtgcctagaaggtttagggttaaagataacatccacagtgcctg

SEQ ID NO: 301 - DNA, 1802 bp, Homo sapiens
ccccatattggcatacttaactctttttagtggtataatatacaaaagtttaccaagggtaacattagtacattcacaatattgtgcaaccatcaccactacccagttcacaatcatcttcgttaccttaagagatgccgttaggcggggcatggtggctcacgcttgtaatcccagcactttgggaggccgaggcgggtggatcacgaggtcaggagatcgagaccacggtgaaaacccgtctctactaaaaatacaaaaaaaattagccgggcgcggtggcgggcgcctgtggtcccagctactcagaaggctgaggcaggagaatggcgtgaacctgggaggcggagcttgcagtgagccgagattgcgccactgcactccagcctgggccacagagcaagactccgtcttaaaaaaaaaaaaaaaaaaagacatgccgttaagcagccattccccattcccctttctcgcatgaagcctcaaaatctgccttctcccttgaagcctcaaaatctgctttctatgtggatttgctgatgctgggcatttcatataaacaaaatcatacaataaatagcctttttatctggcttctttgacgtggcacataaccaaggttcacccgtattgcagcatatagcggtacttcattctttttcgtgggtaaataatattccattttgtttttccacttatcagcaggtggacatctgggctgcctccaccttttggctattgtgagttgtgctgctctgaacatttgtggtcaagactatgtgtgggtcaggtgtggtggctcatgcctttaatcccagcactttgggaggctgaggtgggcggatcacctgaggtcaggagtgtgagaccagcctgaccaacatggagaaacaccgtctctactaaaaatacaaaattagctgagtgtggtagcgcatgcctataattccagctacttgggaggctgaggcaggagaatcgcttgaacccaggaggcagaggttgaggtgaggtgagactgtaccattgcactccagcctggccaacagagcaagactctgtctttaaaaaaaaaaaaaaaaaaagactttgtgtgggcatatgtttcatttcccttgggttggtgtctagaatggaatccttggtcatacggtaattctatgcttgagttttaaggaactggcagacagctccaatgtggctgctccattttacatgcccaccagcaatggtcaagggttccaatttctctgcatctttgccaacacttgttattgtctgactttttaattgtggccactctattgggtgtgctgtagctatcttgtggtttggatttgtgtttccctaatggctaatgatgttgcgcatcttttcatgtgcttgttggcactcttacttttaacagttttgttaagtcactcggaagaggaaagagtacatagggaagtgcatttactcccaagttgctaaagaccaaaaaacttctagaaccccacctgcactaacgaagactctaaccccccaccagaactgtctaccctccaccgtggcaccatggtgtgcccgggaatgcggctggcgtggccaggcctcactcgcttcatgattctagccgcatccatctttgagtatccctctcttcagcctgtcacgggagctacgccctttgctgctacctgtgcgtgtgaccgcagcagctctttcttggcatgctctcaaccccactccccaatttgggtgtcataacctagtgttttcgttcctgacccttcactgcaggcccagcatggtgctgtgaa

SEQ ID NO: 302 - DNA, 4697 bp, Homo sapiens
ccaaaataaggatttgaaagatttagatcatgatctgtaatcaaactttaaacactggtgaatagtacatccgttccttcttttgtattctgggtttttgccttcactccatgaaaggtatcacaaactagtagtcggctaactacacatgccttggcctacagatgtgtcttctttgactttcagtgttaaaaatacttagattcaattagatgccaatgtttcacataaaagtctcaatttcagtttcacttgaagaatggaaaatcctcccagcaccatgcccacattcctgcagggagacagttcaccagggcagagatgcagctgctccctttagacagggcatgtggtctcagatttaccaccaacccaagctgccctgcttcacctgctgacattccctgcgcgtctgtaggcattggagtttgctaccattgctagagcttcttggtccatttataatcactaaaaggtaaagtttcactcttaattcagtcaggagctttttcctcaactattaatagattctctttctcttttctccttgatatctccatgatatcacataaaattttagaattagaagggaccttagaaattatttcatcttgaaactaggtcttaaatatatatatatggtttttcttattattgtggtaaaatatataacaaaatttaccatttaccactttttaatttgagaaatcttttttatggcaataaaacctatataacaaaacttaccactttaaccatttttaagtgtacagttccgtggcattaagtacattcacagtgttgtgcaaccattattaccctccatctccaaaactctttatcttgcaaaaccgaaactcagtagccattaaacaatgactcccatttctctcctcctccagtccctagaaaccaccattctactttctgtatctatgtatttgactattctagatacatcagataagtgtgtacaatatctgtccttttgtgtctcacttatgtaacttagcatgatgttttcaaagtgcatccatgttgtaatatgtatctgaatttcattcctttttatggctgaataatattccattgtgtgtatataccacattttgtttattcattcacctgttgatggccacttgggttgtttctacattttcgctgttgtaagtaatgctgctatgaatgtaagtgtacaaatatctttctagtccctgctttccattactttgggcacataactagaagtgggattactgtaccatacagtaattttatgtttaattttttgaggaactgctgtaaagttttctacagcaggtgtatcattttacattctcaccagcaatgcataagggttccagtttctccacatccccaataatgcttgttgctattttctatttttctgataatagccatcctaaagaatgtgaagtggtatctcatggttttgatttgcatttccttaatgacaaatgatgttgagtgtcttttaatatgcttattagccattttatatcttctctagaggagtatctattcaagccctttgccctttttgaatcaggctgttttgtcgttgagttgtaggagttcttcatgtattctggatattcattccttatcaggtatatgatttgcaaattttttttctgttctgtaggtcatcttttcactttttttttatcatatcctctgatgtacaaaagttcttaatttcaatgaagtccaatttatctgtttttcttttgtcctctgtgtttttggtgttatatctaggaaatcatttacaaatccagtgtcatggagatttcccctatgttttcttctaagaaatttctagttttagctcataaatttaggtatttgatcaattttgagttaatttttatgtaaggtattaggtaagggtccaacttcattcttttgcacgtgcatattcagttttcccaacaccatttattgaaaagactgtcctttctccccttgaatggtaccctttgcacccttgtcaaaagtcaaatgaccatatatatgaggatttttgtttctgggatttacattctcttttgttggtttgcctgtccttatgattactgtggctttgtaataagttggggtttttttgttttgtttgtttgtttgtttggtttgtttgttttgagatagagtctcactctgttgcccaggctggagtgcagtggcacgatctcagctcaccgcaacctccacctcctgggttcaagcgattctcctgcttcagcctcctgtgtagctgggattacaggcacatgctaccacacccgctaatttttgtatttttagtagagacggggtttcatcattttggtcaggctagtcttgaactcctgaccttgtgatccacctgcttcggcctcccaaagtgctgggatgataggcttcagccaccacacccagccttgtaataagttttaaaatcaagaaatgtgagtcatccaactttgttcttcttcaaggttgttttgggtattcttggtccttttaaagatattttatgaatggttttttctattaaaaaataccattggaataccattggaattttgataggattgcagtgaatctatagatcactttcggtggtagtatcaccttgacaatattaagtcatttaatctatgaacataggatgtgtttccatttatttaggtcatcttcagtttctttcagcaattttttttttaagagaaagtgtcttgctctgttgccctggctggagtgcagtggcacaatcatagctaattgtagccttgaactcctgggctcaagcaatcctcccacctctgccatcaagcccagctaattttttatttcttttagagatgaggtctcactctgttgcccagactggtctcaaactcctggcctcaagcaatcttcctgcctctgccttccaaagcagaggggttgcaggcatgagctaccacgcccagcctctttcagcgatgttttgtagttttcaagtatacaagtctgtcacctccttggttaaatttattcctaagtattttattcttttcatgctattgtaaatggaattgtttttcttagtttccttttcatatttttcattgttaatttataaaaatataattgattattattattattatttttttgagacaaagtctcactctgtcgcccaggctagagtgtagtggcgtgatctcggttcactgcaacctccgccacccgggttcgagcaattcacctgcttcagcctcccaaatagctgagattacagggacatgccaccaccccagcatgtaattgatttttgtatcttgattttgtatgctgcatctttgctgaattcatttattaggtctaacagttgtgtgtgtgtgtgtgtgtgtgtgtaaaatctttagggctttctgcatataagatcatatcatctgtgaacagaggttattttatttctttctttctaatttggatgccttgtgggttttttttttttttttttttttttgtttgtttgttttttccttaattgctctggctagaacttcctgtactatgatgaatagaagtagtgaaagcaggcatctttgtctttttcctgatcttaggggaaaagtttttcagtacagcaggtcctcaaataacataattgcattataacattgatgaggaaaaaaaaaattgattcccagctggggccactgtgtgaaatttgcacattctccccatgtctgcatggattttctctgggtactccagttttctaccacagatgtatgtgttgggttcattggtgtgactaaatggtcccagtgtgagtgaatgttggtgtgtgtgtgtgctccccgagatggaatgagatgtcctgtacagggctatccaccttgtgtcccaggcttccaggataggctctggccacctgcaaccctaagctagaataagcaggttggaaaatgaatgaatacaaattattattgaatacaaattattatcaaatacaaatttataaagtagatgataatcatacaactgcacaacaataagcgatgaggtatgaaagcgttcagctagcccaccatatttgtgattgttttttaattcatggtcggaggaggtgctccttaaatttttctatttgcaaatatctattcccttatttaatccaccaccactacaactgtcgtcattcagcgattcaccaaaaattgggtaatcttacttgttgttattaacctttcttaaatgtatgtatagcccacatttatttcaatgtttaatattagaggtgtgtagggtctttatttagaagttgggtgattatttgtgaccagaaacatgccataggaacttaactcttgtttatgtcgattagcctatgatgaaattggttttattataccttgtttcacttaaagtcagtttccaagaacctattgatgaggttgaggacttttatttggttttaaggtaaaagtgtgccaaaaaattgagattcatacagataagtagcttcaaatactaatagatttgtttttaacattttgactgatctttttttagctttactaatgttcagaaagggagtaatagtaaatttgtgtttcaaagctgagttgctcacattcctaattaatgagtaatcactctggagaaatcaacaaattttctcagctagtttaaaaatt

SEQ ID NO: 303 - DNA, 781 bp, Homo sapiens
ctatttaattaaatgtggattctcactctcttgaccccagggattctgattttgcttctgtgggtttagggtacaggtgattcatgatcatatgttgagatgcattgagatatactacattgcttttagggtttcacatctgtatagggaggcatagggataaaattcattgaacgtttttttaactgtgtactgtgtgccagtccccttgatatgtataagcaagtgagatggagtccctaccctcaagacttggtctaatgggaccttggaaccctgccttgactctgtcagactacctcacttgagcaagccacttactctttaagccttagtttctctatctgtaaaatggagatagtcaattacttacttcagagcaaaaggcctgatctatgatcctgtgattcccaaggctcttttaagttgtgaagtcacagggtggactaacttccaatgctgagaacaatgatggggtggtgatgggtcagatagacaaataaatcaataattcaaccaccaataaatagtggaatatgtaaaagcatgcgctttggaatctggcagatccatgattcaaagctcgaatgtgcttgcctcttgctagttacgtaactgggcaaattacttcactgccctgtgtctgcaagtaaaatgaggacagtacttaccctataggactgctgcgagacattcaatgagagtaatgatgcacagcactcagtacagcagcttaaaaacaggtaacaccatgaagcactacagaagcagtgatcaataa

SEQ ID NO: 304 - DNA, 2846 bp, Homo sapiens
accacatttttttcaaaagtgcctttgttcaaatactcatttagtgctgacactactccatggaatgtgggaggaaaatgcactctctagcactgagagatttaaaacagaaagtgtggttggctgggcatggtggctcacgcctgtaatccccgcactttgggaggctgaggtgggcggatcacttgaggtcaggagtttgagaccagcctggctaacatggtgaaacccgcatctctactaaaaatacaaaaattagctgggtgttgtggtgggtgcctgtaatcccagctactcgggaggctgaggcaggggaatcctttgaacccgggaggtggagtttgcagtgagccaagatcgcgccattacactccagcctgggcaacaagagccaaactccaaaaaaaaaaaaagaagaaggaaggaaggagttgttttaaaaaaaaaaaaacttcactgctaacctttaaataatacattaatcagaacaaaatgttacgaaaattaaaatgctgagtgcggtagagagtatagcacagttacaggtatatggatctgtctccttagtgtaattcaagaggtcgtaaacacagcacttagtgtttcaccatcacttctgtttggccccaaattcctaccattataattattttagacttaaaaatccataaagatgctgctccagtgtgtaacgtaagagaggaaatgtgatggtgtatctggggctttccatttaccacattaacaaatgatatcaagcaggacaggtatctcccacttaagcagtaatctgcttcagaaaaacctgatgttctgagtgaaaattctgatagcctattatttattaagtggaagaaaatagagcgtttttatatcaacctaaacccctcacaaccagcttttaaccacctaaagaaaacagtaaaatagacactcaccaaatgccaaggtgcgtggacaaatgttataaaccatatattaaggtgtaaagggctacaagcatcacttcctgctcatacaatgaataagatgttaacatacagtgtcgtaggccctacttggcctttcgctgtcagcagaaaacatgcacatctccttagttggcacctgcactacatttcaaggcatctccacatgattctgatgttctactaactgtaatgtaaatcacatgttattttgttaaaaacattgagattggaagatgtaaatgtaagtaggtgccttataagcatcagcaaaaagcaaaacaagaaacaaaaacatcttagtgagagctcagtctagcctgtggagattggatttcaaaaatcaggaggcaatccactgggcaaccattcactggaaaaatattcttcaggttatgtctgaattttattcggtagctaaactagctaaactacactctaggtaggtgttacaagctgtagggcaagcaaaataaatgacgttgctgactttaaaagacttgaaaataatggtactatgagagcccagtagagcattaatatggcttttttagttataataagtacatgccaactggacagactgctttgatttaactggacaaatgacagacaaataaattttggctaagattattgagatgccatggagctgagaaacatgatgcagccacctaaaagttagataacataaacacaagaattccagaccaaatctctcactctatgtaagatttggtgaagtcatttaatctttcttagtttcagctatgtactgtaaagattagatgagttaatgttgtaagcttttaaacaaatgacaggacacacaagggaacaccaagtatttttgtagatacagcaggtcctcgaataatgtcattttgttcgatattgttttgttataacgctgatgagaaaaaatgaaaatcaattcccggccagagcactgtctgtgtggagtttgcatgttctccccatgtctggataggtttcctctgggcactccagcttcctccagcatcccaaagatatgtacattaggtaaactggcatgtctcaattgccccatgacaagtaggtgtgggtatgggcatgagtgcactcagtgatgtgatgatgtcctgtccagggtaggttcccatcttgcaccctaagcttctgggagaggttccggtcacccaacactctgaactgggataattaggtaaataattatcttacttgttcatattaatctttcttaaatgtacgtatagctcacatttatttcagtgtttaataacagaagtttttggtgtttacgtaaaagcttagtgatatttttgtgaccaagaatatgccatagacacttcacatttgcttatatcaattagtcagtgggaaaattggtttgttatatggcgtgtcatttaaagtcacagtttccaaaaacccatcaatgatgttaagtgagaacttactgtatacacagctgggtttgaattctttgccagctgtgtaagcttgggcaaattattgaacttctccaggctttcattctcccatgtgcacagtgaaaacaactatatgtactttgcagaacagaaatagtgttagaaatatatggaaagtgcctagcaaagcatctggaccatagcagacagtcagtaaatgctactgattaatttgccccttactagtaaaactccgaaaactttcactcttctccatctaagtaaccagctcattgactcatgcctctaccttgtttttacccagaacacttaacttcttaaatttctgtcccttaccacaacttcttgtttctccactgttccttacaaacttacactttatccacataaaaatgtctactacttacttgaactcttattt

SEQ ID NO: 305 - DNA, 1740 bp, Homo sapiens
cctgcactacatttcaaggcatctccacatgattctgatgttctactaactgtaatgtaaatcacatgttattttgttaaaaacattgagattggaagatgtaaatgtaagtaggtgccttataagcatcagcaaaaagcaaaacaagaaacaaaaacatcttagtgagagctcagtctagcctgtggagattggatttcaaaaatcaggaggcaatccactgggcaaccattcactggaaaaatattcttcaggttatgtctgaattttattcggtagctaaactagctaaactacactctaggtaggtgttacaagctgtagggcaagcaaaataaatgacgttgctgactttaaaagacttgaaaataatggtactatgagagcccagtagagcattaatatggcttttttagttataataagtacatgccaactggacagactgctttgatttaactggacaaatgacagacaaataaattttggctaagattattgagatgccatggagctgagaaacatgatgcagccacctaaaagttagataacataaacacaagaattccagaccaaatctctcactctatgtaagatttggtgaagtcatttaatctttcttagtttcagctatgtactgtaaagattagatgagttaatgttgtaagcttttaaacaaatgacaggacacacaagggaacaccaagtatttttgtagatacagcaggtcctcgaataatgtcattttgttcgatattgttttgttataacgctgatgagaaaaaatgaaaatcaattcccggccagagcactgtctgtgtggagtttgcatgttctccccatgtctggataggtttcctctgggcactccagcttcctccagcatcccaaagatatgtacattaggtaaactggcatgtctcaattgccccatgacaagtaggtgtgggtatgggcatgagtgcactcagtgatgtgatgatgtcctgtccagggtaggttcccatcttgcaccctaagcttctgggagaggttccggtcacccaacactctgaactgggataattaggtaaataattatcttacttgttcatattaatctttcttaaatgtacgtatagctcacatttatttcagtgtttaataacagaagtttttggtgtttacgtaaaagcttagtgatatttttgtgaccaagaatatgccatagacacttcacatttgcttatatcaattagtcagtgggaaaattggtttgttatatggcgtgtcatttaaagtcacagtttccaaaaacccatcaatgatgttaagtgagaacttactgtatacacagctgggtttgaattctttgccagctgtgtaagcttgggcaaattattgaacttctccaggctttcattctcccatgtgcacagtgaaaacaactatatgtactttgcagaacagaaatagtgttagaaatatatggaaagtgcctagcaaagcatctggaccatagcagacagtcagtaaatgctactgattaatttgccccttactagtaaaactccgaaaactttcactcttctccatctaagtaaccagctcattgactcatgcctctaccttgtttttacccagaacacttaacttcttaaatttctgtcccttaccacaacttcttgtttctccactgttccttacaaacttacactttatccacataaaaatgtctactacttacttgaactcttattt

SEQ ID NO: 306 - DNA, 8822 bp, Homo sapiens
tgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaaccccaccatgctgccattggtatatgcaagggtgtgggcctggggtgcactgctaggaggggtcagaagaaagtgagaactgcagtttgttgttgttgttgttgttttgttgttgttgttgttttttgacagagtcttgctcttgttgcccaggctggagtgcagtgaggcaatcttggctcactgcaacctctgcctcccgggttcaagggattctcctgcctcagcctccagagtagctgggattacaggcgtacaccaccatgcccatctaatttttgtatttttagtagtgacagggtttcaccatgttggccaggctggtctcaaactcctgacctcaagtgatccgcccacctcagcctcccaaagtgctgggattacaggcgtgagccaccatgcctggcctgcagtttgttttcaatgcaagtgtgggatcaggttttgagagtgtggtgaggatcaagggaggcacttggcaggaggaggcagattcaacttccctggggatcagggttagggttggttaagattacagtggtgggttagggttggggttgggtagaggaggttctgggaggctgtgtgagtttggggcacagagctcctcttaagatgccccaataatcattcgctctgctgttaaaatgttaggatattgctagctacatgctgataaggacaaaggggacatccttaagagaaacctggcaccataagtacagattagggcagagaaggacattcgaaagagataggcaggcacagtaggtacagacatgaccactgtaggaccttcctggagtggcaggaaggagcccagccccagcagtggaatcacactgatcactgcacatatgtgtcagccaacagtgagggggtcccacaagcctgggtggggcaagtcagggatctaaggaaggagcaggaaaaccagacaaagaaaagaggtggagacttgaggaatgtgaagaagtccaacataaaactccctgctcaggaccctggggctgtgttcctgcagatcagccccacttctcccttgaggcatacttattttttctacaataagctctttacactatatttcttttcaatgaagttatctgccatctttgtactgcctcttggtgagaatctttctttcaagttagacaagaactgggacatcaggtctccccagtattagctccatttcagtttgaatttgcagaattgatagtgctgaacaacctgcactccaactttaagtggtgtaggaagaggccagcagggtcagaccctgaaaacagaccagccacgtctcccaggtggacgcagcgggttctccacgagcgtgacttggggatttacggcactgagaccgtgctacccacccccccttaaaaatccctcgtggctcccagttgccctgaaggggaatcccaaactcttcagaggcagcacatgctggtgggtgagagttgggagcctgagtccaagttccagcctggctgctatcggctgtgtgaccactggcaactcgcctaacctctctgggcctcacgggctcgttggaggatgtggtgagagaatgaccgagatgagcttagcacagtgctggccacactgtcgctgttcaatgccaggtggctgtggcagcaacagggccctgcagtgtctccagccgccagcagggtgcgtgccgccactacactgggagcaagagggccctgcagtgccctggccgccagcagggggcacgaggccatgacaccgtgagcaagagggccctgcagtgcccccggccgccagcagggggcgcaaggccatgacaccgtgagcaagagggccctgcagtgcccccggccgccagcagggggcgcaaggccatgacaccgtgagcaagagggccctgcagtgcccccggccgccagcagggggctcaaggccatgacaccgtgagcaagagggccctccagtgcccccggccgccagcagggggcgcaaggccatgacaccgtgagcaagagggccctgcagtgcccccggccgccagcagggggcgcaaggccatgacaccgtgagcaagagggccctgcagtgccccggccgccagcagggggcgcaaggccatgacaccgtgagcaagagggccctgcagtgccccggccgccagcagggggcgcaaggccatgacaccgtgagcaagagggcactgcagtgccccggccgccagcagggggcgcaaggccatgacaccgtgagcaagagggccctgcagtgcccccggccgccagcagggggcgcaaggccatgacaccgtgagcaagagggccctgcagtgccccggccgccagcagggggcgcaaggccatgacaccgtgagcaagagggccctgcagtgcccccggccgccagcagggcgtccacaccgggccgaagcgagggtgaagcccgcgtcctcctcggcacagacccggggggcaccgcctcgctttgggacaactcgaggccatggtgagtaaaatccttcctgtttgcagccctgactactgagggttagagaccagtaagaggggtcggtgtgggaaactggaaaccaaaagcccctctgaatcctgagcactgaggttctccccacccaaggcgaggcgggcgcagtgcgaggtctacaccgcggccttggaacacaaatggagcgttcctaatgcagatatgcctcccgaaatacgaatgtgacactcgcagtgctcaggtaacaaacacctgtaatgctaatgcgctgcctcaatacaaaaatgttaatatgaaaccccgtgctccccacacggccccgcagtccccgctcataataatcaacactgacataatcaacacaaacgtagcctccagctgctcacagctgctgctgagctggagctgcctcgggcttggcctccacagtggagcttgttgtcgtatctgcttcacggacgtggaattgacacagttgttttaaaaagtagcttacttcccaataattccatactttcaggaaacttgcagcggtagtgtggagttttctttctcttttctctcagattcctcagcggttgttgctgagccagatctgcatctcacagaaaacaccccagtgtttttcacccaaaacagggacccctcccaggtaagcgccaggtgaccccagcacaggaggccacgtttctacctgagggtcgtgtccgcaggcccgtttcacttcacagccatcacggctgggtggaaaatgtctctttccatctgggtccagttttccttttctggagccttcgcagagttgaagagcagagctgcccccagcctgggtctgcacagcggttccccctgggcagatgcagacgccgcactccaggtgggaactcgcagcctctggcagtgctctgcacagcgagttccccggaggagcacagacccacccacaccccacagagacctcagggtgattgcgacaaaactctcctttacaaacaagtctcatcccatcactcttcttatttaactttaacgatggtttcccactggcatcagaacaggggtcgcagaactgacctggcccccagtccctgagcgctcccacctgctgccctctcccgcccagcccagcccagctgcctgcgttgcggcctccacctgcagggacacagcaggctctcgggagtcttgggaactctatgcacatccaacaccctcttatcaaatactcttaagattctgtctacctagatccttcaagtcacagcggttatgatgtctaacaacacaaatgttctgacgtgatttttttagaccaaaaaaaaaatgtttggtagatcatatgtgagaatcacccttaatttataaatcaaggaaatagatacataaaagcagagtccatatttgggataatcagtaaagaaaaataaaatctcaatgcagaatgaaaggcagagggcaccattgatcattgaaatttcataagagtttactggacagaatattaccttactatattctccagccctgtgtgtgtgtatgtgtgtgtatatcacacatataccagttgcaaaaaatttcaggtttaaacactcatgtttgcttttttttttttttttttttttttgagatggagtctggctctgtcgcccaggctggagtgcagtggtgtgatctcagctcactgccacctccacctcccgggttcaagtgattctcctgcctcagcctactgagtagttgggattacaggcgcctgccaccatgcccggctaatgtttgtatttttagtagagactgggtttcaccatgttggccagctggtcttgaactcctgacctctggtgatctgcctgcctcagtttcccaaagtgctgagattagagatgtaagccatctcgactggcctactcatgtttacttcattagtcaatacggttgattaagaagttagggttagggttggggttagggttagggttagggttagggttagttttaggggttagggttagggttagctttaggggttagtgttggggtttagggttagggttcgggtttgggtttgtgtagtgttagggctagggtttgggttaggagaattgcttgaacctgggaggtggtggttgcagtgagctgagagtgtgccactgctctccagcccaggcgacaatgggagattccgtctcaaaaaaaaaaaaaggatagtaatacctacttttaacagtcatgagcaacatttttttttaatgtgggtcacttctttatttttctgattgctagagccatgtctcaaatgcaaacatcctcgtgcttacttcatgcagcttcagactcgctctgcagacgagctgatgaccaccttctacaagtgctgcaattctcagggtggacactgctgtagggattaggactaggatggcccagctgcttcagtgtgtgcttaccttgtcccttggggtagatgcttagctggcagtgtgaatcgtgtatcctgagggtctttgctggtgtggtggaaagacaaaccttttgaggtgaagagccagggtgtcaggaaatgtggcctatctgctagtcagagtggatgaagtcatgaatgttggggagtttttctgtatgggtaggagacggagacccataactaagtatgtgctgtttaaagtcctgttccttcatcttctacatttattggcagttgacattcccttactcccaatcaatactatttttttttattttgagacagagtctcactctgtcgcccaggctggagcgcagtggtgcgatctctgctcactgcaagctccacctcatgggttcacgccattctcctgcctcagcctcctgagtagctgtgactacaggcgcccgccaccacttctggctaattttttttgtatttttagtagagacagcgtttcactgtgttagccaagatggtctcaatctgacctcgtgatccacccgtctcagcctcccaaagtgctgggattacaggcgtgagccaccgcattcagcctcaatcaacactcttaaatgtttgtactgtttgcaaaactgagtacattaaatgtctctaaatatttaactgttgcttgtaaacttaatttagtatttattttaatcaaaattctgaatatttcgttaaaatgaaagttctaatattgccttctcagtgttttaaatagcttattaagtagaaagcaaaccccaaatcacagtgatcccaaaattgactacatacttagatttgaacaggctatgaaaatcctcatcactggtatttcaatttatttctttactcctattcttattcccttattcattttttgaaccttccctgattgcttcctagggttgcattaaacgtataagattctattttttttttttttgagacacagtctcgctctgccgcccaggttggagtgcagtggcatgatctcggctcactgcaacctctgcctcccgggttcaagtgattctcttgcctcagcctcccaagcagctgggactacaggcgcatgccaccatgcccagctaattttttgtctttttagtagaaacagggtttcaccatgttagccaggctggtctcaaatcacctgactttagatgatccacctgccttggcctcccaaagtgctgggattacaggcatgagccaccgcgcccggcactatgtttttatactttatactttctgtgttaatcattcaactctcagaagagaaaggacacctcagactagctgagtctaggttcttgataattgattcttggtcaaggccccagtcttaattgctttctaaatcaatctctctctctctctctgaaagagatggggtcttgtttatgttgcccaggatgggctcaaacacctgggctcaagtgatcctaccgccttggcctctaagtagctgccaccactccccactccacatctttttttttttttttgagacagggctttgctctgttgcccaggctggagtgcagtggcatgatcttggctcactgcaacctctgcctcccaggttcaagcgattctcctgcctcagcctcctgagtagctgtgattacaggcatgtgccaccatgccaggcaaattattttatttttagtaaagactgggtttcaccatgttggccaggctggtctcagactcctggcctcaagtgatcctcctgcctcagcctcccaaagtgctgggattacaggtgtgagccaccacgcccggactccaaatcttttaatagtgtattcttgcttatgaaattgtgatacttaaa

SEQ ID NO: 307 - DNA, 5652 bp, Homo sapiens
tggcacaagaaatagcatcaactataatatctggtagagtgtaaaaaagggtagagttcaagttcctaaaaatgttaatgcgccaggctatacgtaaagcgctggcctaggcactatatggatcaagactaaagacacaggcactgtcctcaggagcattctagtggagaggggaggtatccaatacaccaattacgtgaatacctggcttcctttcttaagtgtataaaaagcaaataaagccttaaagactgcttcacagagctctccatgagcagggctggggatacacagaagccagggaaaacagatacaagactcttgcagtcagcggtcccagaaagacaaaatgagggcttgtccaaaggccttgtactgggagtgaaggcaagtggaaggaacgagcaatggggacaaacaggtctcaaagggtgggtgactgcctagaaatgagcagaaggagaacttggaaataacaggtctgaacaaagagacagctttatatgacagaataaataagaagtatgttaggtagacaagagaaatagatgtggtcactgacttgtggagcctgaggagctggcaggggacattcagcataaatttactgagctcctattacatagcaggcactgttctaggatccagaggtacaagagtgaacaaaacaaactaagaggtgtgcagcaagcaacagggtaaagttagactctcctgctgacaggcaaaagccagaaatacagactgagaagtgtcaactgcaaatgagaaaaaccctcggttctcctgtattcaggagagtttcaagaagagagaagagaggctacaacactgaatacaggagtgagttggggaaacaatctggctggatgagaactgaacttaaccgatttgacatttctgtgactgttgagatggccttctccatcgcactgggccaggatccagcaggaggagatcacagcaagtgtgcctttgagaagtttgttattaaaatgaaataaaggatggtattttgatacatagttctctgagaatacagagaaagtagtgattcattctgaccaggagatctgggaatgctgatggttggcagtgaggatgtcctctgtttttgaacaataaatgcaggaaaagaaactgaaaagaatgccaggtatggtggctcatgcctgtaatcccagcactttcggaggccaaggtgggtggatcacaaggtcagagttagagaccagcctggccaacatggtgaaaccgtgtctctgctaaagataacacaaattagttgggtgtggtggcacacacctgtaatccctgctactcaggatgctgaagtaggagaatcacttgaacccgggaggcagaggttgcagtgagctgagatcaccccattgcactgcagcctgggtggtagagcgagactccatctcaaaaaaaaaaaaaagaaaagaaatggaaaagggatgatagagagtcagggttacaataaggtctcattacaatacagctttaaacattagaaaacaaacactgtcttgtgtaatcatacacttctaagttagacatatttctgaacaagataaaatgtgctacataaaaataaatgctggctgggcgtagtggctcatgcctataatcccagcactttgggatgctgaggcaggtggatcacttgaggtcaggagtttaagaccagcctgggcaacatagggaaacccttactaaaaatacaaaaaattagccaggtgtggtagcatgcgcctgtggtcccagttattggagaggttgaggtgggaaaatcacttaagcctgggagacagaggttgcagtgagccgaggtcgtgccactgtactccagcctgggtgacaaaatgagttgatcttgtctcaaaaaaaaaaaaaatgctatttttgtttaaattaggcaaatatacttatctgttatttaagactaaaaacctgatttcttggtcctccatctagaaaatagtctgttttaagacaaggaaatagttcttgtttaaactagagaatgagaagtctgtcagacacatggccccactcttgctccaagtccttctcacctattctcagataagacccagatcttgggaaacaaattaagggcgcatctgctggattggacctagctgcactgggagttgccagagtgctctgagcagcatcaggaattcctctgggccttgtcgtgatatcatttgcgcaatgtagcctgtgatggcagaaaattaagctggtatttatacagggtattagagaaggaccctccctgcaccaggcttaaagtgacaaaatgtcagcctcaatcatcccacaggctttggtctccctctgtaacctctttctttttggctgctctctctctctctctctgtctctctctctgtctctgtctctctctctctctctctctctctctctctctctctctatatatatatatatatatatatacatacatatatacacatacacacacacacacatacatatgacactaacagaaaaataaattgaaaagagcactgaggcagagtgtatttcacgcactggtgccaatgtttcatatctcatgaacctcgggaaaacaattcgtagaactaattagtttacagtgtttaagcagcttgttcctcgtctttaatcttctttatgtaatagtgtgaacaaagccatattatcttctgatttttttatacagtttaacaaatataatctcccttttctttccagagattacttcatttagacatcaaactatgttgttgttgtttttttcccctggggagaggggatataaataaattgacatctattcacataggtctcaatggtctaccagatccacccaggccctaatcctctttgttgtcatggaatccacctggcttaattatatttacagttttcaacgacaccacatggcatgcaggttttccctgaactctgcacatcttcccgaatcctagctataagtcacactccagctgctgtatccgtctcggattctagacggtgacaaggcactcttgcctgaaactcagcatcaggtcctcaaagaatagagcctggataaatctcccctccagtatttttatagcctactaaaagaacatgatttaagagaactcctgacctaaagccaggggatgggaaatagatacatatgtgtacaaattagttgggtggtcaggggagcaaagaagaacaagatacttaacttacaaaagttttatcttaaaatactgctcacaagtatgacttttaagagaaattgaactttttgtgctttctgattctagataaatatttagttgctaagctgctggaatgctatgagatacattttgggtagagtcaaactgaaatccaagaactgggtaaggctagtgttgaagtaattattattcatctggtgggtgatgctgcacacaaataactacttgcactgctaaggatttggagcagagttactccctgagagagacacttttcaggtggcagaaacctacctcagacttttatttatacactggaatccacattattaaagaattttacagtcttggaaaaacacaggacttggtgcaaactttcattttgcttgcctgagaactgtgtactgtcccatggtacccatctgccttaaagttcactctgtccttaattgtcaaacagattcatggtaactcctaattagtgcaaaacaggtaacacagctgcgactctgcaactgctgaacacctttagcatctatatcaagctaagctcaggagccctctctgctctctcccaaggttaatggtttcgagtcttctgagaattatggagtaggtgcccacagtgagagagggcgcctggttctccaagccgctgttcccactactaatagagtcagcataagaagcagccagtttccagcaacggtaacaatggagaaatttctcttactgcacagctgccaaataactttgaggatctgattcagaactaacatggaagatttaaatggatccattgcaacagacgttttgcatgttggcacactggaattagaggaactaatcagagccagagtggtaccagatggtctcttgagaattcttctgagtttaagatatgtgagccaatgagacaaactgtataattgcccaagattttactctaagagcactggcactgggagtaagaccactaggaaactcagctctgccactttccagctgtaggacttcaggcaaattaattaaataggatggtggtgaagaattaagtgagatactgtatctaacactcagggtacctaggtagagcacagggaagatgaggagctgttaactgtgatagttatgattttgtattttttttttttagatttctgagttgaggaatatttgcaagcaggtacagtaattacccaattcagatgtttatagaaaaagaaacacatcttaaaaataaaggtaccacaaaaaacaagaagtagaaaattggaagatggagagatgaaagaaaaatgaagaaatttcagagaaaaatgaaaaaacaaagcagattttaaaaagaaaaagaaaaaaaggtaggaaatacaaattaagaaatttcagagaaaaatgaaaaaacaaagcagatttttttaaaaaaagaaaaaaggtaggaaatacaaatctaagaggagggtttgaattcctaatcctgttctttttccttgcacttctattcaaatcccttttctgcatctcaacttttgtctgcactagatggtccaattctagccagacttcaacttgtagcagtcccaaggtagaaatgactagaaaaaagaaagttccctcttagctatgaagaatgaaaaacattaaaatgcaaattcaatgtaaaaaagaaagcaagactatacacacatttcacagtagcaaattctcaggcagaagtggaagccagcaagtaaccccctgaggtgtgctagtgtaactgtttcaagttttggggatgacagataaacagcaagtcctattactactgaatgaatctctctctctctctctttttttctctgggaagaaaatgtttgtgatagaattggtccttgagaaagagtgaattgatctgttagctttctgtgctggaccagaaataattattgccatacctacttcctatggattatgttcaaaagttagagatactcacttattctgtctttatgctatggggaactaatcggaactggggtttgcttcactgactctcacttattttaaaagtcaggcttagtaggaaagaaaaagtcaaagagattgaccaagaaaggatgaaatgttcggtctaggtaaacaaacactgtctcagataaagttctccacgggtctcgacctcaccttctactgcgtatgaattcattttacaatgttcgttttttttaagctagatctttgtgtgcttattttcaacaggggatgacaattgatttgttttctattgaacctcgccaactggatactgaagcgagcacggcatatttagatgcccttaaactttcaggttcacctttaaaacgtgccaagacaatgtcatgttgagggtaaatgtgcaattttcactaggctgagacgagaaatgagtgtctcg

SEQ ID NO: 308 - DNA, 6966 bp, Homo sapiens
aaggtagcctttgtttttccgtatctttaatgcaatttgttctgaaaaactactgtgacattaataataaaggacaagctctgtaaagaaaaggtgcctaacaaaaacttggcaatgatctccattcaaagcaaaaatgctatgaattttaagataagggacctgttatatgttaagtaaaaatattcgtagtttataatttgtgaagcagtaggcattgcataactctgagaaaaaatgctgttcattatatgaatggcaatttcaaataatatcaaatgatttaagttcaaaggacttaggaaagcttcatggcatcctgttattaatttcacaaaaatttctttagaaaagaaactgagtcctacatgaaaaatgtaaaactacaaggtgcactgtgtactgattctccatgcaacaaatctgcaaacattgcctagggcatgctatatgggaaatctggacagctggaaatcatagtagacaaggagatttaggtcattgatctcagaattggaaaatttcccctagtgagccaatatgaatctggcacatatcactgatacacacacatacacccctcctatatcctcaaaaaagtagcatatcactaagagatatcattagaaaatgtatgcagtaatagcaaagcgtgtgaatatattaactgattgcgtagtgaaaatcttcaatattcagtaaatattcattgggtacctcctatgtacacaacactgtgagaatcagtagtaagagatataattaacatttgttaagtacttgctattctacattctttacctaactcatttaatccccctttcccatctctctctctttttctctcccccccaccttctcttggagataaaaaacaattatgatcatcaacatcagcatcatccccattttccatttgagaaaactgaagcctaactgaagtagcttgcccaaggtgatagagctagtgagcgacagagccaagatttaaaccctggcagtctgatccagtctacacattcaaccactatgctatattgctctaaagcacaaccacagggagccacaagaaacacttcaagctcttgagcacttacgctttatttgtgtacctctcactgcctgaaatgactcccagcttaggactcaccagctccatgaacccttcccagatttccctcaggaacagttgtctactcccttctctggtccatcaagatatcttgtacatattccaaattctgtacttattggaactatattataactatttgtctgcatgtttgctctttttattcgtgaggcttggctgagaattcaacacatagtaaacatccagtagagtaaatgattaacctgtcattggaacattacaatttagttgaagaagtagtctgaactctattggtgtaagtatttgtgtttgataatggcaaataagaataaaggttaccttagcaaaggttgctaaattatggactggggtgaagatagggctcaaacctcactctgatagaccttaaaggataggaatgaatcagatgactggaaaagaggagaggcaatctggggccagatgagcaggagcaggagcaggggatttgagaaatgagtgcctgaggcaggtgtggagggtgggcagcccatttaatggcaagctaaggagcctcaaatttattcttagggcactagagagtcttgagcatggaaataacatgatcagaagagcaaggcaggaaaaacagttttggctgcaggaaacacaaaggtgaataacaaaaaatatataatatctagattttgagggtgaaacctactcagaatccttctttagtaaggaaaaagacagctgaaacattcaccacctgctgaaaaaggcttgtctccaagaagcaaactgttactaatagtttttaatgtaagtaaaaattcattaaacatttattgctgctttattatcctacgggctaagaatacagaaataatgcatcatcttcagggataagaatctaaatttttgaaaatgaaatacagaatatggattagagaagtaacataaaatgatcaaaagtttgtatgtgaaggtcagaatgagagagctattattcttatataatatgatctgtcaaaataaaaaaaaacttttgttcaaaaataaatgatacaatcagaaaatgagaaaggacattagaagtaatctaatcccacagcattttagagatgagaagaatgggaggaccagagaagttaaatgatcacctccaggtcacacagaaagttgtcagtaaaatatggattacaaatctcatctcctaactatggttgactgctttgcctctgctgtttttcataaagctataaatatgactacactagaaaaataattctggtatattttggtataaaacaaattataagtctttaataacatccatgtaaactttaaaagattaaaacaatagagccaatgaaaatggatcattcattcatttagcagcctatattaattaagaacctagccagggaatgcaggaatggatgaagggtttggatataaataacggaaaatggcaaggcgtggtggctcacacctgtaatcccagcacttttggaggccaaggaaggaggaccgcttgagctcaggagtttgagaccagcctgggcaacacggcaaaacctcatctcctaaagataaaaaaaaaaattagctgggcatggtagcgcagctgtagttccagctactcaggaagctgaggtgggagaatcacttgaacccaggaggtcgtattttggatatgctgaattaaatataaaattaatatcaccagcatttttaatttcttggtaaaaatgtagctattagaaaactgaaaattatatacatggctcacatatttctattggacaatgccactctggagaatgagcaaagattaaccagctgtgggctggtgcatgcttagaaaggccaggaaagaggacaaggtgggatctaaccattaaaggataagaatctgaagattttttttgaaagactaattttcagggaattgtggggaagaaagtctcacagaaaaaaatgtgggtagttacccaaaagtttctcccatcatctttggaactttggccaaatcaggtgatgccttgggcaaatcaggtctccttcctcctgccactgaactaaacttgcagtttatccttctgtttgttctctgtggaactgtgagccaagtgaagtgcagatggatggcttcttggaacagaactgaaagcatgccagtacttaagttagaatagcatccaccttcagtgaccacagttattatgtgaacaccgtaggtcctcacgtgtgaggtcaccgtattatagaagcagctctctggataattattcacacagacacaaacacacacacagacgaatgtcatcagagttttttgctgtaaaacactatttccatctgtgtcttctgctgcatagtttaattcctgtatatgtcttttaaataaaaatgtgggcctcatctgtgttacaccaaccttgaagacatgaactgcagacaaattttcataataacttcagggctatcaaactggctagaattgaaatatcaaggtcagccctgccattttcaaattatcttcagccttgatataacaataatcttaattaaatagacttctaaaaactaagtgtaagtcaagcttgaaccatcactattttcagagtatactaaacagctagtaatacaagtataagcaataaattattcttgtttttataataatgagaaaaaagttctagaagttaattccacttaaaggtgtttcaataattaataatttcatttttctcatgtccaatgtcattacagaattaggtatattcattacttgaaacatttcatttaatcattcacttatttacttattgcagtgttcctttattgtattgcagttatttgtcctgacagtttatagttcctcgattaaatggatattttaggtattctggttttaattacctaggagcaaacttcaggtttcaaagttgcatttggacaaagtgctattcctataaatttatttataggatggcttcgctcttgagttaatcagaatttgtgtcacttacataacaatggtgactagcgtgacatgttagtagtctctaatgcaattttgctaaaaattttcttataacccattaatacataagagcagatgtctttagatacccttttacagactctttaagatgactatttgttcttttcatctgaaagaaccaacacaaaagagcaaaagtgagtgtcaactctttttcttttccttttttttttttgttttctgaggtggagtctcaccctgtcgcccaggctgcagtgcaatggtgcgatctcagctcactgcaacctctgcctccaggattcaagcgattctcctccctcagcctcccgagtagctgggattacaagcatgtgccaccatgcttggctaatttttttttttttttttttgtatttttagtggagacggagtttcaccatgttggccaagctggtcttgaactcctgacctcgtgatccgcccgccttggcctcccaaagtgctggggttacaggcatgagccaccacacccggcctgagtgtcaactctttttacaccccttaaaaatatactcatatacagatgaatggttataaatgatttaaaaacgtagatgaggaacactggaatacggccttcacgagggcagaaatttttgcctattacattcattagtatatttctagaacccagaagagtccttgatcctagcagatgctcaataaatatctgtgtattgaatggcacataatggacactcagaacataaatgtttaatgactgaataattcatggaaatgattacgccattagttaataacaatatgctccatgatcatcatttcactgtatgctactgtcaaaggcatttgaatcacagcaactccatcttgaataagggctatgtaaaatgaggctgagagctactaggctgctttcccaggagggtaagagattcttagccacaggatgagataggaggtcaacacaaggtacaggtcataaagaccttgctgataaaacagcatgtggtaaagaagccaaccaaaatccacgaaaaccaagatggccatgaatgtaacctctggtcatcctcgctgctcattatatgctaattacaacacattagcatgctaaaagacactcccaccagtgccatgacagttacaaatgccatggcaatgtcaggaagttaccctacatggtctgaaatggggagtaacctgcagttccaggaattgttcaccctttcccagaaaactcataaataatccactctctgtttagcctataatcaagaaataactgtaagtatccttagtctagcacctcaagctgctgctctgcctatggagtagccattcttttattcctttactttcctttcactttactctagggacttgcaccaaactccttgcgagatccaagaaccctctcttggggtctggatctggacccctttctggtaatactacaatatgaatactttaaatggtggttaccaggaagtcttaaatgtttatgacaagtaggtgcttagtacgttttcttgaatatatgagtaaagaaataaactagaaagactgggtcacaatttagaaaataagtcatgaggtgctgaagaccagaacagcccaatctttttttataaacctcctggatgcaagttttaacacagtctcaaaaaagttgtgatcagtttctccaaagctacacactgagactaggatgacaacgagctacctactcaggattttgcaaggaccaaaaatcttttcttactttacaatactctcaaacagaaactattttaaactacatggttaattcaaccttgtggactggatggtcatcaaaatgattatataattatttcaacatagttgcatttctttctttttctttgtgtgtgtgtgtgtgtgtgtgtgtgtgtgtgtgtgtgtgagacggagagttttgctcttgttgcccaggctggagtgcaatggcacgatcttggctcactgcaacctctgcctcccaggttcaagtgattctcctgtctcagcctctctagcagctgggataacaggcatgcgccaccacgcctggctaattttgtatttttagtagagacagggtttcaccatgttggtcaggctggtctcgaacttctgacctcaggtgatcagcccgcctcggcatcccaaagtgctgggattacaagagtgagccactgctcccggcaccatagttgcatttctaaatataaaatccccacgaagtttgaaaagatgatgagatcagggatatttgaacacatttttaaagtaaatggatgtatggaatattatgatagaatatagtagtagtggtagtcaagcatgaaactggtagagaaacaaaaatatacatgtaaaataaactcagtattttaataataaaataaatggtatcctaaaaaatacactgattttgtaaatctatattttgctattgtgactttctatgaatatccatttataaagtgttacattccaacctgaagcttttttaaaagtacaacaatctttttagtttcaactttaatctgtaaattaagtgccctaaatcatctaatagcatagctctaaattcatccttatcaccactgcctatttaacatcaaaactatcataaaaaaaatagttcttatctatcaatgcatacatatattacttttcttaaaaaaaacctgactaataatgtggcaccatgaacatgttatatgtagacatggtttgttcaaagggctaaaaaacaattatagccctgcctactcacaatgcattcccccaaattttcattagcttacatcatagtaagacttcacaa

SEQ ID NO: 309 - DNA, 195547 bp, Homo sapiens
agtcctatgtcatgatcgaagaaacatttgaaagaagaatagattgaaagcatcatgcaattccactgacacacagttaagagtttctttagtactggcggtgtttggaagttttcagtaccgctgtgtaagtccggagaagcttcatggagaatggtcagctgtgtgatgcataagccacccctccctcttagtcttaactatttttttctcctttatttgtatttttttcttttcttttcttttcttttcttttctttcttttctttttttttttttttttgagatggagtctcgctctgtcacccaggctgggtgcagtggcgtgatctcgactcgatgcaagcctgcaagctctgcctcccaggttcacgccattctcctgcctcagcctcccgaatagctgggactataggtgcccgccaccatgcccagctaattttttgtatttttttttttagtagagatggggtttcaccgtgttagccaggatggtctccatctcctgacctcatgatccgcccgcctcggcctcccaaagtgctgggattacaggcgtgagccaccgcgcccggcctatttgtattctcttaagaaatatttcatttaaaatataatcaataccactttacaaagtatattatgtctcctttctttatagttttacaaagggcacatatatcagctgtatccagaatagcaaaaattaaagatcaaatattaatattatttctctctcttaaataccaatacaacaaaaatgtattttacataccagacattattttaaatttgctaaaaattattacctttatacggttttaaattttctttttaccagtttcttcatttgtttttctacaaaactatttgctaacttgcgtcaatgcctgcaccagtttctcagcatcctattctgtcatcaacttctttctcttaataggggaaccatttcagtaatctatcaattagtttgtgtaagaggcagaaaattaaaaatccggaggggcgcagtggctcactcctgtaatcccagaatttagggaggctgaggcagttggatcaactgagatcaggagttcgagaccagccttgccaacatgcgaaaccctgtctctactaaaaatacgaaaattagctgggtgtggtggcacgcatctgtaatcccagctacttgggaggctgaggcagtagagtctcttgaacccgagaagtggaggtgcagtgagccgagattgcaccactgcactccagcctggacaacaagagtgaaactccatcgaaaaaaaaaaaacctaggctatcaggtcatttactggcaattgcgattttagcatctataccagcatttttgccaaaaaatccctgagatttctcttccttcttaattttgcctgtagctctcagcatttttccagtcttaaggaagttgaaagttttttttttccattttgtttaaccattaacttccattctctcaaattgcaaatttaaaaaacagaagaatgaaaagaaaataaatctgtcatacagtgtacactgcaatatcatgaatttttgtacagaaaaacactgatttaaagaatttctatgaatttgcaaattagtaatttgaacaaatcactctttgatatctgaaaattaatgaaaagcataatttgtatcactttctcattaatattctaaattgtgtcacagcacataaaaaaatcgataaattatacctcaaaacatgaattaaaaagtattctagaaaactttttaaaagcattgatacaatggagtgcccagagaatttgtctctttctccattatgttttattatgtccacattatttatcaggggaaagaaaaacaattcctattaattatttattaatattaaaatattgatgagtattaaaaagtaccgggcttccagctggtgtactgagttgaacttttctgaaatgcagccagcacaaggggcgtgtattaaaagagcagaacaaatgacttattaggggtccaaaagcagcaatcagaaaaggttcatttaacatagcgatggcacaagcttcaagcaattgcctctacttaagtaagtgtggaattacaaaagcctatttattacagtccaacagggtcctgcagcttgctcaaagagctttgaagaaattcaacagttataaagtcctgctcagtgcagaagcagtaaaatttggacagacccccaaaacagcccacaaagctttcatgaaaaagttaatacaatcctcatcgcaattgttctttgaaatgaattgttttctcacttttctttttttaaaggagagatgctgtacctggttattttcaaaacttctttgaaaatgaattttaaccactaggaaaaaatgaaagtttcatggtggtatcaaattaaatgtaggacctcatgtgttccaacattaagcttcttgaaatgctcttgaaaccaacattaaatgtgactccgttaatggacttacttcagcagaaaaattagtagatttcctcattgtagaaaatgcaaaatttgagtccaaagacactggggctgaaatttttttattagtgattggataatgatttgatttttctaagtattaaagtaagcaaaaataaatttttttttaaaaaatccacatatccatttatttataattcagcaatacatttataaatatagaatatgtttatgaagcttcaactaaagtataagaaaaataacttatcttttgcttggaatcaattttagagagcaaattgcagggttgtgggggtgaagccaatttagggactaaaatagaggattattgaatagatgaagaattgataatgaaaggtaaatgatgttaatttgtatgaaaagatattaattcctaatgggagcaaaaagttggtaagaaaatgaatttactttttcatcagaaaagcaacacctacatttttccttggcaaaagattaagtcaggccaagtgtggtggttcatgcctgtaattctagcactttgggaggcctaccggggagaatcacttgagcccaggagttcaggatcagcctgggcaacatgacaaaactttgtctctacaaataataaaaaattagctgattgtggtggcacaagcctgtagtctcagccagtaggattgctttagcctgggaggtggaggctgcagtaagccgagatcacatcactacactctagcctggaaaacaagggcaaaaccctgtcttaaagaaagaaaaaaataataaaagattaagtcatcattcccaggccaatccatgcttcaattagaaggtgttcctatgagatctcacaaataataaaacccagttgatgggaaatattgcagtagattctattttttggtgtacagttttctctgaagtggcacaaggcaagcatcatgaaagtttctattataggtgaagaataaaaatgaaaagtgtttatagataggaaagtttgaatgagaggtcggatgcaaaaatcatcatgtgataatcatagaaacatcaacaaatacagaacttctgctaacttgtgggaaatacaaatacatgaggttcttatggtccttgatttgagaaaaatctatataaaaataagtgctttaacaatgaaaacaattcaacagttaatgtatctaaagattcctgagtttttgtttgttgtgtgtttgtagtttattttgctgcattccattaaggcagggtgccactgaactccagtgagacatttcgattggcgagtgaaccaagattgagatttgaaagcagaagtactttgatgatagtatgcatttttccttttaatggaagggtttgaagaaggaaatcacttaaaatatttttaatcttcagttagaaatgaatttgaccctatgatatctgatccaaacagatggggtttttattcatattccatactttcgataatgcttagcaaaacatagcaaatgtagaatcaccatcaaataagacatttcaaaacatgtctaggtaattgtaacacatatagcagtcatttccttggtacctctcattaagtatttttttaagaaataaaactgtacaaaagaagattgttgttccttttctttgtagtcaagagatgtttgtcagaagtcaaggcctactgtaatatgtcctaaatcatatctattttacaatatactaaatattattattacctatggataccatgggactccttgtgcataatggattccagtcctcttgcagagctgcatatgaaaatgttatcaatgagctgaagaatctggcattaataactttgcaacattataacaaataggtagtcctgatgttttgttctttttttaatacatcaaatatatttcattgcttacattatagtagcagattgaaaacatctgctcacttgccactagtccaccagcagcagagaatctcagcacattttccctaggcctgcatgtaccagggctataatccagctgttgagtctggatatggggccagattaatattcaagagccttggaaatggaaatagtgctttcttgccaaaaaactggaacaatgatagactccatttgcatgttcccttctccctctgttcttattcgccaccctttctaacccattaatttgcttccttccaccttcccctcccatcctctctttacagctccatcacctgtcctgacgattaagaaagatcggacctccagaaatagcatctctttgtcctggcaagaacctgaacatcctaatgggatcatattggactacgaggtcaaatactatgaaaaggtggggaaacaatgtttaagggttgggctgtgtaggcaagaagctgtttcctcatgagctgtgctcttgcaaagaaaccagtgacattcctggtaaatggtagagcactgtttagaactgtggccctgtgacccctttgatttattggtagaggaaggtttagaaagaatcttgttgaataccccctattctacagcaataaacaacatcaaagatgccactgccaacttaatccagttacttatggcaatagcatgacatttatctccctttacaccaagacccctactctaccaactattttattgtggtttcttagtctatttgtgaactgtttttttagttcattgcctcaagcatcatttcctgaccttcaaatttacatgcatttcattcaatacaaatagcaacattgtgctagtaagaaaaatattgtattatttaactgatgatgaaaagattttcttgaccctgtagaaggaaatttaaaaggttggggatagatggataaatttgcgtgacataaagttgtggcttggtaatgcaattattaaaaaaaataggcacatggttatttttaccccaaatttaaaaattattaaaaaatagttatgtggttattttgccctgagtggagtggcgagtattccatcattctaaataactcattttttttctggttgtaaatgatagtaaagtttaaagacaagatatgtttaaaccttagaatcacagctagttagtttcacaactactaacatgaacactacatatttgtgtatctacttcagtttataaagtgtgttaaaatgaattaaatgcaaattgtgcatttatatagcagtttatatttacagaacatttctgtggacattacttaagtctgagctgtataacaaccttatggaagtagcaaagtaagttgttttagaaataagaaaacagagagtgatgttatatgaatttcccacagcctcattgctaataaatattaggcatctgttttgaattgtggcagccgtgagtcctcctttagtaggtttttccctatatcaggtacctttttctacatgataatagatccttataagaattattggcataatcaactgtgcaaactgcgtaatgtaaaaacattgttttgcattatgtagttatttccttgcttgaagttaatatatttctctagtataatgtcatttttttcatagtctctcttacagaaagcctagagtatatcttttttattaaaagaaattgatgccaaataaacttcattgttcaaaaattgtagtagaaataaattttctcctagctttgagtcctctactgtggtaaagtcaaatactcataggattgtgatctattttcagaagtgtgacaagatagaatgggcaaatataataattcatgttcataaatgatgccacaaaattcttaaaaatcagtaatgtgcctcagttcaaactagatttcaggactgggagaagaacacctaacatttagatctatgaggttgatctcaaattttaattgtatacatctgcacctttcacaaacatgagaaatatgctgccttatttcaaactccctcaacaaatgcaacaagcatcattgccttttttttttttttttttttgagatggagtttcactcttgttgcccaggctggagtgcaatggcatgatctcggctcaccgccacctccgcctcccaggttcaagcgattctcctgcctcagcctcccaagtagctgggatgataggcatgcgccaccatgcccaactaattttgtatttttagtagagatgaggtttctccacgttggtcaggctggtcttaaacttgtgacctcaggtgatccacccgcctgggcctcccaaagtgctgggattacaggcgtgagccaccacccctggacattacttttaaacaatattagctattgcaggaaaaaatggtcaaatctattgattattccctaagtattttttgatacatacatacctgtaatattatttaaaatatattcctttaaatacatatttgcatcacatatacctaaatttaaaaattaattctaaatatttatagtatgcttggtaatatttagaaagattctctaggatttaaggtccacaaggtctagatttctggactggttatttcgctgatggtgattaacagtatatgtaatgtatggcatgttttctgtactattcaatctcgttttggttgaggatatacagcgtttcatattatccactctaggtcctactctaggtgcagggacattgtaccattgcttgaaatcaggttcctcataggagctctgtgtataataatatatgtgagagaaaaaacgtaattcttgataaattcaatttttgtaaacaaagcttgacacaaagagaccactaaaatgtgtcgtgtgaatctaatgtacaatgtgaatctcctagagatcctttttgggaagcatttctagcctttgatctggagatttttgtctctaccaaaccacagtgacttagattaaatacagcacaaatacagttaagctaaaaataatgtagagctacatataaaaccttgattttttatgtttaatattttaaggttgataaaaaaaagttctactccagaatcaatagagcattcctattaggtttaattcaaagggatattttcttctttgtaagtttgttattggaattagatttaagctttctctcagccttgactttgaagagaacatatcttctctcacatatttactggttagaataaagccaaatttttcctgctttacatgcaggacagaaatcataatattcaaattgggaaattctgtaaatatttttatttttagaaatgcccatgttgggacaggtgcggtggctcatgcctgtaatcccagcactttgggcggccgaggcaggtggatctcctgaggtcagcagttcaagaccagcctggccaacatggtgaaacctcgtctctactaaaaatacaaaaattacctgggagtgatggcgtgcacctgtagtcccagctactcaggaggctgaggcaggaaaatcgtttgaacccaggaggcagaggtttcagtgagctgagatcgcgccactgcactccagcctggtgacaaagcaagactttgtctaaaaaaaaaaaaaatgcctaagttgcgttcagagaataaaataattgaaataatcgatatgactttttaaatccatcctatgatttgtgttaaaatataaaagaatcaggtttgagtggttcactgtttatcattttatagcattatgaagatttgattttaacatgaatttttttttctgacctcaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactgtatgtattatttcaatgcagtctagaggagggggcagggatcttgcaaaagatgtctgatcgtttattctcactgtttctaagttttaaacaaatgtgatacatttaaggtatattgcttgggacattgcaatttgcagagccctgtgtctgtatacagtatttgtgtttgtgtgggtgtacattttgtgtttctttttttcttgtatgcaaatcaaacatattctaatgcctgaaatgcttctgttttttttttttagccataaattgcttttgaggaacattatttaatatagtaacacacttccagtgtctgtcatttcagatattccaggttcattgcgtgattcaatgaaccacaaaaaagaaacttgctgatccatgagaatcttaattttgttttaatccttaacacattcaatagcatatcacagagagaataaggattttctaaaatgtgttttatcacttcattcacattcagaagtaatttgaatagcctgttcctttaaccccaaatttggctaaaattggcctaaaactggcaaacatttttccagtaacttttctttttttcaaatgaattttcttcatacttaaaaaagccctttgctaaaatataattttcaaaaaggtaaaattatgtctatggcactaatataaaatgagtagaagttaatgattttacttaactcatttttttctttctttctttttttttttttttttttgagacggagtcttgctctgtcacccaggctggagtacagcagagcgatctcggctcactgcaagctcctgcaagctccgcctcctggcttcacgccattctccccctcagcctcccgagtagctgggactacaggcggccgctaccatgcccggctaattttttgtatttttggtagagtccagatttcaccgtgttagccaggatggtcttgatctcctgtcaccttgttagccaggatggtcttgatctcctgacctcgtgatccgcccgcgttggcctcccaaagtgctaggattataggcgtgagccacctcgcccggctgtttaactcattaattaataaacagattagcaagagattaaaacctgtgctaagaaaaacttgaagaacagatacataattatgtgtgtgtgtgtgtgagcgtgtgtgtgtgtgtgtgtgtgtgtttaggtaatcataatatgctaaaaatgtgctaatatatcccacactggttaatatccaatgagggtaataaatgtaatgattgaggtcatctttcttacagggcacaaaccagttgtctttctagtaaataagtgttatttcaattgttaaaggaaaaaggatatatatcactatcagttttctacaacttaaattcactgttgtaaggtagcctagaaagatgagcaaagatgcacaccctttagaaatagattacccaggaaaggtctgacaatgctcaacactctgctgaatggaatataataatcttctgaccattcccatttcccattcttccctgacacctgtacttcccattttctagatagttagttcctgacataaaatctcattgttactggtatatttttgtgtccaaatttgatacctgataaaaactttcaggattgacctaaaaatataagaatcattctagttatatagtatttattccatcaagtttactcatgttggagtacatattttatggcacactttctgtcggacaattagaaatgctgcttacaataaggagctataaatttcaccaggtattgaaatgttaatgtttttagaaatcatctgctcatagctgaaccatgacaattctactcaaaggagagctgccatcctcaaatacgtaaatctattcttaaagacttcttttaatcctcacaataaaatgtgtatggagaaatcaccctcagaagatattagaaacaaaacatgaagtatgatggaaataatgcaagtgccaacaaggtttaaaacaaattaaaaactttagatggctcaataataaaatataagtgtaacttaacattagtacttctaagactttttgcaaatgttaagtggtacgaagaaagtttctccttttgaaatgattacagattaacttttctcaaaatctctttctttttttgtgacaaaatcctgctctgttgcccaggatggagtgcaatggcatgatctcagctcactgcaacctctgcctccctgactcaagcaattcttctgtttcagcctcccgagtggctgggactacaggctcatgtgcccacgtctggctaattttttttgtatttttagtatagatggggtttcaccatattggtcaagctgatcttgaactcctgacctcagggtgatccacccacctcagcctcccaaagtactgggacttaaatgaatatttgaaataacagcaataacaaaatctatatttgatttatcaggagagatccgaaatcatagaattagcaaaagctaatatttattgtgtcctgtggtagaaatcaggcatattatgaggcaaaaagctcagatcactattagataaacatgttttatgcatatttgggaacatccctctaatattacatggtcttaacacttaaccctctctgataagtaaatttgcaaaaacaatatattttaaaattgtaatgtaattccagatttaccacagatattgctgtggtagcatttatgcataaccttctaatgaggcttcagtgtctgaggtttaggaaatatctcattcgaaaactgcagggccttaggatttttgccaagtaagttttgtattagcaatgcttccattgattgagagagagaagaggaaaaaaggatggaaaaatatgagcctttttctccctcctcatttatttaaaaactgtgagttacacattttaatctttttacaaaagttagtttacttttgcccttatttcaccataatatttccagattttaaatataaatgagaaaaaaatgccttttgtcttaggaggtaaaagacaaaattttttttgtctcactctccctattgtttttattaaatcaaaatgacatattcctaaatgctgtaagtatttaataagactcttatttgttatatattgatttttttaaaaaatagacataagacttctgtttgtatttaacagtttgctttttccctctcgttttaatattttattttatttatgtatttatttattcttttttgagaccaagtcttgctctgtcgcccaggtgggaatgcagtggtgagatctcagctccctacaaaatccgcctcctgggttcaagcgattctatagctgggattacaggcatgtgccacaatgcccagctaattttggcatttttagtagagacggggtttcaccatgttggccaggctggtcttgaactcctgacctcaagtaatccgactgccttggccttcaaaagtgctgggattacaggtgtgagccaccgtgcccagccggttttaattttgtaattacataagaatgtctcattcatgacatgtatgcatatttcttggtagaacacaatgtattttgagctggaatttagataacattttctgaactttatagggaagagatggaggcagagcagagcacatattgttttctaagtgctttaaaatatcttatttttgtatgttggtattttatatttattatcatcttcattttacagttgaggaaactgagacaaagggaggttaaggaagttttccaaagtcacacaattggcaagggatacatcaattccagaatccaggtttctacatgacagtatataaagcagtatgataaacatttcatttgattctgttctataagttattcagatactattgtatccttttatacatgatccaagatacagattttgtgtgttttttttctgagtttacatatgtagtcagatggggcaacaaacctagaatctccaggttttgaagtcttgaaccgtgcaattattgcacatgaaaaaaaaaatactaagctaagacccatagaaagcatggagtataaaagagtaaaaggattttcctagcatgaaggtagcttccaccaatacaagaagtacagacattagggcatgtttggaaaagcagatagtccaattgtttggaaaccctcagtggggaaaaactgaagccatggtgtgtgctttgtgcacaagaaaatcagggataaagtgaaagttaagatcaaatacattagagcagctgagcattattagggtgaacttgacaagtcatttcaagtctccgtgtctcagtttttctatctggaaattggggaacatcatgtgataactcatgagattttaatgtttattaaatatgttattacttgtaaagtgcttaaaatagtacctcatatagcctcatatagtaggtactcactgtgcatgtgtgttgtgtttaaacaaatagtccgtaatttgaacatctgaagaatttcaagaataacaatctgtggaataaagttgagttttaaaattagaggatttcattggatattattatgaagaagacaaccccagggataattaaattagcgctcccgaaagcctcacaccctcattatttgttgttttgaagagtaaaaatggtacaactttactttcttgggccctattactagggaacataaaggaagcctgacaaagggagaatggaatcattaaatggagaaatttctatataaaaattaggcattcatcatctatcattttgtaggaaatagagtacttttgcaaagttttaaccagggaaatgatataaacaattgtaacatttattgagcacttaatatatgcttggcactactgtaagtgttttactagtactaactcatttaattctcaaacaacaaaattatgtcacacagcaaacaaatataaatccaggagttctgactcaaaagaatgaactctgaatcactcttttgagagagaaagccagcactctgtgtaggatggagtaaaatggaaatgaatagaaacagagggagcagaaaacaaattcaagttgaattattaagaaatgtaatagctatcaattacattaaattattagacacctatgtaactcatcactattagtcattcacatatttgctaattttagcaatggaaatgatctgatttagttatgtgctttagatagcctctgtgagtcatatattttagagacagaaaaaactgtggagaaatcctagtttaattctgttttcaacagaaaaagaaatagataattattttttctcctatcatagttcccttcccagtttcactgagctttattttataagctggctaatcaaaataaccacagaattcaaaccttgctgctttctataaattattacagtatgcaaagtgaaaagcatgagttcaagtcaccactatatgtttatggagcatttttgaaatattggattaagctatttcacaaatcattcacagatctgtagccaatggatagggatgtaacagccagatgctctgggaggaagatacaaagatgaaactataagagctttataggagaaatatttgtgaaggataaaaggcagatggagctgagccaggcaagcagaacctcagactgagatgtaggtctgtcatttataaaggcaaggagggaaagaagaaagagttgaggaggggaagccccagacagcagtgcagctctgagggttttggccaagccgatggggagtttcagagcacagatcacccatttgaggagtgttgcattgggcagggatggccaggctccagtaaccctttgccagtactgttaagtcactaaggggtacataacctgtgcttgaaggctgtagctgaaggtgctgcagctggaggctgtctgctgactgtactctctgcagcaggaacatctgagcaagcactcctgtgactgccatagaggtataaacaatagtttgctggtagtaaagagtaaagggcttacaacagtttatattatgagtgtgccatcctgccacactctgagcacttttcttcagatgctgctcacaggaaactcctaacaacctatctgtcacgtttcttttcttgcattatttaactaaccctaaaaccacatattttagagaaaatcttccaaacttagatttgttcaggctgaagatgatatgttggctcctggggaggtgatagtattcagataactaaaatctgctcttcttttgagtcctgaggtattcatgtacttaatcagcatttaccgcaagaacaacatatgcaaataagagcataaaagaggctgttccaggaattgtgtgtattttaaaatatctagagattaggatgcttatggagtttgtaggagatgtggctggggatttaaacatgaaacagattctaaatggcttttacacgctctgctatgaaatttgcatcttatcctgaaagttataaagagccaaaattttcctatgcaaaacttttatgcataggaatgacatggtcaaattcatggtttagaaggaatattctgaaagataaaatgtgtggaaagcatacaaatagagaccaaattaggaatttctaattataattcagaagataaatgaagacttaaactaggatatttaagagtgtttggtgattaactggaggcagaatgattaggagatggagaggagaaggttattttatatttatggtctagattcttgctcctcaaaatgttgtggtctggaatcagcagaatcagcactgcctgtgtgttcataagaaatatacaatctcattccccactccggaatgactgaatctgaaactgcttttccagagattcttgagtggtttttgtgaacattaaagtttgagaagcattggtctgggtcaagagtcagtaaacttttttctgtaataggccagataataaatattttaggctttgtgcacatcattctctattgctgctactcaacttgcccattctagcataaaatcagtcatagacaatatacaaattaatgaatgattgtggctatattccaataaaattgtatttatagacagcaaaatttgaatttcctagatttagaattttcacatgtcatgaaatctcattcttttgactttttacaactgttaaaagaaatgtgaaaccattctaagctcgtgagctgtacaaaaacaggggacgggcaagatttggctcctgggcttttttgccaaccatttgtctaggtgaataaatgggccatttataaaggtaggaaatagagggacagtttgttggtggtatgtgttgaggtccatgtattatatcacttttcaaatgaatatggatattggagttaaaacaagcttaattagaaagctttttataattgtatgctgagaaatcttcctctcttctctaagatcctcccataacttctggttcattcaacgagttttttgccattgaggacagagaaacccagtacagcatattttggacaggagacatttaaataatgtttgattgatgtcattgaaacaaagtatgtacccatattaattaggtagaaatttcaagcaaaattatgggaaatgtctatttttttaaacattaagtaaagaatactttcaacattgtatcagacattaagccatacttcaggtaaaagtagaacacatattaattaattaatgaatcaatcaactgttccatgtagatgttagtcatgattataatacctgttcttattttttctcttcaacctcacagctttctccatctctggtgaaagtagccaagtggtcatgatcgccatttcagcggcagtagcaattattctcctcactgttgtcatctatgttttgattgggaggtgagttcacagtctgtttcactattcactttctttgttgctttgtttgctgccactgattgctgttaaaatgtgaagagtgtgctcaataaaatattttaacaaataagaatgtctccacttgtagtttaggtcctctctttctcctccttttctttgtttctccatccttagttttgattttctgctctacattaaattcctgtccccactcttttaacatacacccctcctcttctctcttctgacactactcctagtttttactttctttctctaattatctcctcactcttcaaataaccccagatttccttgacactttctcacccagaacaggggtaacactgcacagcactaatcattacccatagagactttacccttcattccttctaacagaagttgttaaaaaatactataaacacattctaaagccattataaaaactgaactggagggtctgcacagtgggaagcaactctgtgtatctcctcattaggcagctttccagggttcccagagagaggggctttcttcagaggattttgaaaatatgaagttattaaactttcactaaagcatttaattgtttgaggaaaatgttttatttttatgctttgcacattctgagcataggtaactattttaaatatattcctcttatgtgttcgctttccttgatttacctccaggttctgtggctataagtcaaaacatggggcagatgaaaaaagacttcattttggcaatgggcattgtaagtttctaaacttggctttttgttttgcttcaccgttttagctttagcagttattgatttacaattggttaacttcctcctgacaaagagacttcaaaagtagttttatggaaaaactgagtacattaaatttattttagaaaaagagggaaattcatggttctgcattaaataatttttacatgtgtacatttcagcatacttaagctaaaataaagggtaatctgtggtttacattcaaataacgcacatgctaggtagtagaaactagtctgctctgcatggctgaaatgcaaagcgtatcttcaatttccttattactagtcctttgctaaactctaaataggagacttttctctttcctaactgccaagtaaatataaacaacctctgtttatttgaagtgccttatcccattttatcaaccaacctagaaagagcctttaaaataaactgtttattttgcagttacatgatatccaactagtagtaaagccagaactttctctccacattttaatttacccttttaattttttttaaatacacatttcagaaacaaagtgtttacaactaacaaaaagactttttttctttttctggtgaaacgaatcattccaggtgttttgcgttccaaactatggctcagcttagtgtggcaattactaatcagtagcttaaatagcatgttctcatggaaattagtacaaagactgtactcatgcttatgtgctccaaaataatctcaatataactaatgtagtcttgtaagcattaatttttttagtattcactattgccttctaaaattatttgcaaattgacatgatactttgtatcagccgttggattatcatctaaaaatgatagctttagttgtaactcaagtaaaaaacttgactacctgttgctaacctgcaggaagcatacagtagcttgaaaataatgcctttcaaaatataaattgatatgagaagaaagcagtataggagtttgaagaagcattattttgttcatccaattgcagcgtctataaaataattcacacaaaaaagccaaagtactacattcctaaaatcaacatcacatcagtccagattaattaggtgaccaactcaaaagtctaaaaagaatgcctgaacaagttacaggatccttgtctttctttttctcaatgggcccacaaaacactagtgttacaatttttatgcataaattagagcagtggcattcttgtggattaagtcaccctcaatttgacttggacaattgtaaatatcatctttagagcaagaccatgctgatttgattttttttttatgggaagcctacatcttacgaattttgagctttggtaaatttctgtgtgccaattattaaacaggttcctctatcgtcccagtctgttttgctattgtttttatggtggatttttgttgaaactttaatttttttcaaatgcacaatatccttatgacaaacaaaagagaaatgcatttcatcctggctgcaaaggcataaagtaacttatatgcatgtcataaactttctgcatcttaatactacagctggtttatttcagaccttttatttggtattactttaaaaagctctagctacgaactgttccctacagccttgttacaaatcctataatattgcttcaaaaggaaagaaatgtgtttcacctcctaagatcctgtccccttgccctttctggctgggcctttttacttctttgctatccttagggcaactcatgctggtaaaatggaaatgtaaattattgtgtttgcacagaatgagctgtaaagtagtgcagcttaacacgtgtgcatgtgtttattacctggttttcatgacagagcccagttactctgtatgttgcccttaattattggtgtgaagggattatgtgcctcgcagcctgaatcacctgattcctggaatctctggggtcagcagttaaagatcagcagccagtgcttctacagcgaacagaccattttacttgggggtgtatatgtttatgtttgtttttttcccccaaatgtcttatggatggaaaagaaattcaccttattttaattaatagaaattaataggattcattttatttgggaatggttatttaattttcaaattatttagtaatagtagtattgcatataggtatccatcatacatatattctctacaagctgactggtacttaagggtaaatctaaatcacacaatttcaagtctgtttaaggccaatgcttatttaaaatatgtgagacattgttcctaacaactcattttataatctttgtaaattctgatggcaggaaatctcccccacgttaatttccttaacttcagcaaagtaaaggagttataattatgtacaaaacagttccattttaccttatgcttaaagtatcattttatttccttgaaaaagattgctagatttctttaccttactgttactaagtaaaggcaaataaaaactggaagatcacacattatagggttgatctgatatgagttttcatccttaaaatgtaactaaattgactaaatgaaaagactccaacaagattttatttcctaacatattttagtaatggttacttacttttacaatttttcttactccacatctagaaaagtatgatagcttttccttaatcttaaagaagtttcttcttttaaaggtaaagggttttagtactggtaatgttagaagttattttaatgtaacaataaagcacaacagattactgtattaaagggtgactctcccatctgtatttataggaaggattcatgcttatatggaagaagcatataagctgatctgtgagctcaaaagtaatggacatttctaagtctaaattctaccattaggaaacatcaattatattaataattgtaaataaatgttcttaacaataaaaacgctcattagggcaatgagctctatcaatacattgagtgagaactatgcaacagtttctcatgctaggcatttgaatagtatagctttttttttttctcagagccctagcttgtcttttttgccaagatattcaagatgaaaaactctaaaagtgaagttctcacttcaacagctactccactcagagtttgtccaaagcaagggacagaacttgtatttccccatttctgtggatattgacttctagatagtggtgtcctttcaaattatccacacctcgcctcaagctggatagcagctgctcttttgttgtagctgtatcagcaccaggcagaagtaggagtcgtgttagcttttcttctgcattccctatttgccctctcaccaccatccctgctttctattatgctgtgtcaaagtcatgcaaataatagctgaggaaaatagagtttttacccaacctctctctcagccaccatttcttttacaacagtttattctcacacttacgtttttttactcaaaatctctatgaaagcttcacaagaacataaatcgtaatgcattataaccatgggtttcatgaagttgtcttgtagttcaaagaattgatcatttgttaacacatactgtgaaatcctagacttgttggcctaatgttcattgtactgaggcttcccagaaaaactgcgggcatctgcagtctccacaactatttaatacaaactacaaaactaactcaaagaaacgattggttcacgcagggtgttcaattgcaactttcccataattctcccattatgaagtaatattggaaacagtaatatctgatttcatttgttataatttaatgtaatgaatgaaaatatatttcactattaagtatccatattctgtgctaaaacacactattaagtatccatattctgtgctatgaatgttatcaaaattaaaagcaaaatcagtagtcttagcagatataccataggagttacattgcaatttcctttaattttagatcatatttatatagtttagtagatcttagaatcacttttttaaaactcagggtttttgtttagagaaagttaatttattgaaaattgcaaattgtctccactgttatttttccaaattataggaatcttattaatattaaatcaaattaaaatgattatcctgtatcagttgtctgtaatattttaactacaggatatgaacatttttaccttcagaataatttaatgaataaatataatatgaaggagatttttatttaataaattacatatatgacttacgtttggaacttagctccttagcgccattattcaactcatagacaatatttattttacttctaattatgttataaagctatacaatatgattatatttaactgatactatattggtgtgtatacatgtatgtattatatatacacaccaatataatatataatacatacatgtatacacatactaacagcttaaagtagatttgtaattacagtgggacattttgattgtgaatgttaatataagcagtacagtgtcagaaggtatgccattatatatcatttaatttatctataattgcagccattatctcaccttataattgtattgaattattttccaatcttgcattgtaatacatatctggttattataacatttgtgtaatcataaatatgcaatagcataatggtgttcactcactgttgctcctggtagtaatgactaggtctaatcagttctgaattatctttcttcttaagatccccttttttgagtatgcattttccttctgatgtttttgcaaagaaagctcctcattgtggttcctttatataattcatcatagagaacatgttttcttaaatttttcaacacagtccaatgtcactgccagtttctgtgatactacagaataaactgaaggttgtgcaccttatggggtagggatttttttaaaccaataatgccataaaatttgatctataattgtttgtacaaatctagctacaattgcgcctttctttctttcctcaaacagtaaaacttccaggtctcaggacttatgttgacccacatacatatgaagaccctacccaagctgttcatgagtttgccaaggaattggatgccaccaacatatccattgataaagttgttggagcaggtaaccacaatgaccctactgccaacttagtactgtatgtgaatcacgattgctcagtctctgaaacctaagtatattgctaaagaaatgggaattttctgatttcatgatcaaaggcaagtaataaataagtgcaatatttaatggaatgtaatgagttcaaaggtgccagacttaccggctcacagaccatggctgcttttgatttattaaatttctgatgtgacagcagcaacaactcaatcttcccatagctgtgctgatcgtgtgtcacaaaacctatttggctaaataaggataactggataaaagtctatttcaatttagacaacccaggtaatttgaagttttcattttcaattttagaatcatgtttggaattaaaagaacaaacaacacaaagtaatatcatgactcatcttacataaattttatcacaactatcttgggtggatattttaaataatataaggtgctccattttaatgcttgcttgactttgaatagtcttatgtgttaaagctttttttaataaatatacctttgttctaattattaatttaaacaatgataaatttgttaacaatcacctattaagtggttaataacagttgcatatttataagaaaaatttcatatatttgtaaaataacagtattttatatatttacacataaacacatgatatgtgcagtatgcatggaagtaaaactactattcaaaagtaaaaatgaaccatgctcaacaataaaaaattttgtaccatcatctaatccttcaatgtcactccccaaagcaaacataaactagttatgttgatacaggaattctctgtgtaacatcagatcacattttctgcaagtaccgtatttacatatttatgagtgatgtgtctttacaaaaatgtacatgtaatgctttgtttctttttctatacaccaaagtagtactgaaaaatcaagcagtagttagtatgcgaacaggacaatcttgtaaatataatgttaatttactagagcttctcttctaattatcttaatttcttatcctaaaatttacatgtgcaggtaatattaaaatatgaaacttgtgttcatagaaagaaaatggagtagtaacttcttttttacaatctaagacttgagagtaaacatattcgctgtacatctgtgctgatccagtgccaaaacagatatatattgtttactctgtttcatttcttcagtcctgacttctgaacagctccatgatgcagaagggtttagtctggctggttttaatgtttcctcacaagagtgcacttttctccagcacggagcctgcggtagcaaatgcagcacgaggactttgaacactcaactggagaatatgttgagaggaggaaaaggttacttatgctaagccactgtccaaaagccaggcagacattattatgatgttgaaatttaggtacctctccactgataaaatatctttatatagttattattgacagactcagatatacagaacatagtgatttgggaaaaagcacaccactgaaaatagcagctgataaatgagataaggggaggtctatttatactgaatcacttaatccctgatgctcattaaagattagaatagagcctccttcctatttctgtcttcaagtatatatgttaatgattagatatatgcccatgttcagggttttgcagccaatattcacatttgccatgttaagaacaacaaaactgtacttatttgcaaataggtataccttcaaggttagttatacttttcctgaaataattcaatacaatatacacacccaattctagactgccttgatgacctttcagagggtttgtatttaccaagttagaaaatgaaattattattcctaaaagctaacaatttgttaaacattttgttttgtaaaatgtaaaatatgtacacaaataaattaaatagtgtaataataaataaacctgtatgttactcatttctaaaatagcttttataacaatgaacaaatggcaaccttggttggtatatacatttacctacttcctacattcttaatcttaaaaaaaatatgttatttataaaaatttaataattattctaaattgattaccaactggcttccattgttagaaaggcaaacctttcagccaactacataactttcagagtcaattaaatttacagaaagaatatatatatatatatatatatataagctaattctcttaaatttctgtcagaaattttacataaatgaattgatgttatggaaactctcttgtatacattggactatagaaagaattatacttatactataaatgataaaattaagacatatgaattagcttcccacagtagtagattactagaagtgaggaattcatgactacaattcctaattttactcctcaatccaaccattctttcaacgattgaatactaaaaatttctgaagaaagtaaatacttagtaagtccttaatttatcctgtgcattcccatgatatttaattttattatcctttttagataggtattattatctccatttcagcacgtgaataaacaaaagctgagaatttgaatagacttgtttggatcaaatgaaaaaccaaaatttgaatcttatactttccaaatttaaagcccatgctggacactggagatcatagtagtgtcttcttcatagtatttttttttgaggattaaacaagataagttgtgcaggggacttagctgacacagaagcattgttcaatatgtgtttttattatgcttactttatgaaaacagtagaaggagggtaggctttaaagctagtgttggagggagtcattctatttaaatgtcggctttttttaattgtttaaatgaaattagcataagaaattttattttgagcagcttttacattgtgcattttaatcagaatacagtccccattcttataaatatacctatttcaaagagcaaataaaattgccgcacttattagaattaaaaaatcaagatctggcagccatgcttttatctagaaatgacaagatctgaatttttgtttcatatgggtgcaaagttaattgaataagacaatataaaacttggccagatgaaactattgcaaattgcatttgcccagtctttgttaacttttacaatacagttcttttattttttatttttaatctttttctatttttagcagctttattgagatacaatttaccaaccataaagttcagctatttaagtatacaattcagtgatttttagtatattttcagagttgtaataaccataattgctatcccaatgcagttattttaaattattaaaaatataattgaattaatattaagcatttctatgtcttttataatatattggcggctatttctagtgtttatctgatgaaataatcacattactaaatgtggggaattttaaaaactagcattgctgaaacacaattttcatgaatttcgaaggtaaatatatacatgtacatgtttatgtgtccaggtgtcccacttacaacaaagaacactcttaattggctcatttaaaatttgaactcctacttttcatatctctagtatgctatcctttacaaatatatgtccagtaagacatgagccttgttatcgccatcattaccataaccatctcttacattaacatagaatttggcattttataaagcactttcatattcatttgtcagtttgatttaaacagaaactcttaaagggtagttaggcaatttatcctttaggtgggtctgaactcagagagataaatagtgaccaacacttagatgtcacctactgtgtgtctggcactgtttcaagtacttaacatacattagttcctttaatcccacaacagctttatgaggtagatacaataagtgtcccccatagagataggaaaagataggtacagagaggttaagttacttaaaatcacacagctaatatgtggcagagtcagaattggacccgaagcaattcggctgcaggatccatgctcttaaccagagttctgtactatcactcctgtaaactgacaagtgacatgtcacttagaatatgtgatgatgacatctacatttaaaacatgctctattataccatgttgatgtatgataatggcagaactttctggttttcccaagcttagtgtttacacaaagtgaaacaaagtaaatgggagcgctctgataatgttcggataaccctatatgaggaaagaaactcttactcttgtttacaattctgagaataattttatcacaccataacttctctttctcctaatattctcatatctaaatggcatattcttccttcgaattagcaagatcaatgaactttctcaagttctactccctgattctttctgtatcctaaggaacactatagctgtagatatcattatcttctctacacttcctcaaagggaataaactagtcctgtcttgtttaccattatatctatctctgtgtgttttatactgtatgcaatacagttgctattatgaatatttattaaataaatgcatgaatatctgcttttggattttaagtgactttgccaaattaaagcataagtcattgctttgaaaacagggcaagagtggatttctggggatgagtcaagcctggggaaggttaaagcttcccagggagagagacaccatttgtagtaatgtagctggcaaatcaataggacaacctgctacttttgtggttcaaaccacttgcttgaaaacaaaaatagagaagaatcatatcacttcaatctgactgacacgtagggcatgaagctcatagaaaattcacagagagaaaattggaccaagattatgattccactccatcaagagccaaaaattaatcatataattaattctaaaatatttcaagaaaagctcatttgacattaaaaactatttttaatgtgatgcaaaacatatctgataatccacactatgttagaagttcttctgtgaacaaaggacattctatagaactcccatgtggcaatcatcatggcagcatgggtacagataaataaatgtaaagggtatctgctctaagtgagctccaaatgtaatgaattgatgattagtaaatctctcagtaaaaatgtattttgaaggtagtgtccatactagttctaggcagttttatatcaactggactataatatttaaaagtcagtaacactctatatgggacaaattctggattaattgcacattgaagacttttttttttaaattgaagaagatgaatctaaaatatttctacagtatttagataaggcatgttgtttttatttgatactgttatattgttgttgtcctccagaagcccagagacttttatagctggtatgtcagtaaagcaacacaccaatactccaataaaataaattgatagcagatgctttccttctcatttttagagtctgaatatatagccatattggccctcggtaaaaacagaattgttaaaatatctgaaatttaatccaatgctcacatttaatcactgttggtgctgtcctgttaatttctctgaggtaatggtagctatgacaacaaggggtaaaaaatctaacatatgcagctttcaacttatctctccttttacattacattatttatagtgtcgtactttaaagtatatggaattttcacaaggttcattttccaacagggggtgactatcctgaggttttctaggcagtttcatatgattatctttcaaaataatttggagtactagagtgtacatcttgcaggtcaaaggcacaaatattttaaatggaaattttgaaataaaacagttgctctctactgatgaatttttattatagaattccttacattttgttgctgttctgctttataacaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagtaaagtagtcataagacctgtgtttccgtatgttgagcaaaggttgtttaaacccaaccccaaccatttaagaattttggctttttttcataagtatctcagttttaccaaaaagaaaagtttaggaatagcatgcctttctttgacagtagagcagacctttaaataatattctattgacagtactgttttagacctcaaaaaattttaaaaaaatactagaagccacatattagaccatttaaaggtacgctgattagcagacagttaagagaagaattgtggggaattctcggctatgtaagtagcaaagaaaaacaatgactcaagcttgacaggaactcccagctagctgccttttcttttattgttcatcagttttatttaaaagttacaaatctttaacctcctcccaccccctgcatccctgcctttaggaaaattttgggagtctaggaaatgcttctgagctgtacagattggaatcacaatagacccaaggccgtttcttggttctctgtggattttaaatagttctgatctagaaacccaggtggattcttactgctctgtggaagctctggctcacagcccatgatagagatgtgaacttatttccatgatggtttctccagcaggtctcaaaagggatcctgtgaggcggatctgtgatttttggctccaatccctatataagtctcttgagaatactctgggacatttttcctcaagattttggagctcaggatgaagaataagtgaaattggcagcaaactttttagagtgaaagacaacatatggcagggaatttggcatcctttaggggataattcattggcaccacatttacatactctatcgttaccaacagacatatttttcataattatatttctctttaccattttatagagcattttccaaatggcactaatacttattctcactttagcatgactaaaaaggcatttccttcctcatgagagcatggtttaattgaaatagactttgatttccttttgagttttcatatataaaaagtggaattaagaatttaacaatgtggaatagttcaacatacattgtaagtccatattaattcttataaggctttttatttgtttgcctatgtactctacaaaaccaggccttattaatagaaatattttctgataaaaaacatttttaaattttaagttaataattaataaaaatgggcataattagtaaggattgggaaagtgtatgaatcctttgttctttctgagcaaggctatactgttttatgtctgtacagttacagtatcatgtctcattgggattttagtgtcatttagccatttaatgttctccattacatctgcatcaagtggtggttgccttttagctcttgagcctcctgggaagagaaaactcccttgtacttatgaagccattcttctaactctcaatttttacaagtttttcattatgaagtatctgttatgtgcccacattatactatgacattatttcattcttaccactaccctgtgaattagacatgataatttctctcttacatttgaacaaacaataactgtaaagggtaattagcttgtataactagaaaatgctagaggtagcactgggaacttgttctgttcatttcaccccatccccaactctgaacccaaacaggtttctacttgtcttttcctgtattctacttattcttttatatcgttactttaaaaatcttctctaacatagtgagacattcctcaatcttcaaaaatttctggaactattaataatccttaatatctaaaacaaaatataaactctcaaagagggcaaaaacccatgttatttgatgacaagtgactaaaataaatcctggatcataatagatacttaatttaccaatgttgaaaaattaaaaaaaatattgatgaaggaaggaaggaagaaagaaaagaaggaaggaagggaggacacaacaatatcttttaacaataggtctttctttagtatttgattcattaaattgaatacacttttcaaaggagtgcatttaaataactacttctatcacccagagagtgatgaaaaaaaatgattactttttagcttgaatagaatcataatctaacttcttcaacatgtgtaattaagaaaaaaatgagctaagagtcactatcacacaaatattaggttctaatttaagcttactaataaactcactctattattttgtcagtcatgagttgatttttttgtttcagtgttatgaattatgaaagctactccttatattttcctgtttcctataaatgcatttactggatgataagcaacattaaactataaatgttgtggcaaatttcctttagatataaaactgaaacaattaaatatagattatggtagactgacaaatctatgaaacaatctctaagacaaaaaatgtagaaaaatgcactaaaatgacttttaaaaattgcaggtattatatattaaacatcttactcaaaccgactctgtaacattctaatatggattacaactgccttattcttagggtgagagttctaaatttgatatatctccctggtcaaataagcatgtaagaagctgccaaatctgactatataaatcccagtcatctcatatattgtaaatataatagagtagtagccctagaattagattttgaactccttggtggcatatttataagctcttagtctggcacccggtaacatctgagaggaaatagaaactccttacaataaagttgatatgttgtatttaacacacacacacacacacacacacacacacacacacacacagagcgattgtgtttccaaaagaagctatttattctactgctattattgtctttgtttcctgagatttctaaaacaatccacctgcagagatcagaaagcacatctatacatgcacacatgcacacacacacacacaactagagtgatgcagagcttataatttaatgaacaaaataatattttcaaaagcaggcatatcagtatctagattaataatcaatgatctgagttcaagttctgaaacaaccttactcctctgagaactcctacaaatcagacaattcacacataattcatttcttcgcttgtaacaaaattaaacagtactactttactatttttagatactaaagatcaaatgagattacataagaatatattaagtggcaaagaactgtgcaaatctaaattactcctctggttgtttgagattttaccaatcaatttgggtgtatagaaaaaaattcttgaaaataattctttttttgctcaaagataaatctgtttattattgttattcgattgtgtgctttgaaacactaggtcaaatacaatgtatcattttcaaatcatttgaagaaaacttttcttaaagctttttattcagtcattgtattttcatttagccacaaacaattttaatgtttttgagcctgatggtcttaaacaggagaaggtgagagagtctctgatcttcaaagtagcagaaagcggggggcacaggctctgctcacaacaaggtactaacatgtgttatcaattttagctgaagttcaaaaggatagaacttgttcttagcaaatgtttgatatttctgccatcacaccattagtcaaataatgttcagactccaagaacaccttccattggccacttttcacctagcgaaatagaaggaattatattggatgagattaatgtattttgtcttgcattattttcaggaaattttaaaaaattaccatgtaacttaagtgtaactttgcattattgaggaatgtcatgggcagaacgttaagatgattttcataattaaaacttatctgtagtggcatgagtatccactttcactaaaagcttagccattggcttccagttgcctgtttccctgcatgtacggtaaggacacatttctggaataagaggtcatcatttagtaacaatgccaaattctagttattttctgtttgtttctctctaaaaatattctaaatttgtcttaagtgtactacacttcatgtcatcttaaaagacaatacatacgttgtacttactatactagtaatttacagagatagtttgttaggataacaaattttggaaactctaatgacccaagttttatcatggattcatggctgcaaattgttaaaatgagttcagaacatgtctgtctaagtaaccacatcaacaaaattaaaaaatcactgctcgatatattagaaaaatataagacagggaatgttatttttacatatttaaacagcttttgttacttcttcatcactgtccacttatgtcccttggatgaataggccattttgacttatagaaaagtgtggtattgtgtatttttctcatttatatgtataggatggttttctgatatttttgaaaaattaagatcaacttacaaaatttgttagagcacgatttgtgtgtgcccaaagacaccatttctagagcactggtttacatatacagtaaatctcctagagaaagaagaaatatgatgaagcactagtttagtagctgtctgaataactgtggtcttacacaacctttgcagaaagggaaaaaaagtatcacctctaaatgccgaggctagtaatatcttgataccaaactatacagctattatcagaaagtataataacattattgtaatgcataaacaaaaatttaataacactagaataattgtgaagccatatctgaaagtgtatcaaaaaagatactacaccatttcccaagtgtagtttattccaagtatgaaaagttggttttgtatttaacaattctaaaaactcataacattaataggtaataagaaagttctatcttaataaatgcaaaaaataaactattttaattttaattttttattagcacatcatacatagaaaatatgtattcctgataaaggtatgtaaacagcccccaaacaaacacaaacaaacccacaaatgtcacatttaatagtaaaactttaaaagcatttcttttcgagagaaaacaaaaagcctgttgttattattatttcaattcaatattgtacaggaaatcttaaacctttttttttgacttttacaaataaatcagctcctttatttgcattattttgagcactctgataatgacagtcttcactgatatttttgaaatcctgttttttgttaaataagcttttccaattaggcaagcaaataaataaaagaaagcttggaaaggagaaaaaaacaaaactttttatgaaatcaaacaacatattaagagtattatatacattcattccacttactgtatgccttacattattgtgcttactgcatgactcagctctaactagcataatggacagtaaattagttgttatctttgaagatgttaaatttcgtttcaagttaagcataaataaatataaatatttttcaagcagctgaaagtaaagcattctatgtgttaggattgatagagtagggttggttaaggaagtcttggagaaagtgtttctcatcctgattttgaagaaagaaattatctctagccagtctgaaattatagacctaatttgatcaattgtaactggcacagtggtaggtgttggatttagaactacagacaaatgggcttggtctttgctctcattaactcatagacgtaataggggtcatttccacacaataatgtcttgattaaaatggaatttggaagacgttgccctgtaattttataatgatttaataagaaacccacaaaaaaaaataccctaactcagctcaatatttcatttcaatatttcagttcaatattcattacaatatttttatcagttaggtatgatatgtgaaaatctatgatacattttttattctcatcaaagatgattcaaatcttctttcctggaaataggcaaattttgtcaatttttttcaactttccatctcccgttttttttttttttccttccatcctgacactgattatatagattgctagcggctaaggtcaaaggttttgattttataatataccctcattagagtgtgtttaatccttttgaaaataagacatagagtgttagacccaatgactgttgttaatagggagttaatagcatttccatttgaaattattaaatgtaaatatttaataatgtttcaatatctgataaacagtttgtttgaatgaaaatattttaatctgaaaaacaaagtttgttagaaaatttcaaagaaaatatctttatgactgactatatatgtatatatatatgcgtatgtatgtgtatatatttcacattattctactctataagaaatgtgattgagaaggttgtgttaaaatagctggtgctgaatctggaattcttagacattttgaatcatatttcttctgtcatcaagcggcgattcaatgactagtaatagctccgagccactggggatagttgggaaaaggaactgattataacagactgatttgcttccctttactttacaattgtgaaagatcatcattttatctaaactcataaatcaacttgagaacaaaagcaaaactccactgcaaattttgttttgctcatttttgatggtttcatttcagcaagtcatagaacagtactttcattgagtttagtatgtatacccagatgtgttttggggtttctgagagccgcaaatgatacaagctttgtctggaggaagacgatcatgtcatttgtaaatcaaaatacacctggaagagcatgcaaacttgagtacaaatacatggcataatgcgcagatgagctggcattttataaataatttcccaccacatttaatgcatgttggaactagttctcgccactacagaagtctctttttctttaaccctatttaccataatcaaaatcacaagggaaaccctaagtcaagatactgtttcccaaggtagaatatttgtaattctgtttactctttgtatatttgatttgcagaatctttgaacgtaatgcaaagcacattttcagacttgcccatcttaactgatgtgtttacaaatacctgaattctagagttaaatgcacgctgatgtgatttctgaatggtcatggggctttgacttaattgactggtttgatttttcagctacttttatttcccttcccaaacatcccactagacatgctaatgagaaatggtcataaggctgggagccagaaggaaaggagtgataagtaaaggtctgagtagtataaaaatgcagtaactggccaatgatattgagagttggtggtgtgaggcaaaatatctgtgactgcatttgaagtgtgcattgaattttggtaacatatcattcctcccagcactgtatgaaggaggaaagacagaaactgatggtgatttatagaaagtacacatatgcaggattttattcattcattcatttattcattcatttcatttcaggccaggcatctagaatcaaacagtctctagggaactgatactaattcaggagagatctaagtttccaaggaaatggtgaatcttccctttctttttgaatattgtttaatcaaagtttagttggaattttgataaagcaaattctgggggctcaaggttttgactgaagcaatttttcagatattactacattaactagatagatgttacatggtgccttaaagacataaatcagtgtcttaacggaaaatagatcaatgtatcaagtggttgtaacatgtataaaagttatctcaaaaactatagaatttaaatagatttttccttaataaataagacataattcctggaatatattcaaattactgaatgtaaaagtataaccttcatgatgctaactcataatttacattttgtacaaatcaaagagttttttacacatgaaaggaaaaaatcaagaaaaggaagttattttctagcatcagaatggcaaactaacctcatgataaataagacacataggaggaaaagttgtgttatacagttatgtgtacattaatgtttgtttaacatctgttatttgcttatgagttttcagcagtactcggttaatactcaactcacgtcttctggacttggaaaaggagtgattttccttcctgtaaaatgctggacttataactaaaatagtataagaataataaagtaagggaattacagtgtggtaatatgtataggttttgaaattagagacagtcgtgtttaaaattttcttgactgctatctaattgtattacctcaacaagttgcttaaacccacaatgttttctgggtaggaatcagtaaaatgggaataatgcatattgctaaagcataagtaagctgtgaggattaagtgatataacaaatgtcaagtacctaatgcaatgttacataattctaatcatgaaaaaaaaattaccagtatttcttttatatcaaagcatcctttttttggtatttttctttttaaaatgttagttttacataatcttcttaattgttaccataatgtatatagaattatattttcagctttgtataatattacgctgtaacaattgtctaaagtgcttaagtcttaaggtcatcattttaatttaaaatcatccatagctttaacatgcaataactgactaaatcattatctgtagtggaacatttgttatattcatagctctgtgtatccactatacttagcacctttgtgtctgatgctttttcatatgttacatttttccctcattatcagtttccgaaagtgacagcatagtgtgtacaggttgcaacttttagctttataacttgttagatgtatgatgaccagcaagttaattagcctctgtgtctcagttttctcatgtgtaaaatggaaataataatacttaatatgttaatatataaattaattacaccagcatcatgctcacaataagtactatttaaatacattaaaatgctgggttaaaggtttcatggtattttaggctacatatttgcaaactggttattacaagttactgccaatagcaattttaatttcagttttattttccatttaaacatagcattcatttcataatttttaagtgttaaacaaattttgtaaataattataactattattctgaattgttttgtagaactcgtgtagaatccataaaggcagaaattttgatctacttgctccccactaagcggcacaaaagagaacacctagcacagtgccctacacgtatatatgtgtgtgtgcacatatagcacatataaatacccatagaaagaataaataaatgttaaattcctaacattatcttgggcttggaggcagaaatatttggtgttgaagataagtgagaatttaattaaagagaggaaaggggcatattttttgtttacttgaaaggcctgtcaaaccaatttagatgctattggtcatgggcctttgttctggaaaccaatcttctccaatttttgtggtttttaaagttttattttctaatgaaacctagggctttttaaaatttttaaaaattagaagacaggcaaagttcttacatctctataatcctcaggtaaatccaactatattatatatgttcattgtataatacttgaactgtactgattattatttattatttactgtatatctaggtaagccagttatgattgtcacagaatacatggagaatggttccttggatagtttcctacgtgtaagtaagatgcacacacatacatatatatgaataaattgctgaaaacattagagacaccctccaatattgtgccaagcaattcagtaatctaagtttaaagtaaaactgaaatcttctgaggctaaatagacagagaagggctgtaaaattgcatctttttttgcagcattcaaatgttaatggtttatatttttaaaacaaatttgtgagttcttcttcaaaagactctttttatactgccaagattcacactcgttaaataaaaataaaaaagaatcctaaagcaagtaataaaacccactgatgtaagacagaaagtctcttttttaagtaatctcagtctgatataattatttaatcacagtctgatataagacagcccatctactttccaaacagtgctgtcagaaaataagcatgtgctataatgctaaagtatatatagttttaatttagatatatcattttgctgttagatatgtacattaattttttagattgagaagctttatacgtttatctatcatctatctatctatctatctatctatctatctatctatctatctatattttttgagatggagttttactcttgttgcccaggcaatggtgcaatggtgcaatggtgcaatggtgcaatggtgcaatggtgcaatcttggctcactgcaatccccgcctgctgggttcaagtgattttcctgcctcagccttccaaatagcagggattacaggcgcccaccatcatgcctggctagtttttgtatttttagtagaggtggtgtttcaccatgttggccaggctggtttagaacccctgacctcagatgatccgccctcctcagcctcccaaattgctaggattacaggcatgagccaccgcacctggccatattttgacatactatatttcaccataagaaagtgaatatattaaatttacatctatttcaacaaatgttatgttcaacaatttcatgaagttcaagacaataccaattaccagtcattgcaggcgataagaaaagacataggccctgtcctcaaggtgcttttgttgctatataaattgagatgggcagatgacagaaagatagatagataaatagataaagaaaatatgtagtatcattcataatcatggaggaaaattttaaattttctaagactgagaaaggatatgctttatattaaaatccattagccaaataaaaattttaatagcaattattttcataatcgttatttcaaaaataaacatttccaaaatcaggtgagttaaaatattatgataaatattctttcaaaattatcgtttgtaattaaacatggaattttatataaatacattatctatacattttaaaccttatgtttctattttaatccaagattaaattagattggaagctggattatgtgatttagtttcttattgctttctattttgtgactacaattcagaagtgggtagaaaaacaaatatccaataaatatttttgactaattatgaactaattatttatgataatgtttaaaaatgtagcatccaccttatttgaaacaattcataaaatatcaggaaacaaagaaggggaaatgaaaattcaatcaaacaaataaatatcaacctaaactagccacaagattcatttcacttttttgttcttaaccttaatgagtctgagcaggagttagtttttttgtcacataaggaccaggaaagtccttgcttttaaactgaagtcaaagaacgttaagatacttcctgttacaaagtatttgataacatagccagtgtgttattttgtttcagccttgtatccatttgccacatatctttgtcttgagtgcttaggactaaagtgtgtatagtcagtcttgttacaaaattcaatatgtgagattttaaccaataaagatatatctttaagaaataggaacgtatcttaattgtacatttgaaatgcttcccagaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagagtgagtaacttagattttctccttttttatcattgttttccatcttgtatcatgttgatttgtaaataagtagaaatcatgacccaaaacgtgttgtcaattatgctttccacaatagaaaacatatcttaaaattaaaatattattatttattctgggtaaatagatggtcactgtttaacatttaatgattttaactctgaaattctatacctcagtttaatgttccccaccaaaagcagcaagattctcacattcctcaaatcttgatatttttaaatgtacccatcttttcaccatggttgagtcaccctgagctagcagattggataaattctaaggaccttatcccagtacatatcattttaaagcactttcaaatcaattttttaataagtaatacctatttatactgtaaaaatgtcaaaacagacctataaagaaaagttgtccataattgtgccatccacagacaacatttataagattgtgagtcaattcttacaaatttttcttcatactcatatgtacaaacttgttcatgaatatattatttaaatacaattattcataatacaattgtatgccatttctctccttaccaatacacttcttgaatatatttcattgtcaataaataatctttaaatttttacatgtagtaggttgctgtattctatattgttgtatcttttttaaagcaaaccctaattagtgagcaaattattattatatttaatttttccatattttataccaatgtatgtgatctgcctgcattcataattgttatgagcctcatgattttctaatgatacattcctaaaaatgaatgttttgtgtcaaagattacgtgaatattttaaaagcacactttactacactcttgataaaactaggtattttcattaattttactattatcagttaggataaattgaatgtatatgttttaatttgcatccatttaattcaaaatgcatttgaattttttgtgagcttttctgttgttgttttgttttgtgtttgttttttgttttttaggcagggtctcactctgtcacccaggctggagtgcagtggcacaattacgactcattgtagcagcctcaaactcctggcctcaagtgattctcccgggctcaagtgatcctccctcctcagcctgctgagtagctgggattacaggcatggaccaccagccccagctaatttttaagtttttctttaaagaaaattatttccatggtagaaatttagaaaatatagataaaaaacaagtaaatgtctaataatcattactattaatactacacaaacataattattagcattttaaatttagcctttcgatttttttaaataaattttcacaaataaataactcctcttttggcataaagttacaaaaatgggattatactttatatactgatatataaaatgatttcaacataccgataatttaggcactttacttatatataaatcaatgccattttgttttctgccctgttttaacttaaaaatataaaatacataagtttccagatgattaaatatttttacaatattcaataatgtctaatactctattcatatacataatttaattaaataaagcactattaattgggcagaattacaatattttcatattatgagtgatactttgatgtcatgatatctattttgtgtctgtccatgattacctccttgggatatttctatagaattaacattacaggatcaaaacgtatacaagtatgtgagaatttttggcgtatatattgcccaattgtctttgctgtagtttgttatcaattttctctcctaatggcagtatctttctccatattctcatcagctaagagaataggtggttccaaagatggtagtcttctgctgtttcttattatctaattttaaaagtttattcccgattaaaaaaaaaagctcatcctatttgcaaatcactcgagaactccaataatcaaaattgtcacatggcatgcatatcatgctataataaagaacctaatatgccagatagcatttcatccacaagtaaagccgcaataatagaaccactgaataataatgacacaatgctgttgggatatttctagatgcattgatataggaggtaggactctcccaatggcttttaataataaacccttttgtttttccaattttcaaatatactctgtagtgcatttactttgttcatgaatctaaatttttttttaatctgagtattttttaaaaagtccttagacacttaaaatgtgtcctacataaaaatgttgttcttaacaaacacaattcaaatggataagagcatgacaaattaagacaaatttcttatcttgtagctagttgaattaaatttacaagtgactacaattatatagctctgaacatgatgaaattgccaaacatgggatcaatacctcaacagtgctttttagttctccttctctgatcaccagaaaaattagtcagccaatgtatctgcaacaaagcatcattttaataactgagctaccaattcagtagacactatatgcagcaagtgatacttaacagtcttagggaatgtatttcattctactcacttctactctttttctaaggctatccctcttaacctgtcatgacataagtacttctaagagtccatgaaaagtatcatgcttacttatattgtccgtgttacaacaatcatattatgccagaaaaatacttttaggttaaataaaaactatttgataaaaaaattatttgaaatgttaaatttctggttattcagtcaggttctaatttctatgccatattaaattatttatttatttatttatttattaatttttgagacagagcctcacgttgtctcccatgctggagtgcagtggcgcagtgtcggttcactgcaacctctgcctcccagattcaagcaactctcatgcctcagcctcacaagtagtttggataacagtggcttgccaccacgcctggctaatttttgtatttttagtacagacggggttactccatgttggccagtctagtctcaaactgctgatctcaggtgatccacctgcctcagcctctgaaagtgctgggattacaggcgtgagccactgttaccagccccatattaaattattatgtgagagcatctctgtccccataagtaggcttgattgccaggatactcaaaagaatagtttctctggcaggaattggaaacatttgtccaactttagatgattcatactctggagaacacagggggttaactctaaatgtttcctttacactgattgttgttttgtcagggcctctttagtgttagaagaaaagtgtcgtatggaaattgctctttaacatttctgaaataaaagtgaaacaggctctttgcatttctgttccagtcactgaagattcttaaaaacacactgaacaaataggctcattcaccaccaataaatagctgtttcgagttcttcagggttcatctttgtatttccttggaactccctcaaaatatccatgggagtcctggctttcttccgagaagctgtaatttgcatgtgcgtttctagagtaatttaaacatcattgatttaatctctcataataggccttattgagtacaataagtttatagtttactctaaatatgaggtatggttatgaagtaataagaagacttcaattttttaaaaaaacaaatataccaaacagctaaatgaggcagcattctaagttttccttttggaaataaatatatacttactccaggaatgctgatattgcacaaaatgttttgggaatttctcttttggaattatatttaaagctaaattataactgatgcattaatcaaacatttttaagcaggtagtattttgggatataggcttgactaagataaaatctggtctcgataagcagagtggggtggctcacgcctataatcttgacacttcgagaggccaaggcaggaggacctcttaagctcaggagtttgagaccagcctgggcaacatagcaagacttcatctctgttaaaaaatatatatatatataaatatatatttatatatataaataatatataatatatatacacttttatatataaatgctatatctatataaatactatatctatataaagtatatatatactatatagtatatataattttatatataaatacatctatatatatataaataaattatatatgttatatataaatactatatatatgtgtgtatatgtattaaaataatataggacaggtgcggtggctcatgcctgtaatcccagcactttgagaggctaaagcaggcagatcacctgaggtcagaagctcaagaccagcctggccaacatggtgaaaccccgtgtctactaaaaatacaaaaattagctgggtgtggtggtgtgcgcctgtaatcccagctacttgggaggctgaggcataagaactgcttgaacctgggaggcagaggttgcagcgaacggagattgtgccattgcactctagcctgggggacagagtgagaatccatctcaataataataataataattaattaataaaaataaaaacatatattaggcatggagacgctcacctgtggtcccaactactcaggaggctgaggtggaaagatcacttgagtccaggaggttgaagctgcagtgagctaaagcctggggatggagcaggaccctttttcaaaaaataaataaataataataaatttaaaaggaagaagaaaagaaaaagaaaaaatactattacatttttgtgtatatattgtctgtttgtcaacccaaagcaatatacccagcttagacatctgtcttgtttatttgatttagtgtgctctgattattgttatttcagaaaaacaagttcatcattcaaaacaatttgctgaggcattccttttggataagagatcctggttaatctgcattaaaaagtcagtcacattaataaagtttaacgcagttcatctagtgtctgaagtttctacaatttggagattaacatttggtgcctcaatgcaatgaccctttcctggttgctcctctgaaagttactgcctgtaggtagagcgtagttgcactgaagagtcatgaaggacatttgaatcaatgtcagtggaaaagaatactgaacatagaatgtctgtcgctcttgttttaaaacatctctgtgagtgacaggcagaatagaggaatgtatagaaattatataatctaattatgtatttaaaacttcttaaactttgaagagtatttgaggagttgaggaaacacctaagctcaaaacttaatttatcagacagtcaaagatattttctcacactgtgttctatactgtcttaggtgtatcacaagctttccttccttatgttctcgacagcatgccggatatgaaagggtcagctaagatagtactatacatttttatgtttattttctcttttacataaggatattgtgtaaggaatcagatttttttccccaatactcacttgttgttatttcttctcatttcttactgctgtgttacgcagaaattgcaaatgttgatattttccattatacaatgttattatgcatcctgtaaaactccactgtactctcatgggatgttcagaatgaataaggctatgaagtttcagtattattatgaaaatagtttctatcttgtggacccctaaaatgctcttggggacccacatacatgctcggatgacagattgaaagccactgttatagatactttactaggaaaaaagtcccttaataactaaatgaatatttttgccgttattcactgatataaatctaaattatggcatagttttatgtgatataatatattttaaagaagtagctttgaaagcagaactgcagctgcataccaaagtttgcaaatcatcttgaaagtccctggatttcgtttgggatggatatgattagaccatttagctccacaaatttaaatcatcaaagaagttttgtgtctgaaaaaaaaaacagaaaaattaattcctttcctctggtttctcatcatgtgactttgaaagtataattataacatgtttgttatatttttgccctggtctactaatttacttcattctaacagaatcatgacactattgtagaacagtttgccactgaatgatttttcaatttttgcttctatgaaattttatctttaactggttagtatttttgtatatatgcattcatgcatctatatagatgaatatttctatattcatatgttgaaatacatggaatccaaaattccaaaatggtagtgtttaattttctgttttatacaggatcaagttactgaaagcacagacttttatcttatttagatgctgggtaagccatcacttcaattcttcctatgtccttaagttcattttgggagcataattaccacataaactgagttggaaagtttgagaaaacaaattgaattgtccttggctatattctccattattcgatttttttcttttcatttctattctgaagttgcctacttagtaagtactaactagattttgttacaacattttattttacataataatttatttggctttttagatctgtgactctgccatattgatgccagatatattctatacaactttgttttgtttgatttcatttttgtttttttgttttgttttgttttgttttttttgagatggagtctcactctgtcgcccaggctggagtgcagtggtgggatctcggctcactgcaagctctgcctcccgggttcacgccattctcctgcctcagcctccggagtagctgggaccacaggggcccatcactacacccggctaatttttttttgtatttttagtagagacggggtttcaccatgttagccaggatggtctcgatctcctgacctcgtgatccgccagcctcggcctcccaaagtgctgggattacaggtgtgagccaccgtgcctggcctgtttgatttcattttaaggataaggcaaaaaaagaaaagtggctaagcaagtggttaaaagctaagaggttaaatatttcctttcaggtaactccaatctaagaacataaataacagaaaacaggagcctttgttctgtaacattttcaagaaccaaaaaaaccatgcttatcaaaattggtataatacaaaagacacatattaatttgataagtaatatatgtcgcatgtcatttatacctaaatgaaaaaggtaataacaaaatatctaatttgtgtccttcatatagtaacagtattttaaactgtgaaccaaaaaaagtcaactacgaatttattgcctccccttatgatcaatatgaatatgcctgcatgtagcatcagaaaatacagccacttattcaataactagaaaactctcaaaggttcagtgattttaataattaatgttgaatcgacacttaatgaaaagtctagtactttctacccatctatttcagagagatgagtagcatgaacatttaaacatgtaaaaaacaactatccaggtttatgtggtgaaaaattacaactataattgtgaagtggaacacaggagcacacaagtaaaggcagaaaagtaaaatgaggaatgcaggcagtctgtagagaatgcaattttatataggatcgtcagagaaattggtaaaatgacactagagcagaaaatgggtttgaatgaaggagcaaatactgaggctaaagaaacattaattttgctttcactaattttcaattgaatagaataattttaataattgcactgattccaagaggcccaccttgcaggaagacaatgtaagtcattagattaattatttagctcagactaaatgtcaagctaatagtaactagtcctctttttctattggtgatgcatgcctttagtcccagctactcaggaggctgacgtgggagggtcgcttgagcccaggaggtcagggctgcagtgagccttgattatgccattgcactttaggctggggcaacagagtgagattttatctcaaaacaattattagaatgaatttagtattatttctatcatttcaattgcaaattgtcagtatcccctgctacgtttctactaatttaccatcgcttcttcaaaaaattgtgttcagagtgctacaatttcagactttgaaatgaatcactataacttttaaaaattagagattttaaaaactggagattgaatatatataaaaaatacaaaatttgacatttaaaacctcattgaacttttaaaaaagccagactcatattaaggcacacacacacacacacacacacacacacacatatatatatgtatgtatgtatatagacttactccccgatgtttgcattatttttgtagaagatagatatcatacatcagattacttagtttttacactgtttcatgagagtccgaaagtaacataagcattatgagtttgttttttatttcctggttagccattataataatttggaatatggagattttcctgtatttcaagtaatgcttaatcatttcacatgatgttgaaagatctcaaaagttcgaagaatgaggttttgctacctaaaggatcatttatctctgatctcttgtggcaatcaacatttgctgaaactattctctcagtggcgctgagatttgaactgctggggataagactagatgcttcctttgggagccttcttggatcacccttcaccttgttgtctgcagtgaatgaattttagtccttgacaatacatagatgctaaatcttttagccaaataatttatctctatagttccacttttaacctgagaagctaatatttccctccaggttaaatactcaattacttgggtttactcagataaactctccaaagtcctttgtcactctaaatatgacctgacaaagctcaaaaacaggaaatgtgaattataaccagcaaacctttcctaaattggcaggcagagatttgtacatataattacagaaacatttggcagctatgtgatattatgcctcaatacccagaaatttcagcaattacactccttctctttagaaatcagaacttgaagccccgtaacccataccgcatgagctgacttcagttaagctcctgaaaaattcaggcttttagccacatgtctcattgaactgtctaaattcatcgagcttagggaactgaattgcagaatctttcaagaacagggttaccgtgtgattcctcatctaactgctgtatctaggcaaagtggacaaggttttagactctcaactaatcctggagtggagtttagcagttatgtagtgcctttttccagagaatcactagcatctttacctgtagcactttattcatctcctttaccttttctgtaaaactctatagacgtaaatcgaggtgacacccatgtggatatgcaatttattccaaagttagtctttctttaagagtccaaaataattaacattgaaaatgtcagcatccttgatactcatgtaggtttaagatagaaagttcaaagagctatggtcataagtcagcaaagctgttaagctgttagataaaactgaatgtaaagtcaaattttatatagtccatgaccctgtttttgaatgacaagacagctgtgcagagaggttaagacacctggctaaaattaaacaggaaggtcaaaactgaggccagaaaccaagactcctgattcttattaaacttcagaatccaaatggagcaaatgactaaacttaccctgtacctccagttatttagctatacatagatgagaagtcagcacttggaggaactggctgaaggtttggcactggagatgtaaggagcaaacattagcttctgattctgttaagtttgaattggaagtctttctgaaattgaggttttagatacactccatatgctatgattctgggcttgctccaagcaactggaagcttttctgaaatacataaatatatcttgggagcttacattaggatatagagaccagtaaaagtaaatgcttcattttaaatgtttaaatatggttaaaaaacacatcttcataaataattgttatagtgactagctgagcttttataatattctaaatgcctagtgtggcacatccctctaaagcatctacattttaaaaatgtccttcacatatataagctaggaaagcaatttctaaaccagaaaaaaataacactcatgcaatatgagcttgaatttgttaaggtgggaggtgagaagggaagaggaatttttgtggtcacaatcaagaacagaaatatgcatacgctctgtgatgaattacttgtaggaaacttagactcctatatattcaatttattttagtttgatagtctcagaactacagatcctcagcttaaatgcagcaagtcttattgtaaagtgtgactcagttaaaatttattgccccagcttcttcttttaaccatatttcagaaccaaattgggccctcaaggactcttattcgtgtctctctatgccaataatgtttacgtttttgtagctgtagacagtgtttgctgttggagcaagcacttgtatcttactaaaatgcttggttacttatacctccatttaataaaaaaattgatgcttaatttataaagttaatttaagttttactagcaaacttaaattaacaggaagttatcctaaaaaagaaaaagaaaaggaaggaagataggaaaaaagaagaaaggagaaaataaaataaaacataaaaaaattccagaagggatattattacatcatcaaaacccaagtattaggagattggctctggtgaacttgacccctgtttttctattagtaaaggtatagcctgtgacaggggtataaaatatccctagaaagttgatttcacttagtcaatataaaatcccacataatttgtagacctcatgtggattactttcccttgatgattgtacaacatttaaagcagtagttcgcaaatggggatgattttgttccccagaagatacttggtattgtctagaggcatttttggctgtcacaactggggagatgctaatgtaatctagatgacagcggcagaagtgctgctagatatcctacaacgcacaggacagccgtcacagcaaagaatgatctcgggtgaaaggtcaacagtgcccttctagagaaaccttgcctacaaggttcccatcatgtgcaaagaatgggagtggggatcaaatgtttctctcaggtactttctattttttcctgtccatattggactgcaagatgcatgggacaatatagactacaccatttgtgaaaaaatgtgcaacagactagccatctgttatcaggcctcctagaatgtgaaacttcaagctatcacaaacataatgcaacaaatcataagtcttgtgtgcctgttaaaatttcattttcatttggtttcaattaaacacttaaattacttaccaccctccaccccaggctctaaatttcaaacatagccactttagttgtgatgttctattttcattttattaagacatcatggagtaaaatcatacatagatgtatatctctagaagataaatatatcagatattttagtcagtatataagtcttacccttgtgtaatttttttaatgttttaacattttacttagcctcattctacaaaggggtaacgtccatgtgtgtagactaaaattattttttaattaattgtatttttaggttggtgaagtagctacaacattaatattgaagcagttgatgtagaatgtgtattgtttatggagtcaaatgaaaatctttatagcattctacgaactctaaaacacataatccatacaacatcctgtgacatatttttgtaattctacagatactctaaaaaagttgatgctcagtgaatcttatactaactatcgttgtggagttcttaaaatgtattaatgtaacaacactattaaatagtagcataagaaaaaagaggacattagaaagcagtatgatttaagaaaataaactattatgtttatattggctcattcacattcacatatattatgaaaaactagatttaactcattatcaactgaaaatgaactgcacctttaaaatgcacaaaattatcagaaatctttagaaaaatctactttcccaggtccacaaaataaatcattattctcacttgacagaacaacgtgcttttttgcaagcaacaaagttttgtaaacagcagaggtagaaaataagacatactttaaactgggggaatacagtggtgaagggggccaggtggttattcctctggacatcccagattaggcaggataataaagcagtagaaagatcacagaggatggaatgaccaactcttgctggaagactcctaaatgttcacccaaagagtttacatttgaccaagatgttcagataagaactttacccagttacagaaaaaaggaaaaaaagcctcccaaaaagaaagaccatgtatttgggaagatagcatgctcacagggggaattcaattaagatcagtgagcatctgttgaatgcctgcactgcacatttgccaagataataccaagataatactacagagagcaagaaaactgctctctgtagtgaatgtgtattgtttatggagaacatagtttcatgtgagttaatactccttatcttcagctttataatctattcagtttttcataagcttatgatttgaaataatggttcgggtttactatttttatttgttgcaattgatatgacaggcactactgctactacttttactagtgtagaacataaagagtttgaaactacaatgaagaatttaaagagtttatgagaatgtatgtatctatcttttcttaaattccataataattttgctcgtttgaaatttcacctgtagtttgatttttttttttacttcaaattaaatgtgtacaatgttggtttattattcttttatttttaaagccagagcaatttgatattatttgcttgccatagaataagataatttttaaaaatttctttttatctgatttagtattaattgctaaatttgaattgtactttgtagttaacagtgagctttcccttgtagcatcttttaataaatttgttatattgacagtaaatgtaacaattaaagggaattgaaaggaaggaacaggcataacatttattgaatgctctattaaggagcagacactttttaaatggctttatatatattataaattcatgacaaatgacaaaattttctaaataataatatataattctcaatcatctttattctcttcctgtttccctcaatgatggatggcatcatttacaatatggttagatagaaaagagataagagtcttgaatctgtgattatttcattattggagctaaactaatccgtctaataagctacctattagcagataatggaaattctctaatgaaaaggctaaatgtttcatgaatattgaatacattctgggctaaacagctaactcttggccaggtgcgatggctcacacctgtgtaacaccagcactttggtaggtggaggtgggaaaatgacttgaggccaagagttagagactagcctgaccaacatggcaaaaccttgtctctatcaaaaatccaaatattagccaggcttggtggcgcacacctctaatcccagctactaaggaggctgaggcacaagaattgcttgagcctgagagggggaggttgcagtgagccgagaacgcactgcaccaccgcattccagacctaactgtctatggacttcaacactaaaattgggcaaagcaaatcacttattcacatcttcttctaaagaaagagtttaaattagccccagctcttcttttagactgagttgtttggatatcatatataaaaatataaattaagagtttttcattaaaaataaaaataaatatgtttacttctaagtatataagctcaattaactgtgacctgggacagaatctggccagcgaggaaaagaactggtacaccaaaagttgatcaatagtagtatctggataaattacggaaacatttaaagcactgcaccctggtttcattgttgaactgattgaatgccacttaatttttgagtgtttgtaataacatgtccaaaataaaatgaaaataaatgagattgccccacttccttatgctttcccacaagggcagcaactgaacccttgatatagttaagagacaaaaaggaaaagtgtaaatcaaaaacctgaatgacacaagtgaaaagaccatacctacatttccaaagctagcaaaacttgtagcaagaggcctttgccatttcacaggtatctactgcacaatgtggccaagatacttttccaaggtaccacagtgagctaagagccagaatattttgttaaaaattagtacgaaggtaaagatagtataaaggtcacctgatcagcaagtatgttacattgaaaggtttaaagttgtcattctaacaataatatgtgtgtgtgtgtgtgcaggctacaacaattacaaaacacaaccagaagagcagaattgaaaatttaagtttttcttattaaaataaattactatacatttttccaaacatgcatcccatttgtttaaattttaagcattttaataagatttacacaggttacacaaatagaccacatgtaattgggaaatattctggaaataatttgcttgaatctgtaaccatgtatttcattagagaacatactgtataagtcccaggcaagttaagagattcaggtgagtgaagctttccttgaagatatgatcatgcgaccacagcagatacctctccaacattattatgtctgtatttacaacagagcaaaagaggattctccttccaagcttaagcagaaatatggctctgttcttcctaaaaatgatcacctttcagtatatcattattttaagaaattctattaatctcaatgctcttctctctggaaaatggtgaagaaacacttaaaatgaaacaactcttctgtgtttctttttaaccctgattgaattaaccaaataaatacacttctctttcatggctgtcatcaacctattgtttttttcttatgactctattttaatttcaactagagaccatggtaaggcaacaaatatctgggcctaatattttctaaataggtacaaagttttcagcatagaaagggcttttttttttcttttttcttttttttagtgccatttaagtacacttcacaatttcagtattactgaaagtatactgacatgatcctttcagtataagtatacttatataccttcagtaatactgaaagtatacttatacgctttcagtaatttggttctggaaaaagagaagtagcaaaggcagttagaaaaatgacaagtgtctataacagacctaagatatttaattgagatttttaagatactgtacctcccttgtcctatgaatacagctctgtttgacttttgttaattctctgagttcttaagaaggagaaagtaggcccaatgattccatttggcatcctgagtagattctgttcaatgccacatgtctaagtccacttttgtcgatgtcaaggggtagtatttgaaattttgaattataaaaacataaacttgatctaggcatatgtagatgagtgctttgggagttttagtgcacgttgcacactgtagtttatctccctaacttccgaggctatcttttctctggctccggtctctccaatttcatttgttttacttcatcagtagaaactgtcaactattcttcacctggtagcttcttaggaaggttgcgctcactgtgtgtctttgcaggcttattcttcctgctgatggtgtttttccatttcctcaattctctgcactgtttcttgcattcttcatgactgtgtaagctctaccttttcaaagagcttctggcagtactctccctgaacagctcatttgtgccaaaacaccaaggagaagtgctcagttttactgagttagttccaatcttatcactctcctagccaggataaagtttcccaagtgcatctgtgattaaataaaaatttgacattttagcttcctcttccattatatttcttcacacaggaaactgttcttctagaacatacagttttctcctctgtgctttgatttatgccatttgctcagaatatgagagtattgagctaacatttattgagtccttactatgtcctaggaagaagactaaatattttactgaaatttgtcgtttagtcccacataaatactctgaaccaggactattacattctcaataacagatgaggacagtcctgcacaacaaggcttagaaacttgtcccctaaattgctaatccatttgtgtaaagcactatattgcccccttgagcatcacttcaaatccagtggcatgctatgaggtccgatagaaatcggtcacattttgacgaacacggcttaagattttgaggatgtgagttctttctttgaaatatccatcccttttttcttatatcaaatattgtacttatctttcaagtgacttcacttgaaattgaggtcacttaattcataagtgccctcctcagtctctctagtgagaatcttggctccacgttccacattacggtggctttcactactgtctttctactcagggtaagttccatggaccagcatcacatggagattgttggaaatgcagacactggctacacactcaacctcctgaatcaaaattttcattttactgggagtaagctgtatatgatttatatgcattataaagtttgaaaagcaatgtgctagatacctatttcgttctgtatctagtttttcagagtaactcattattactcctgtttgcctgacacttacgaaacaaaagagccagtatgttatttatcagtttcacccaaattaactagcataatacttcctatatggttgacaatcagtacatctttattaaatgtatttattgaactaagagcaaattccatagacattacacttttatatctcccataacttataaaagcaatattattttcctctaaattataagttctgggaatgtaattattatgtctatctaatttatatggtgcttgcctactatccagaagacacttcaatgactaatgatgaagcacacagtaaattaatcaagatgattattgtgttgaagagagttttttaaaatataattttattttgagtttatttaggtaacaaacacctgtaagtacttatgtgccagggagtggtctaagttctttacaaatactgacttattcacattctgaacttcgattgcttggtcaagcataaatctaggttaaatcaataaaagttgatttgtgatacctcttttaattctaatacatgtcatgtcacatctgcttcaggttgttttgttgcagatgattaattaacctgccatagttgatataaaatgtcaatatttaagcaattttcttttttatatataatttcaaaatccttccaaattatttggaagtaaaatttgctgtaaatggtatgctacttctgcttggtattgaaatagaataacatcaaaatgtttcacagaaatgcatattccatttcagaacagaaatactatgagaaattctgtccggtttcagattatgttatgtatattatatgttctatgcattgctgatttatgtagacatgattttatattcaaagggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaagtatttgtggtctatgagttatgagttcagatgaaaagatcaagctgtgcaaggaagtggaacataatgtaactgggtggctcctggtttataacactgaaataaaatatttagcagcaatgaaactgtttccaagtcttgcaaggatattatattaattgaattgttcttacagatttacatatttccctcaagcaagggtttagaaataagacaaaagaaacatttgtagtgaaaacgtaatgaaaaaagtgaccaataagataacctctagattctaatgcacattgaagtttgaaagtcactgctttacaccattgaaaagtactaatgaactaatagttacttaattttacagcacttaggattttacaaaaaaaattactataatttggaaggcaccatttgaactgcagtataactaaaacctgtatagtaattttgtccatattcattcatatatgttttccatagagaactatataaccaaataataatttctttataacaccaaatttgctctatcatttaacatttctttttattttaacccaaaaaggatctttacatactctttcctaaatttatgttatttcaatcttcctttatataatattttaggcatacataacgtcttatttatttgatcagttgttatccttttaggcaactaaaaatgagaagttttcccacttacctttaaaataagcatatttgtgagccccgcccatgaaaacgtaaactaagtgacacttcctgaaaacttcctggttcctgaaaactttgcttctcacacaggtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggtgacacattcaatttgttatctggcattcactctgaaatttgtgtttgctatctccaagatgttaatttttttagcccacccccaaaatgcattatttgaagcttgtattccaccatattagagagatgtatttcccctttcttttttaatctttagaactaattctcgtcctccttaatagtaatgatgaaattctgagatattttttaacatctatcttgactctacattcaggcttgtttaagtctttgggaaataggaatactggaggggtgcggtggctcgtgcctgtaatccaagcactttggtggatcacttgaggtcaggagttcgagaccagcctggccaacatagtgaaatgccgtttctactaaaaatacaaaaattagcctggtgtggtggcaggcacctgtaatcctagctactcgggaggctgaggcaggagaatctgtgaacctgggaggcagaggttgcaacgagctgatatcatgccactgcactccagcctggtcaacagagcgagactctctctctaaataaataaatatactgaacacatacttcttttcacccttcatgaataaagaagtcctgattcatctttcattcaaaataaagaaaaagaaattatccaaaatattgcactggctagcaaaatgcaaattttccccagttaattaaacaaatatttgtctagtctatattgcgtatcaattactttgctagacaccattgaagataaaactaagagtaagataaagccagtgtccctggacaacaacacaaatgttaatactctgcagctgtaatgcaatcctggatgcacaaagtctatttaattttatgcatattcttttaggttaagaatcactgagttctctcagtggttagaacaatgtaaattaaagtgtatctacaaagtacagtggaaaaaagaaggaagaagagatgaattttgtcaggggccatataagaagaaaataaatattaatatatttggtgcctctcagagtaattaaaggcaaagatatcttgtttaataattttgattctcattgtaagcataagaaaaaaaggttcttttacattttgataatgcattctcttacaggcttttaatttttctctctgatttatcacatgagttagtacatgttttatacttttgaaacattcctcttgacaactatagagagaagcatttcagacctatttgggacctctagctatgtgcctactcaatggcttggacttgtgagttcaatagtatcttgattggtacaatggagttttatcagtaacgatgacttgtgggtcattctgccttctttgcataaccagttgcttctcaatatcgcttctcaactgtgttagttttgggtctcaataatagtatcccgccctgttgtttccattgctacaaagcttagtgactaaagctggcgttcaatgcatgggaaattccttgcattttgtcttaagttatctgtttgaagatcaagcagggcgtgtgtgtgtgtgtgtgtgtgtgtgtttgtgtgtgtgtgtgttggtgagtgaatatgtaggtacattacaagtttgattaaccatgccttagtatcatatttttgtgaaaaaaatcaatcatatttaaaacaatattttaagatgtctaaaatcaatgcccctgaaatccacagggaataaaatagcaaaattttaacatataaacgttttttatccattcttctgtcagtggatacctatgttgatttcatatcttggctattgtgaataatgctgcaatgaacatgggaatatagatatctctttgaaatactgacttcatttcctttggctatatacccagagtgggattgctggatcatatggtgattctatttttagttttttgtggaacctccatacatttttccatatggctgttccaatttacattcccttacatgccaatgttccctttctccacatcttcactaacagttgttatcttttgactttttgataatagccatcctaacaagtgtgaggttctagctcattgtggttttgattttcatttctctaatgactagcgatgttgagtacctttacataaacctgttggccatttgtcttcctcagaaaaaaatgtctattcaggtcctttgcccatttttaataggggtattattatttttgctatcaaattctatgagttccttatatattttggatattagccacctatgagatatattgactgtaaatattttctcttcttctgtggattgcctttcattttcttgttttctttactgtgcagaaaatttttaatttgatataatccctcctgtttaatttggcttttgttcctatgattttggtgtcatctctacaaaattgttaccaagaccagtgtcatagagctttcttcctgtatttcctgctagaagctttacagtattaggtcttcagtttatccattttgtgttgattatattaaatgcacattacctgttttttacataatagtttaataagttaagtaggagaatcataaacaagatcttaatatcagtatataagaatcatagattatttattgataataacacttagtaggaatcactatgattgaatttagtaataagtccttaaataaaactacccataacttattccataaggataaatatctatcccaaacttcacagagactgtatagactcttagaaattcacctgacagtttaacaactaacaggataacaaacctgtcctttcctgggccatatggtcctcattctgtaccctgaaggcatttattttgatctttacagcatagatagtaatcacagaaaaaaaaagactttacctatcataaaaacattcaaaccattttcaaagctaactcatgtaatgtaatgtaatgtaggggtatctaataccagtttcacagagaaaagtagtcttactatcagatcataatatgtgaggctatgtcctagcatccaaattttaacatactttcataattcacttttccactcttattgaaatatatcaaatactttttcttatatatttttctttaatacatgaactaatttgatgtattttgtcataaaacataattttagaaaaaaatcaatattttctatgaaaagacaaccatctcaatgtacagaatataaacatttgggcaattatatttatatttttacttattaccattaaaatgcacgatgggttagattttgtcataatacatttatttttaacaacctcacattactatatgcaactatgtcaagaagtttttttctctttagaaaatttgctttcctacttttgacaatgattatttcatccttttcataactgattaaaatgacctccttctttaatttttagtgatgtccttgccaaatgctttattgagaaaataagccattagatgggaacttcccacagcaaaacagaaatgtagtggcacctgcacctacccatatcgtccttctttcctctaattataaaaggcagtgtccctctatttgtcagaggctaatcctctactcttcctctctccctgtctccctctctctcttctgcatatccaggctctttttttctgtaggatcattgccacaaacagatgttctattatattctttctcattatcttattcttatcaccaggggaacctattacacatacaaatatccaggtctatcccaagaatctccaggaaaagagaatggagtttggatgttttataaaaatgccaggtgatttttttctcctctggaaaatttaggtgatattgcttgtcaatattacccctgctggccccacatctctgccaactacttccctacttctctaacactcttcacagccaaacttctcaaataatggactcacagacataaagtcaatattctgaaaatttatcaattttctccccctagcctgatccttccactgcctaattaattgcatacaccagcagctacccattcacctaaccaggaattagagcaactcttggtacctctttcttcccctctacactgtgatcatctggatcaatgagatctatctctatcccttttcactgaaaacactctcctcatggctgtttcgtcttctgacctggaccactgcaataggctcctaacttgtcccctgctttgattgctttcaaactccaaacattttttttgcacagcctccagaatcttcttatcaaaacatatatgatatagtttcagtcacctgtttataatcaatattgaattcacgttacacttataaaaaaatctccttttggttgtttaaaaagccctgctgactgggtggagtgactcaaaactgcaataccagctattcaggagactggggctggaggataacttgtggccaggagttggagaccagtttgggtgttatagcaagacccccatccctacaaatttttttttaaatgggccaggcatggtggtgtttgccagtggtcctagctactcaggaggctgtagcagaaggattgcttaagtccaggagtttgaggttacagtgagcaatggtaacaacactgcactcagcctgggtgacagagcaagacactgtctcttgaaaaaaattataaattaattaaaaaagaaaattttgaaaagtcttgcttctccaatgttattatcttattcaaataaattttattcgaaaactatttttatataatacaatgagatgactatagtcaataataccttaattgtgtattttaaaataaatggtgttttctgccactcttgtaaacaacagacaagtacagaccagaggaaggaaataagtaaatggccgtgatgggcgataaaggaatagctgcgaaagagtctgaggagctgatgtttgagacctgcaggaagggaatgagccagctgtgtaacctcctcctcaccaaaaagaatattcttggcacaggattaaaaaatgcaaaagtcttgagatgagaaagggtttggagagttctaggaagtggcagagaataatatgactgaagggagtctgtcatgaacctaaggaggtaaacagaagccagagcacttgaggctacacaggccatggtgaggactttgaaatatttttcaaatgcatgaggaattcattaggcatctgaaccagagaagtaagatgatttgatttatatgactgctttgtagagggaggagcaaaagtatgaggaggtgggggtcattttaacctttcgacttgtgccaccttcatctaaacaatactctaacctcagtggctacttctagttccttcagaaaacaaaagcatttcagaagattgtagcacatgctgtttgccttgtctcagattctcctttgcacctttcttccttaaggaagcaacttacacatcatgtatgtgttgactcattctgtggcagcaccagtgaaataaagtttaacatcattattcttttacagagcaccatattctcgttcttcatcactattttaattctgttttctgtgattgtgtctgtgtattctttttaactatccattttctcaataaactctaagccctgtgagagcacacaccatgcttctctcgtattaccagtgcagattgataatgggtgctctgtaaatgtctcctaaatacctaataaatatgtgctgacatcattagtaaatttacatttcaaaagatgcaatttatagaaaaaattccagtgtttttctgctctctgaacagatttttttaatagacattgatcatatggtaaaagcctagacctgttctcctaagcaaaattctgcatgtgtacctttctgtcaactcaactccagaaatacactcctaaaaatttaataggagacttcaaaactgaattcgtggctggtacaaagcattcaagtttctgaatggtgtagttattcagatcagtgcatagaactgtgtttatacacgtaccctgtagtgtcttttaagaaaaacaacatcattctgatagaaatgatgtttcttcagtctttctggatttagtacattttatggtcaaattttatttttttcttggtggctaagtaccttttgaaactaattgtttgaatttaaaaacgttgttgcatataccgcaatagaagtctttttataatgcatcatttcacttttcagccttcattagagttgatgatttatagcagtaccattctcaaagaatcttccgcttagagtgtctccatgaatatcgtcactggaagtggggaaggtggaaaagctgatggtcagggtgggccagatcaaacaattacttagatgctgcaaagaatcataataagggaaggacagttacattaaactttgtgttatgcttgttccctagtaattgattgctttttctaaaagtagagtaaatcagaggagatgtgagggttttaagttttgatagtacatcagtacaaggctacagatgtttattcaacaataaccgtgtgtgagacattatgttaggtcctgtgatgattatataggtaccagatgtagcttccatcctcaacagcttacgtttaaatgtggaagaaaaaagaatatttagaacactataatacccctcagaacatgtaattattagagcaaaaataaaaggagttcgggaatcccgaggggaggtgagtttacttttatatttggagttttctggtatttgtatgcaaaagggacttttggatagtggatgaaattgaaatttctacaggtaggtaacaggaaaacaggctgggggaacactacagaaaagggaagacatgcaaataggtaggatacttccaaatcacatcgcataatacggttttgctagactataggataaaaaaaggaaattatggggaaaaagcctgatagatcagggatcctcagcccccgtgccatggactgcttccaggccatggcctgttacgaaccaggtggcaaagcagaaggcaaacggcgggctggtgagcattaccgcctgagctctacttactgcagatcagcaggggcattagattatcataggagagcaaaccctgttgtgaaccgcacacacgaggagtctaggttatgcgctcctcatgataatctaatgcctgatgatctgaggcagaacagtttcatactgaaaccatcccccaccacacccccattcgtggaaaaattgtcttccatgaaactggcccctggtgccaaacaggttggggaccgctgcgatagatgattcgtcaggtgatggaagactaaatgtcatttctagacatttgggcttttatccataaggaaaggggagacactgaagttactgaagtgatatgttgcactgtgtttagggaatagttctttggcagctacttctaaaaagggctggagatgaagggattcatacgagagaattaagctttcaatagtctaagaaaaggatctgctatgctagagcagggaaagtagacagtgtgtgaattcaatatgttttattaaagtgagttctataggacatagtgactgagatgtgcagagtgacagagaaagtatcagagaatacttccaggttctgaatgtggagcctttgagatcagccttctcattgacagtggtaggaagaacagaaggaagaacaggtctgccatgcagataagcattcttggcaacagtcaagaaactaatttaaatgtttgaatgcctcctgtttccattgtatgtaacaaggtgtagtggcagccaatccagattttaggcaccttgtaagggggctgtggagccaatcagtgacaggaaatggcaatacaagaaggaaaacaaatacgaaacattcactaatatctcagaatattaactcactacgttgactgccaccaagagagaaagaaaattccctttattttgagctttggagagcagtgccagttatatcacagaagaatgtgaaatggtaggtagaaacgaggaacaatcagggtgataggatgaggtttagactactgcagaaaaccacagtgcaaggcatttccaaaaagtagattcaaacggtattaacaaaagctgaaaaagggaaagaaaaacaaaaactgagggaatagacttccagttaaataatagaaggatttataatccattgggtatatacccagtaatgggattgctgggtcaaatggtatttctggttctatgtctttgtggaatcgccacactctcttctataatggttgaactaatttacacgcccaccaacagtgtaaaagcattcctatttctctgcatcttcgctggcatctgttgtttctagactttttaatgatcgccattctaactggcgtgcacacgtatgtttgttgcaggactatttacaatagcaaaaacttggaaccaacccaaatgcccatcaatgatagactgaataaagaaaacgtagcacatatacaccatggaatactatgcagccataaaaagaatgagttcatgtcctttgcagggacgtggatgaagctggagaccatcattctcagcaaactaacacaggaacagaaaaccaaacactgcatgttctcactcataagtgggagttgaacaatgagaacgcatggactcagggagaggaacatcacacaccagggcctattggagggtgaagggaaagggaaaggatagcattctgacaaatacctaatgcatgtggagcttaaaacctagatgatgtgttgataggtgcagcaaaccaccaagtcacatgtatacctatgtaacaaacctgcaggttcaacacatgtaccccagaacttaaggtaaaattttaaaaaagatagaaggaacattgaggtattaagaaaactattctgaattttggaataatatatattacattgtgagagacctaattataaaattggataatgaaaaggcaaggcaaaacaagaagatgtgcataaaagaatgaaaacaaaagaagctctcctctctttttttataagaatcaaagaaatgtttcttctttcttctctttctcttcctctttttcttactctttctttctttctttctctttctttcttcccttctttctctccttccttctctccttccttctctccttccttccttccttccttccttccttccttcgttccttcctttcttcctttctttctttcttgacagtgtttcactcttgtcgcccgggctggcatgcaatggtgccatcctccgcctcctgggttcaggcgattctcctgcctcagcctcctgagtatctggaattataggcactccccaccatgcctgactaatgtttgtattcttagtggagatggggtttcaccgtgttgaccaggctggtctcgaactcctgacctcaggtgatccacttgccttggcctttcaaattgctgagaattcaggcttaagccaccacatccagcccaaagggatgttttttaaagattgttcttgatagaaaatgccaccatgaaaataaatagaaaatagtcttaaaataaaaatattctttaacttcccaacacattgttttgtacatataagagaaatacacatttattttttaaaaacatattttgaaagattataatataacttctagatttaaataaatttattcacttattttataactgaagctaaattaaaaattgactaataacagaaaaatgagaatgtgtttctattcaagtagtaagataccctttttatttttgaagatatgagatttttattattgacaatattaattttgaagagatgtatgtgtgtgcatatgtgtgtaaaatgaaatagagaaataatttcttcttaagttcacagaatttccactagccaggtattgaattcttctatactgttgtaaattgataaaattcaaattcttgacacaaaaaaattagataatacattcaaaatatttagaacgaggttttaaatggaaggcaacacaattcatgacacagacttaagcaatatatttaataatatttagaacaaggttctgcagacccaattatatttagttaatttaattgaaatgtttttaaatatattgtttcattgcattgatcactaactttgaagggatttatttttattaacttgcagcatagaaaggagtaaaaataaacaatactcatattttccccagttaatgaaaataaacaagtattagtaaaaagcttctgatctctaagagtacataatagaattctttttgagaataactgctgttttgacaaataccatatccttcaagacaaatcgaacaaccaaaagacaatctgcctttatttctcaaaatgactttgacctcaaattctgaaactgacagggtgactttgctcagtgaataaatatgatacagaaccttttagagggaatcgaatatgccgaatacccaagtgatctctctgtctctctttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttattcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgagaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaataaggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttggagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctatttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcctgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgttgccgccttgcagtttgatctcagactgctgtgctagcaatcagcgagactccgtgggcgtaggaccctccgagccaggtgtgggatatagtcttgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttatgcgtcgctcacgctgggagctgtagaccggagctgttcctattcggccatcttggctcctccctcctgtctctcttttttaatcttaaaatcaaaacagctaattttaccacacggaggaattaaaccaggtgtaacggctataacttcaaagatttttgtccttaaggcctagagataattaaaataaacacaatgactttatttctccttaatgtgtcatttatgtactaggttcctgttgggaactgtatatattcaaaattatttttagttactgatgaaaaattaaattcattttatcgtatctggatttttaattttagtgataaagatcaaggtcatcggcaatcaacattaaaataaattggcaaatataagattttccccctgaaatacattggggaaacatttgaaattttaaaaaacagttataaaatgtacggaaaaaatatattactattctcaaacaataataaattcagatacaattattagtattttggctttaaaaagttgctttttagatttaatgtatttcctgaaactattcacaacaaataaaaaataattataatgttacagtatgcatctccaatgttattacctccttgtagacataataggcatatacttattcattcaagaaatgtgtattagttattatttttgatatttgaggagtaaatctctttgtaatcaaaaggagtctattaagtgagaaatggataactagagattcagaattctaaggtagcattgaaataagattattacccgaagatattcctgggattggcagttgtttattgagctttttccccagtatctggtgctaatttttatgcacctatttacagctaaaataggaattgatgggaagaaaatatatatgtacctctctaatgcaacagtataaaacccatgaaagaataattcacaaatcttaatagaaagagagagaaagaaagggaagaaagttatttttcacttcccctgagcaaatatgtaatttccatgatttctttttaatgactgcggtctgtagccagtaggtactgatttatgaaaagctgtaaaagatcaggtggagctctgtaggacatcgtttacagctgcatggattgaaacctatctaatttgtctagtaaaagtgtgagctcacggtgcacatcacccagcctataaatttccccttcagaccaatgtctggggctgggtctgaaaaaacgccaatgcctgcagctgctcaaaggcccagattcccttggtgcgcatgaagagacatcacaggctcttcacagtgagagacaaattcctatccattgataaactctccagatgtcctctctgaggaggaaaggaaccaatttttatttgaaatccccagagaaatcctggaagtggaaaaatgatactttgcagggctagttattctgaggtcattggcattaaaattaggtcatttttttttgtcttggatgcactttgatccaagtcataaacagacaaactcagttggggtcactaatccttaatccacacgtcctgttctatttcaatttgtttatactaattttctctaaactcttgttgagtctggctaaagtgttgagtgtaaaagtacaaactattctgaactgagaagaaagaattctgcattttgctattaggcacacttcataaatattctgaataaatgtcctggggtttgattcttcatacccacaaacccataaataaaaaagtattactattcatgggactaaaacttgacataagattctgtgctccagctactgtagacagagaaactgtggcgtgtgcgcgcgcatgcctgtagatagtttaatgtcttgtctcattctaggtttcacatgatttttcttctaaaatcttctcacacctgatttaatgctattcttatcaattttttagtggttcaatgacttatccaatgagtctaatgtaatgtctaatgcttgctagtgacaaagactatttcactcatgataactatgctgaaacaacccatgaatattgtgtacattttggtgtatatctgtaattactcaagttcttaggaaaagaataaaaatacaaaattttcaattataaaaataagctgtttttcttcctaagatgagtaatttaaaaaatcataaagtcgtttgcatatatgtttcagaagaagataacttatgaaatgttatattgatattttatagttttcctgatattgctaaaggaaaaaattaatatttatataatatggcccaatccttttttagataatctctgagagttagtaaaactaaactatatcagagaaatagaaattataaactccataattaagattttcaatttataatttgaacttgtgaagtaaaaaggattgaggtaattgagtttagtctagtggacagaagtttgaagaatccttccctttcaacttccctccactacacaaatgaccatcacagagaggggactattaatctatattttccacagagtatgtaaatagagtcagaaccaatgttgcaatttttttttcctgaaactcagggttaaaactgcactaaaatgtgaccatttttatcaaatacgtttcatgcatcgctgtaaaaatccagatagtgaattcacaaacttctcatatgttccaagtaatagcatgtaggtgtagggcacgatctaaaattatcctggctcacgaatcaactttacacttgagcaggtcttttgtacataagagagtaagttgaagaatatcaccagaagtggtataaacctctcaattaaaagacctatttaagtgtgcgcagagctggcacagatttgcttcatagattttctcatttagaacaggagcttttaccacatatcctagatggtaatcaatgattgctactcatatgtaaaacattatacagttttatttcatgtatattgttcattttgctatttcatgctatttctaaagatattgaaattagccccttagagacctaaatttatgtctaaaataaggataaatgcatgtcgatatattatttgttttggtgtcttctcaccacaaattctaaactttgaatttaaacacttcaaatgacagacttcacttagactaatctttcatttcaagtatataagaaaaatatgaagttctagttttaatactcctaattttggagatttttattgaaagattctgaagaactaaaacggcaaaaaatcaaaatataccctcttaattattaaataaagattaaattatatataaagttttaacattaatactatattttattacaataatgaaaaaaatcacagacagcagaatagcacttctgttttcaagcatttgcagtggaatgattgtgaagttgtaaaagttactgactattctaatgaagcccctaataatggctacttttcagggttgttatactattatgtacataatattatatatgactaaatttctagttacttaaaatggtggttaacaagatcattgcattcccagcattatatataaactgatatttactctgctattttctttttgaagttttcagaagtttaaccatttcaccatttacataagaataatgaacagctaacacatagtgcttattatgagccagcactgttctaagtgcttcccacatatgctcatttaatcttcatttgtgtgaaattgatatcctcaccatcatccccattttacagatgaggaaacagacaagaaattcaccaaggtcacacaaatagtatgtggtatacctgggattcaacccaggccttacggttccagtatctgtgcactaaacttcagggcatataaacatcgaatatgccacatgatggaatcataaatcatttaagaaaaaacaggggaaatgcaatatgaacaaagttttacctaaatggcacagtgtaccagtcaagaatgtggactgtggtatagaataatgtgggtctaaaggccagctctgcctcttttgcctgaggaaacttagcttcgtaacttaatgtgatttagtttcagcttctttatctatctcagaggatagcatcagtgcctaacaggtactgtaaggattaaggtccttcatgtctgtgtaatattcttagcatgatgcctgccacattgagtgcacatgaacgtttgatataatatgaaaacaagggccttaaaaacttatttctgtcattgttattattcatccaaaactaaaggcttttataactaccttgtgcccaagctcccttccttaggagaaaagaagagagaagtcaatatattgttcacctagtgactggctccagtcttataagtcaaaggacaattaaagaggccactaagagctgaagaaaaaaaaaaacacaccaaagacatttcaccaacagtctgcttcttttgcctcttcagggaggcaaacattgtctcattcatttcctttatgcctcttctgttccattgatttaccaggtcttgcaggtggttatagatagatgtttaggcctgtatttatataaaaaaatcctagaaggaagtcctttttctttctctctttctttttgagacggagtttcgctcctgttgcccaggctggagtgcaatggcatgaactcggctcaccgcaaccttcgcctcccaggttcaagcgattctcctgcttcagcgtcccgagtagctgggattacaggcatgtgccaccatggctaatttggtatttttagtagagatggagtttctccatgttggtgaggttggtctcgaactcctgacctcaggtgacccgccggcctcaacctcccaaagtgctgggattacaggagtgagccactgcgcccggccctttttcttaaagctgattgtattgtgcaatataaatcacaattacaatccctctctgagtctctgtgtgtgtgtgtgtatgtgtgtgtgtatatatataaaatattatgtatatatcatgtgtatataaacacattacatatataatgtatatatcatgaataatgtgttgcatatatatatcatgaacttcatttggtgtcaagtatgcaagaatgttttttcttatcagtcatctacttttttctattattttttatttttaatgacatgcagcattatttaactctgtattgagtttatgtcctgctgtgagtgtagcctagattgttcaagccattctttagacagcaacctgtgcaatgtcaaacaaacaaacaaacatccagtgggaaatacttaaaatattgaaactgaatccatcatcaaagcagacagcaaagaattcagtgtgtcctgcctactgtaaccgtatcctaaattactaccatttttgctagtgattaaattcaatgataataaaatatgtatggatatatttatgtctttcactggaaaattttcagtgatttaaaagcatttgtggatggagaaggggagaacttagacaagatgattacacggcgttcctccaagctgccagcttgaacagatgaagctttcatggcagataaattccacaaatgaaaggaacaccatatgaagtctggaagttcctgccgatgttagtgtcaaattttgacacacagcaactctgctgactcctgatctgtctccctttggtgttttttttcttgcaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagagtaagaaaaaaaaattcattaagaagaatgaaggattcttttgaactttcttggcttgacatgaaagatttgtaacatcttggcttgacatgttacaaatattagtggtagatctgaggtactgactaccgcctggaactgctaatcagggccctgggtctccttgtggcccacagcttctggattgatacatattgatgtgtcttcctctctcaagatagggcccaggatcggtgtctttagatatgaccttcagatcaaccaacagattcacacccataaccacactgcagactcaagcccctaatttaaaacataagcagacatagattgatgattattatatttctgcattttgtgatttttctgttatttttactaaagcttaacatctgtgaatcaggaaaattgagagccaagtagataatgtggtatacaaggaaacatattaaagtctaaaactggttttcatagttgctaaataaacataacaacatgtattcatcattgtctaccctgtaaaggatatcatgctagaaaatgaagttataattaggtttaagatagaatttttgggttttcctcaaaaggcttattgccagatgagaaagaaaaaatatgcgtcataatattaatattaattgatagctttatgtgttaaaaaccaataataatcaagtataatatgctgtattttgtggacaatcatctttgggtaacaggaatcttttgatatgagaaacacatggactcaaggaaaggtggtatataaagaatcaagtgaatccagtgaatagtcaaaaatttggttcttattcacaaagtagagtgtttgggaattgataaattaagagttggaagtcacattcttcatctcactgtgattgagaaccaatttacttcacttcctaatgtgactacataattttttctttttctgcacagtgacattttctggattcccatgcgcatagctaaaaactggctttctaaactcttggtcatatagccttatagtgccattcaactgaccagggtccaactcccttaatctaagttaccaggagagaaagtaggactggctcagtcccacttgtacattggcacctccaaagtcatatgtttactagtatctagtcatttatcttcaaaagaagtagaatgaggtagtatgaacttggctctaggggccttttcctgaagataagatggagaactgtcccaaagaaagaagtgtatactggatagatacaccaaaagttgtccagcatgttgtcgcttgcatggtctattgggaaactgttcatctttgtgtcagtctttctttgatctttgttaaattaaataaaccctttagtcccccaagtttaagtattatcatctcccactaatatttaaatatttaaatattgttgaatatataaagactttcattgccaccctgtcaatcattcaacatcactgtgaaaaataacagattagatgccagaaaagaacatgccatgtaattaatagatataagtgcccaacaaacaaataaataagtttataatttatggtgtaacattacaatcagaaagacataaagccaaagaaggacttacaggaacagtttacgattattgaagaagaggacttgttctaaaaaaataaacttaccctagtcaatttaacatgcaccagcattcttgttcaaagtggaatgtggtgtttattgaatagacttctgacccaatcgacagtacacttgggtttctgtggtacttattttgatcagatacagtctcaggatatagtcatgtgtttaaatatttttataaattcttattttagtaatataaacagttagggttatgatacacaaaacacctgctgtagagcacagaagcatagcgaaaagcaaacacaaagttgaacatgtccacatcactgccagattttcaaaggcaaagttatgcaaatgtttactctcaataaaatatcaacactcaaaacttttagatattgaaacactatattgaaatgtatgaggcagaacactgttgataagattaactgctagtttgcaattcaaatattgtcagccattataagctatgaatgtgataagaaagctatttgctttaaaaaagtgaatgacagcatttgtcatactttccaagttagcgacattacttatgtcagcaataccatgttggacgtcaaactctttttggctgattggaatatttttacttaattgttattattatttgaacaacctgtgaatatacattcaagatgaaaactgacttttcctgaaagacagctttttcaggtttgtcctgcacactgagtcaggtggtatggatatgtccatattgcactccccacaatattccttcttctgtcctttctcctcaattcagggacaatataggattaacacctttgccctaacactccttcttgaaaggagctgcttttttccttgagtcttcatagtgtcatgcacctcatgctcctaatttatattacaaaaagagaatttattaaaagtctttaacatactaataatttgggtaaatataatgaggcaacattttcagcataaatgctgtaaaatattgagctagatattttagctttctttcgggttcctggcttattgtttgaatttgattgctttcagtctgtattttctttgtgccatccagactcaattcagaaatgatttgctcgaccaaataactgtggagatcctcctagaatagaaaaagatacctttattcctattcaggctgtcaaagtataggaaaagatcaataaaatttcacattcaaatgcatattaatttattttcgttagtttagagatttcattgacatgcaagctactcaagttatctcatttttgaacaaagcccagaacacatgcaattttgtttaataaatacatatttcaagacattatttcataacctaagatggatttaggaaggttaaagtgagaaaggaagagagaaagggaaaggttagagtggctgtgactgtggaactagaaagagaattaagtgtgtggaatgaatattaagcagattcattgccacatgtcattatcctgcacccttggatgccattttcaaagtgtcatcacctatccctttgcctttgaagtaccagataacactttaacctctggtctcagtctggagctgctctttagtcttgaacttttccgccactcttctgaacaggacagtcaaaatgaaatgagcacacagagtgttatggagacagcagcaactgggggttccaaattattttggacatgcagagtagtggacagaagatattcgggcaagaatagagagactagagggtgtttaaaagccctagctaaggaataacccaaatggataattactttaattctcttttcaaaagtccaatataatcatttgcattaagtaaaaaaattgtatataaaacatttatatgtagtatatttatataaatatataaaaatatatattatatattatatataatatataatgtttatatattgtagataacatatataaacatgtatatatatataaacatgtatatatataagcatattatatatatatatgtttgcttatattgggttcacagatacagaatgtaaaacagttttttgcagaacatttcttgaggaatacactcaggaggtgcagctatgaagaagtgatgaggaatgtctcaaatcagtctgtgaactcagcatcacatttttttttccagccacttggggatgagtgcttcagttcagaaggaagatcagggccaaacatcatagcaagcagcactcagtaactatgcttaaatttctcaaagagctcaggcaattactgcattggaatatataaatattatatatatatatttactcatataatataaatattatatatatttactttccatgactattattatttttatttatttatttatttatttatttatttaatttttttgaggcggattctcgctctgtcgcccaggctggagtgcagtggcgcgatctcggctcactgcaagctccgcctcctgggttcacgccattctcctgcctcagcctccggagtagctgggagtacaggcgcccgccaccacgccccgctaatttttttgtatttttaatagagacggggtatcaccgcgttagtcaggatggtcttgctctcctgacctcgtgattcacccgcctcggcctcccaaagtgctgggattacattccatgactattattttaggaaggggaaagggaagagacaaaggacaaaaaatcatctagtcataaaacataggatatggtattggaagaagatgaaagaaaaaagaaagagtgagaatctattgatttgcatacccatacttgtatctgtcctgttttctggctctagactcaaaaactgactttgctgtcgtttggggataagtggagaaatgtttattctttgttttaaaggtagattcatggtatgtttatcaaaatcctgtaacgcacattctcaaaggcagggatcaacagaagtagcatacattactccaagtgaaggcttccatcatccgcagtacactaagcgtggcaagcctcacattcccatacatccccactagccttcctgagaaagagtatgatcagatagggcctaaggcaaggcacaagctctccagagaggatttatcagccctttgacagtcagcagggagggaacctgaaggtcatcaggaaccttctcagcccagatggtaggaattcagtagagtctcggttaatttaatgccctaatgcttaaataacaactacatttcttctcaaatggttacctattgttttcttgaacacctttattgcctaggaacccatttcttaagaaatcgattaatccatttctgtgtagttgaattcccaattttttctttctttatgctcagtataaaggaatcccctctgtgtgtgtgtgtgtgtctgtgtctgtgtgtggtgtgttcacacgtgttcttttttccttgccattctcaattttcctggctctccttgacaaatgatactttacgccctggtcatctttacccagaaaaatatattttgtatgtttctttctttagcaaatttgtattgagcccactaactggcagccattgtttaggttgctgttggtaaacagagtacgagaaaaaaaaaagaatcccagttcacatggaatttaccttcttgtggagtaagatagggaataaagaaaataaatcagaaagaaagtcaatatgtcagatggtaataaatgctttggaagaaaatgaaacaagaaaagaaaacagaaagtgcagatacaagtacagaaaagttttaaaatattaaataggagggttggggaagatttcattagagggggatgtttgagcatctctcaatcctgaaagacaggaatatatgaactaattacttgaaacaagaatatataattaaccatttgcacattagctgtcttttttacctaaatgaaattccttatgtttttataatctttattttaatgcctactttctgactttaaattattatatatttaataaaagagataggtctttgtcattgtttttctactttgaaagaactgtgtactttaatgagattattccagttatctatggctgcacagcagcctccccgaaaacttaaaggctaaaacagcaagaggtttattatacatcatagtgttgtgggttataaatgagggcagagctcaggtgggtgattctttgtgctctgaggttgatgttgacagaagcttacagctgccaaatggactgatctggtgtggagggctggagatgctttcatttcgacgtctgccttggtacagttagctgtacagctggtctcacctgggattgtaggccaaggtgcttacatatggcctctcctgtgaaatagtatcaggtagtcagactttttatatggcagctctagagcccccagagaggatatctcaagcaataagtagaggctggcagtttcctaagacctgaatgaagaaagtgatacaatgtcaattctggcgtactctgttagctgaagcagtccccagattcaagggaaagagataaaaccccacaaagaatgtgtgatcattgatattagtttcctaaggctgccacaagaagttaccacaaatttattggcttaaacaacagaagttttttcttagaattctggtggcagaagtctgaaatcaagatgttggcagtaccataattgctccagtctctaggggtgaattcttcctcgtctcttctagtttctggtggatcctggtattctctggattgtggcaacataactccaatctctgactccatttgtacatcgccttcttctctgtgtatcctattctcttataaggaaactgtcactggatttatgtaccaccctaatccagtaagatattttcccaatcggtgtattaattacatctgcagtgaccctctatccaaataaaatcgcattttgaggtttgggattgacagagattttggggaaactctattcaacccactacaccatctatatagccttctacaagatggtggaacggtccggacataacacagatgatgcaaatatcagacaattaggtccacagtactagaatataacatcgtgcaaattgtgctaattgaaaatctcctgcttatacactatcgaggaaaccgattcttatattgttttctttttttacagtgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgcttttttaaatattagttaatggattaaatttaattcttcagcgtaaaatggtgaagaactagcatatagccattgatcataaactgactatcataaaatcaaaacaagtgaaataacaaaatggacatggtggctttgtttaggtagagccacaaaagaaaagacttgtaatatttttatatacagaggaaatctgtaacaggtattttgtttcttttaaagcaagcaacacagaggaatttatacctcaaactatctggccatatttactaccttatcactgcattattctcttttatctgtttaaagcatatagagatgaagtttgtagttgttttaagtactacacatttttaaattgttagcttccttaagtatatcatgtaaagaaatgtcttaatttttgaaaaaagtacatatttattttcttttgaattgtttttattgttttctatttatgccttgatgatttaatatggatttgttacagccaagtgccaaatgctctctcaaattgtcagcaatttaactagacacagataataatgggtttctttcagattttttgaaccatccacttacatatatttttaaaaaatgaaatccttttcctgttcatacactaaccaaatctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaatttcacttatacctgctatcagcagctagaaaacattttttttttaaatcaagtattttgtgtttggaatgttagaatgagatctgaatgtggtttcaatctaattttttcccagactactattttcttttttaggtactattctgagcatactcaacaaaacccatgcatttcataaactaatagaagttgaggattgttgaatctatttcacttattttggctgtggtttccatctgaaagtagaggttgtatacaccatatactgttcttcattttattaatatttttctccttgacctctcataaatttactttacacaattcttaccctgtacatatgtaaacataagtgtacgattcttaaccatggagtagaggtactagaatgcttacggccatctctttgtacaggaactgcattgactttcagtaaacataaagccacaactcctacatgatgttatgtaccatatgatctgttttgtatcttaaatttgatttacatatattatttatttctggtaactcactcagtttatgctgtgctaaatatcaatcaagccatgtataaatgtgatatgattggcaatatgtgtttactttaaacttgtcttttcaaaatattactcagtttatgttgtacaatgtagatggcctcttactaatgtaaaatgatttgtagtggaaacatttatatttttataataaacataatgaaaatattttttacagattggaatacagaagtggtctttgaagttttttaaaaatatataaaactatgtgcttatttaaacagcaaaataatgaaatttacataagtcacaaaaatatgcttctgggcttttattctccattagtgaggagggatttacattgtataatccacatgtttttggtctacatctcattatgaataagccagaaaaataatcagtaaatgttatttcaaagttaataaacacaactgtaatagacagttctcttttgattgcaaataacagaaaacaaataaattggattaattttctaaaaaagaaaatgtttagaataagtgacagaattatctggggataaactccctagctaagagatcagacacagattgaaccaggaattcaaacaatgtcaacagggttaattctctcattctttgtcttcttcccttggccctattttttttccaactgggttgatttgcaagctatacctttctacaaggtaaaaaatactactctctttaatctaattctgcattgcaactcctatgaaagaattactgtctctctagttccaacagagatcatgaggcctttcttggatcacaagccctatcattttgggctggagaatgaatcactcagattggcaagtactgactcctgtgcttgcccttggagatagtgtgtggggttatatgaaagtgatgctcaggggttagaggtgtaaaagtaatttatgtccaacagaaagtcagaatactgtttatgacaaacgaagaaaggaattctggccaggtcaaataaagcaagtaaaaattaaaaaaaaaaaaaaaagtacaactgcacacctgatactttgtatacaataggtcccttgtcattgcagtccacttaaagaaaatgattatatatgaaaatcaaaaaaagctaattcaaaaatatgcaaaataaaataagtgatcaacattcccatagagaaggaagtggttaggaagagattaaaaaaacaggtctgatttgtgtttgccttgaaggagaaatagcatttggtcaagttgagtggagtagagaataccttgtaagcaggagataagttagttaagttaaggggaagagaagaggtaaataatatatttattcattcaataaatacatagtatgcatgatcatgagccagttgttttgctatcatcatttacaagttacctcattaaatcgtttgcaacagtgctgtgaatggagatgagctacttttatctgagaaaggactccaggctcagaatgtccaagtcaccttcccaaggtcaccctagtatgtagatagatatttcaaactggaatcttcctattctgtattcctcccatcatgtgatagctactataatctccacaatgctctggggacagtggcaatgacaatttgcagaagaggcttgggggagactaggtctaatagactatgtgatgttagaaatctattttggtattctatgcacaaagatatacatctaccccaggatggtggtaatagagatgtgaagaatggaaagcatacaaaaatatataaaagaaagaggattaacaaaatttaccgatttgttctgagaattcttcgaaagatagaaatcaaagcaaaacaaaaatttaggtcttgagtgtctgtggaaatgatggcaccattagtccaagtagagaataaggagaagtcagcttaacatcatgggtttgtcaaatatatagtgtaagccagactttaataagttactaagtattggggatgagaatctgaagctttaagaaaaagaattcaagggtaaaaatgtatatggaaagatgtctttgaaagtatgtaaagatctacattacaaatatttatgtgtttcctatatagacatatatttttcttggaagacctcttaggttaatgctagctacatagttaagttctcaaatattatcaacttaaaataataaaaatatgttttttaacacagaatgatccaaagtaggtgtttgccaggtggccttctttgcaataattaagaatctacactttctccatcttgtcgagccttgaaatcctctacttccagccaggaaaatgaaggagaggatcatttggggggattttatgaactctgcttgtaagtggtacataccacttcttctctggttccactggcaacaactcaaccacactggcatacttaactgcaagagaacataaagagagttgtctgacagtgtgcctaaataaaaatggaaaatttctggaatttatatcacaatctctgccacaactccttttaacataaataatatgtcagaggcagattgttctaaaaagcttatcagagaaacatcagtttcttgctaactgtgccaatttcttttcctctataggcaaccatttttcattcttttctcttattacataaatccaatacctctactaatggcacttgtcagctatgtgagtacactgctcagatttcctttcaagagagtttcttgcaagagagcagttagctgacaactgtgagctgctatattttcaaaatccccagcatatttttagcaggccatgctctaccttggttaatgcctgtcaatgactgagtatggtggaagtactagtgccaggccatttcttcacaagtggtaaatccctttaacaagcgtattttgtgttctaatcatcctgactgaagcttgctcaggcataccctacagtctgatctccctactactcaattttccttccttcactctttccttttataggtgtcagaactgtatttctatctgcaagctccttgtgttttctcttaaaccctgttccaatgatgttacccaggcatttctagcaaaaaatatttgcgggtttaattctttctgtgtctgattcttgaaaatcttaaacttagatgactctcaagttgactcacttggaaaactaaaatgttatccttcattcttctctctgccttttcttcagtgtctaactgatcccctaacaatgccaccttagaaacgctcactctcatcccttttctctactgcccagcagaatctctgttggatcctcattacttttctgagttacagatggaatttcttaaattgtgcccctgattctagtcttgatatcttcaacctacaaaagtaggttgaatatgcagccagactaatacggcaaagttaatgttgtagttcctcctcaggaggcttgcaaacgcaaatgcctcagggaactggcaggttatataaatgagtgaagcaagtgaagagtgtggtgacccataaaagtgccttttcttccacgaaaagcaaatttctcaggtgtaaggcaacaccgatccagtatgaattcctggtttttccttttctttgtttttaaggtttaaggaaactaggttttaattttttaagtttttgtaggtacatggtaagtgtatatattaattcttgatttttcaagagaatccttaatctgagtctttgtggaaaaatttctatatatttaaattataacccacttatttatgaacacacacacacacacacacacacacacacacacactctgaatttaccctgcagctgccaactttttatttctaaaatacagactactcattggtattggcacatgagacctatcttgaataaaacccggcttctctccttattttctggttaacccactacctccttacactctatacaactgtactgacccacttgtagttctctgagtattccactttcttaatgcatcatagcttttgacttttttgatcttttgtctagaatcacttagccaatctctaatcattcttcaggtcctcttatatccctaaaaactgggttaggtaacccttcctcgtgcagcagtagaaccctgtacttaatactgacacacactatcttaaccaaaattgcctattctttatgccctatctttacttctagctgaggacaccttgaactgtgttttgcaaaccattgttgttgcatcacctattgcaattttcctggtatataataaacacaaaatttttttgagttgaattaatatattaaaacaatgtttgatggcattataaatggcaatgtatctgattattttttccccgtaggaaaaagtgtaaatttccttcagctcaataaagctagttaatgttctagttatatatcttggatcattgaatatactgatctctgctagaactggttcattttcatagaattttgtggacttgtttcattggtctcaatgctcccacttttcttagtgcagttaagttgtttaagtagacccttgaaccagagcttagctataaaaatttaacaaggtaaatgccaaagcttttctgatcctttctactttctcactatgtacaaataatgtcaacatgcctactaaaagctacccttcttatgaggcttctgggatgcacattctgttgacacacaggctctagatgccatttgggaaaataagtggtggagttagatatgccataaaatgaagagtttggaggtttgcagaagtcctcaccctgaaattctctgggaaaactcagttacatgttgatgaagaatagtaataattgaatcgcattttccaacaaagtgggctatcagctttcctctttgaagaaaggtaattttccacttaacttagaaataaagtggtgctagcaatagtaataatagaagaaaagaagttgcttttcttctattatgtgcatgttacatatatgtacacacacatataaactaacttttctgaataattataattgatgtacattgaacttttactctgtacaaagcccttaacatatattatttgatctaatttttccaagaacttaatgaaataagtatgttgttatccactttataggttgcaacttagaatagctaataatcacacaaggtcatacagctagcaagcagaagaactgaagtcaaaatcgctccagatctcttgttctgaactattatgttgtattagctgtcagtataatattacaacttgaggataaaatctgaaggacaataataaaaactattccagaattaagatcttgggtagtctctattttccacttttcaatgtgcaattgtaattcagtaattctgctagtagaaacatagttctgcagaatcctttgattgttactaccatggtagaggaaggaacaggcagttatccttgatttcatttctgagaactccatttcaacagcatgagatttgcttgacatacagtgaacccttcaagcaaacatgttcccttgaacattcaacaaataatctaatttggaaacaccaaataccacaaggaaaaagtagtacttttgttctattttctgacagatttccacaccagtgatttatggacgtatgttaagtttaggattcttatctgaagccaagaaaaaaacctttatatttttgaagcctatcatcctcaatgatggaagccaaacccttggaatgttgctaaaatcaaggatgagagaatacagaatgtcatgtactatcaagaacttattgactttcatatggttctcatttattctcatacatggcaaattgaaagccttgggaggaagccaatacaaattgttacagataacactatctaaatttaactgccataggtatgcttcatataataaatatatatttcatatcagcaactcagcaaggcaaaaattgaaacagactctagtcaaaattcatttggacacaatccttcagagaagactcaatttgccaatataattatttatcttggtctggagagcccttaatactcaattttatgtttctgactctagagattttatacacacacacatatatatacacatacatatatacacataaaatactctatggaagttagaacattgaaatcataacaatatcttagggtaataaaattaagtttgaatacatgaaagtttagtacctgcctgcagaatcaaatagattaatttgttgatattttcaaatttttaaagacatttttgcaacagaattttttcttggtttaatgggttcagtttgaggcatcatttgagcattaaaggctgtggcatgacattaatttttagcctagtgtgatggttcatttatcaagtgcttaacagagtatctagtatacaataggctagtaggcatacaattagtctttgccaaatgaatattaaatgtattgttggaggacaaatgaacaatattatctatttcaacaattgtagcagagattctgtgcaacatgcagttgctttccatttagattaatgtttctctgaaacagaaagttttgtagaggaaagtcttatctaacacatagacagattcagggcccagcacatagaataaacccataattgttgaataatacacatttataatgtaaaatcactatgggtaacaaaggaatcctattatacactttcctactctggataaagagaaatatatatatttacatacatatatacacatacttaattattaaatggattaattatatacatatataaatatgaatataatatatataaatatgaacacaatatataaatacaaatatgaatacatatatacatatatttatatatacttatgaatacatatatacatgtttatatatacttataaatacatatatacatatatttatatatgtatataaacaaatttatttatatatatacacatatatttatttattatctggcttactaatacttaaagaattaataaatgccaaagccagggatatgactaaaaaactaagatatctttccttttaagatagctatgattgcataacatgagacactgtggttgcataatatcattcagtgacttaaaacaacaaaagtcacttatttcatgttttttgcaggtcaggaatttatacatgggaaagcttgtctctgctccatgttgcctaaacttcagatggaagactcaaactctggcattggattcttctgaatatttatttgttcctctatctggttattggtgttggctattatcggggattcagctaagctcacacgtgccttcacaatgtggcggttggttccaagtacagacatctgaagggaggggaggagaaagaggaaggatgtgagattttaccctacttacaagccaacaatttggcctgccacattttcatggatattggcagttgtcatgaggtttctgggtcagagacaaagaatagtttggtactcacagcagtggcagtatccagtgtcaccattttcatacacgaattccccaaggcctaatttctacaaagttctgcaaagagagccaagtcttgcctgcatatgcaatgagttttgttgaagaaaaggaaactcatgtttaaggaactacaatcttttataattggctgcaagcaaaactgcctaacaatttcttcagagagaaatgtctttatcatatcggagagttaacaaatctaccatttgctgcaaaggggagtactatgtctttattccaaggttatttaccatacaaatatctttgaaaagataatgcggaaaagagggcagttagtgcctctgcttgaaagatatgcagaaacatgaaagacccatagagaatcttttcctccgaaagactcctttcaatctttgtggttaagaacaatgaataaatttaatgtaaactcattaaaagatttaacctcaaaaaattttaatatccacatttaagatttctttaggagagaagaaatcaactcccttaccctcatcctcctttggttaggaatgactacacagcatagaaaacttgggactgttaggcattaaacaatcaaaagattcttctcaaattaagataatagcttacatgaatattttatgaaaaatagccacatttgataggcttttcattaaacctatatataatttgggtagaattcacacctttacaatgttgagtttttcaatccacacatacggtatgcctctttgtttatctacatcttctctgatgtctttcattagcattttgtaatttttagcataaagatcttatacaagtatttttttaatttgtacttaagtacttcaattcccttggcataattataactgatatatatatatgtgtatatagatatacatatatattatttatttatttatttatttatttatttatttatttatttttgagaactctgtcacccagactggagtgcagtgacacaatctcggctcaccgctacctctgcctaccaggctcaagctattctgctgcctcggtctcctgagtagctgggactacaggagtgcaccacttctgtccagctaatttttggatttttagtagagacagagtttcaccatgttggccaggctggtctggaactcctggccttaaataatctaccagcctcagcctgacaaagtgctgggattacaggagtgagccacttctcctggccctaatattatatttttaatttcggtttctacctgttaattattgaaacatggaaatgtgattaattctcttgggtttggttatatattctactatctagttgcattcatacattagttctaagtttttattttgtagatgctttgggatttttctatgtagacaaccatgccatccccaaactgtgaaatttttacttttttcccttccacttgtatgcatttttatttctttttctttctttattactctggctagaatttctcctactatgctaaataaagttgtgagcagacatctttccattgttcccagtcttaggaagaaagctatcagtctttcactactaagtttgatgttacctgaaattttttgtagatattccttatcaagttgaagatattcccctctatttcaatttttctgagagttttttttcatgaaaaagtgttgaaatttttcagattttttttctgcctcaattagaatgatgattttttttttctttttgatttggtgatcatactgattgatttttgaatatggaatttgtcttgcatacctggggcaaaatatgcattgttcatggtgtgtaatcatttaatacattactgaattcaatttcctatgattttgtagagcaatttgtgttgaactttctgacacatagataggtgtagtttttgcccatcttttacttctttaatttttctttattttctttgttgggctttcgtatcaggataatactggcctcataaaataagttggagaacattctttttttattttctgaaagagattgtataaaattgtgctaattcttttgtaagtgttagagaattctctagtgaaattacctaggcctggagatttctctctcaagctattttaaattataaactctatttaataactacacaactatttagtttatttcaagttggttcattttggtaatttgtagcttttgaggaatttctcaattttaaaagaattgtcaaatgtgtgagtataaaaatagtttgtattattcccttgttgttctaatcattatgaaataataccacttgtttcattaccaatgtttatgataattgtcatgactattttttggatttttaacacttttattaactttttgggataaaatttttgttttgttggttttctctattgtttttctgtttgattcttgtttgtgtgtgctgtttataatttctttcatttgcttgctttgggttattattttctctttttttctagtctcttaaggagcttagattgtttatttgaagcattttctcttttcaaaaataatcatatagtattataatttttcttttattgctattttagctgcatctcattaatattgatgtttgttttaattttctttcaattctctgtatattttatttgacttccttttttatccatggattatttaaaagtgtgttttttaattttcaaatgtttagagattttcctcttgtctatcattgatttcaaatttgattctattaaaattaaatagtatattctgcatgatttcgattattttaaatctactgaggttagtttagtgagccagcatatggtctatcctggtgaatgtttggtggacaattaaatagactgcatattgtgctgttattgagtggaatgttttatcaatgtaagttgaatcttattggttgacagtgtttttccattctcctctatctttgctctctttttatctaatgcttctatttcctgctaacagtgggaatttgaagttctcaactacaggtatagattggcccatttcttctttcagctccatccaattttgctttgtgtattgaaaagctctgtttttttttttttttttttttttttttgcacatacacatttaggacacgatgtctcttgttagattaatcctgtcattactatgtaatacctttctttgtccctactaattttctttgctcttaagtccactttatgtgttatgcaattatatatatattacatatatttatatgtaatatatatcattatatattgtattgcctcagagctaaagcaattttacctcctaaggtaaaatagagtatgcaaacaaatattggccaaataccttacttttaaaaattaatgtttgcataacatattttcatccatcattttattcttaacacatctgtgtcattatttttgaagtgagcttttgtagattcaatgtagtggggtcatcgtttttatccattctgtcaacctctgtcttttaattgatgtatttattccatttatttgtcaagtaattatattatggcttaagtctgctaatttactgtttgttttctgtttcaaattatgccctttctcttttcttgcttttctgtgggttccttgacctagttttattttagaattacatttttgtttataaaatttttgaataattttgtataattttcttaatatgtgctcaaggtatgacaataaacacttgcaacttcaaaaagacatgcaaactcttaaaatgtttatgtgaacaaatattatcttctttacctgtggcaaatgataactgggctagagatttttataagttcttccagttctaacaatctgtattatgtgatatttactgttataaatctattaaaatttgaaaatgacagtgctgtatataacaaaataaaagcctatgactctatccatgctacttagcagggctttttgaactggtttgtccagagtttaaagagttatttcgaaactattcaggaccctcttgcttgcttgtggtaattcagaattattcagtacataagaggagttttaagcacttgtgttcttcgtgctcttaaaaataaatgcaccctaatttgcttcttgtattttttataattttacatagtaataaagacttcaatagttttaagatttgtaaaagtcactattgtaatataagctgacacctgtgattggtttatttggttgtagatcactgaacaactgagaaaagaaaaacaaaagcacagagttagcaaagtttctattatcaccaatataggccaaaaattccacgcatttattcagtggcaacaagtaatgtaggttttttgttgtttgtttgctttttctgagatatctactctgtgccaggcatgatttgaggcctcagctatgttggtgaaataggcaggtaaagactgtagggaagatggaattaaagttactgttgaagcccgaaaaaattctagttctttttgatccttccaagagctcagatgctaagatgatttgttgttcccacaatccatgcatcattaaataaacccataatcactaagtaaactatatattttctgttctttacattctgaaagcttctaagggacacccttagccatgatactgtatggtcttgaaaatttggctaaaatcatttctatttgtatacctctggatgttttaaacactacagggcttttaaaaagtgacattttgaatagataagaaaataaacattggtatcagcaaatattagatattactgtgagttcttgctgttatgcttgttaaaaagtatcatgatggaaagaaatcaggatttagaatcaaacaaatctgtgttcaagacccttagctgtttttgttagttgaattcaatgctggctgaactctaaagactcagttttttcaccatgtaaacaataatcattatataaagctaatagagctggaaagataaagtattatgggtaaactgctttccttagtttatctacttaagtagtgctatttcctttctttatttacttaccttgatccaagtgaaagcctagttttaggatttacttttaccaaaattgtactctgaaccaaatgagctcaaaagttcaactttgaaaagtcaaaatcatagaaaatttttacattgaaactgctcaataattgttttcaaaatgcacagcaggacttctcttatttaccatggtgaataaaatgactttagtttttgacatttgaagtatataataataaaagttatagaagttagaaagcttccttcagggaaatggaatatttttacttcctatgaaagtgatattttggtctcaatttaagtaacacaaaacttagttttcatttcctggttttaaatgataagctgtatattcctagtttacagtaaaccacatatttttagagagttagaaacgttgcttcaaagtggtagatattaagtgtcataaatgtccaggctgtaagtatggtttcctgttgtgtaagacataagttattaggtttagtttgaaatgacacaaaatgttcccgacttctaacaattaaaagaagaaatgtgaggctccgagacaatctcggcaaatttgtattctgattaaaataattatttgatcctatacagttcagtgcatggaaaaatgttgtctagttactcaattcaatgtggttgttagagaagaaaatatgtctcttatgtggggtttgagcttcatgtagctttgtgattgtatttgtttactcacggtggaaatctccttattaaattgtgggcaagaggcaacccatggtggaaatctccgtattaaattgtgggcaagaggcacttctattggtttttctaacagtaactacttacttcaggaaggattaggttaaaatactaaatgtagatctctagagttgatcttgtaacagaactagaacacattgacttgatatttagacatgtgcagaaggcaaaccatttcataaagggctggatataatttcttctttcagttctaagtcaaaatttaataatttttttctatttttaataaatatatgggcatatgcatctaatagtgaggtttggtaaagactcttcttcactttagttttgcatgtgtgggcaactgacctttatgttgttacaaaatactacttaaaaataaaaagctcaattctgtacagaaatgagccattgttcgttgttaggctctcattagctgttatagtatcaacactattgtcaacatgatgtggatcttgaattgttttcccgtctccactgctaactgtgtgttcctcttgttcttcgggccagttgaaccatacatcttgtgtcctaaaaccatatggagcatgtttttgtatgaactctcatgattaaggacatctgtctcagcctctacgtttgccttcaggggatctttgcatcatttaatggtacagttaacagcatgttttgcatcatgaagttggccgtacagtttttctgcggattctactgttttcattccttaaaaaaacacatggacgagtctatattttgtctttctgtctcccattctaactttcttgcttttcttcctccctcattctctttcttttttttttctattaatatttactggccatcaccttgtgtttagcaggtcttataatattccaaaattgcacattttcaaaactgtaaagattgaccacaatttctaaatgtaattcacttttcctttcaattgcttgttttgagtgtaatttggataccctaaagttcatgtgttacttttctatttattttgagtaatatgattcagattcaactcctttagatattactgaaaatattcttaagtgaattgatacaaaatatccacattcctcataagttatcaaaccaaaatgttgctaactctatactgaaattctactaattcttctgactgtacagattgattcgtcagtatatattagcaagtatttaattaaaatctattttaataactttaaatggatatagtagcactctaaataggaaatgcagtcattgaaactctcaaacactagggaatagatataaaatatgtgcatttaatcaattatatgttgttgatttttactttataatctatgacttcctttgttgatgtcaatattgactttctttaaaaatctctaaattatgaaaaagtctaagttattgtaatctacattatagactttttctagtatgttttactcataggtaaattgttactagtcccattaattgcaaaatgcagtggtcatgtgtttccaaataatttcaaattgtagaaataaatacagacagtctccatgaaagcatattgattcaagaattctatttattgatatttatttactcttcctaacatttatatttactcttcatagtgcataatgtttgttcagcagaaatatcatcaaaaaactattgatgtgccagttaccatgatgcaccgaagatacagaaacgaacaagatgtccccactctggtgaaggagtctatttgttgttggtattgacagtgtgagaggcagatgtagaaacaagattgacagactttgtatttaaaggtgtaagtttcataaatggatacatagaaaaatgaacacgtttaaattaatgatgtaaacatgttaatattcccaaatacaaatataagtctgtacagtgacttgcttttttaaaaagcattgaagtggaatttgcataccatgaaattcacccattttaagtgtataatatgttgatttttgacaaattttaaaatcttgctagcatcaacacagtctagttttaaaacccgttcctcactccagaatgttcccttgtgcccttttgcagtccctcactccacattccagccccaaacaatcactgatctgctttttatctctgtagattttccttttctagatatttcatgaaaatgcaataataaataatgtataaatcattaaagatttatagcaaatgtagttttgttacccttttttcatgtttctcaaattgtttgtacaaggaaaattatttcagttggtattttgaaatgtgggagaggcctttgactaagaactttaggagtaacacccctaactctcattatcttcattttacagatatgaagactgtgctttataaaagatcagacatttggctaatgacactgctactaagtgacaacagagatttaaaactagttctgtctaattctaaatccactgatacagtttctcagaaagttgaaaaacttttaacattataaactcattgatagtgatggatatttgttcttttgttgtttagtgattacctcaagatctacaacaatgatcagcaatacaatgggagttttagttgtaatcagctgtttcatattttaataattattaaacactcatgtaccaaatacaatgctagctgcctgaaattacaaaaggaataaggtttgatataaagtaccacataggccaggcgcagtggctcacatgtgtaacaccaacactttgggaggccgaggtgtgtggaccacctgaggtcaggagttcgagacctgcctggctaacatggcgaaaccttgtctctactaaaaatgcacttagctgggtgtggtggcagacacctataattccagctacttgggaggctgaagcaggagaattgctcgaaccctggaggcggaggttacagtgagccgagattgtgccattgcactccagcctgggagaaagagcaagactctgtctcagaacaaaaggtaccatgtagttttcacttgttctaaaaatctcctctcattgtgtaactcaagtataaaaatccatattacatctgaaaaaggagttattcttctgaactctctctaccctccttaaagccaagtatatgccactttgctatgtcagttgatttgacttatatttggtacacagattgcatttttttttttgtaggacagaagaactccctgtcaagctagtttaactgtattacatctaccaatattcaattatttaattttttcaaaagtgaatgcaatcataatacatccaaatacaacctgaaactgttgggaagtaatgcttaggacaaaatttcaatctggtttactggaaaattttagcaataagtaaaaatcttaatgtgtttccatatgcatggtttcacacactttttatcaagtactagaaaaacactgaatgctaatgccattgaattttgctgaattagtgtactatataactcctttcatattaaagattttacccacttaacctcaccagaagtagtgttttcacagtgcatgattatgacaaagatagaatgatagggagaggggaaagtgccatcaggttcagggtcaacagaaaataaaactcgttctctttttgtaatcagttataattcccatttcaatcaaaaaaattattgtaaagtattttcttgaaatttgcttaaatttttcatttttaacaagaaacgttatttataaaacacattacttgtgtgcatataggtgttgggtctgagaaagtatacattattaatttgatgtgttattaaaagattgctgtcaaaaatctgtttagttaattgatgctgtcaattgctcgcattaatacctaatactcataatatttgtacctaaatttttcttataaaattgtttctcattggtttttattctttttatttctcctattttttaaaattgaagtttgtagtcaggtcatgtgaccacatcaagtccatcattcaaacacgtatcaggaaattggaaatttaaaaatgacttatgcatggatatgatgccagaggcagagacaagggggtgggggctgtttctaaataccttccaataacaataaaaaaacggaagttatttgtgatcttagaagatggctaaggaaaaactgaaacctgaaactgaggaaacaaaagtttagacaagataatcccaacatcagagaaagcatttgtcattgtcagaactccaaagagcaagaaagctttaatccatttcatggaccctaggactcatggtctagtaattcttatgtcaccaaaccatcttaggatctgtatgaaattacagtgtgtcaccactctacatctgcaatcttaatgtttccgtcctttgattgtatgacaaggaaactcttgaaccagagcactgcacttcacaggagtctgaaagaaccagctgctcataattttggagttttatagggctttttagtctcagaatccctgtctgacctatgtccatatccagaattcattttttttcatttccagaattcttcagaaaaaactcttgctgtcttttaacgtcttaaaacatttttcaaaaaatatatagagagaattagaaagccactcatagacttaccctctttctccgttgcttcttcagttgtgtaatagtcatgaaatctggaatgaccattttaaattatattcactgagtttgaaacaaaacgtttttagatggttttgttcccttaaaaatgaatattattgtctagcattaacattcacccaaattgatagcatattgaattatgtgtgtagattcttaaacgttttgttgtgaaacatcaaaagaaatcactgactttttatttaacataaataaattaagggaagtttagaaatctaattgttggaaaaataaacttctaaacataactcttcaaaagtctacgtgctcacattttctattcccgaacaaaaacttttgcaaagctctctgaaagccttgtaaaaggccaatgaatttcatttagcattaatttccctactcaccacatagcaaatatatgacacaacttatagttctgttaaaaaaaagccagaactgttacctgagcaactgcttataaaagagcgaggcagcttacgttttatctattttttgtgtgctttctactaagttttacaatctaagtgtgttagaaataaaatcaaattcattaggaatctctatgcataaaaggaaattaaatatcatactcaatgacttgtgccacctgtggcaaatagttttacatgccaatttgtgttttcagggtttttttgtttggtttctttggtttgtttatttgtgtggctttttcttttttttttcttaagaaagtgtctctttgtcattcaggctgtagtgcagtggcacaaacatagctcactataacctcagacatttggccttaagcaatcctcctgcgttggcctccaaagtgctaaaattataggcatgagcccccaagcctggacttttccttttttaattgctgaccaataatagttaccatacaaatttcagttatggtccatggttgattcatttttaagatcacaataaatgtatattcttaaaaattatttctacaaattatgaatatttaaatgaaaatacaaagggttcctttcattaagtttgggagatgttatatgctctatatcacctgttgatgaatctctatgtttgttcttaacttttccagaaagttcagtactaaagcatctgtttaatggtgttcattctacatcattcaaatttatttaaccagagaatgcttttcactaggtatctgttttgcagaacacacactgggaaatgttgtcgggtactgtactgaatcacactacaacattttgtactgacatgatggtcaaaggttgaaatgtttttcttatttgttttcttatacatttagaaagttaatgcaaaatatataaggtaccttgtccatcaagagacttgtcatctatcatagcgtgtatgtgttgctctctcttttcctaagatgctgcatatccctcttctgttgattcagtagaaaattttatgattatttttcccttatatccaaatgcaaaggagtttaatcttaaagacatcttcttaaaagcttcttaaaagaagcttaatcgttccctttgaaaaccggcacaagactaggatgccctctctcaccactcctattcaacatagtattggaagttctggccagggccatcaggcaagataaagaaacaaagggtattcaaataggaagaaagaaaatcaaattgtctctgtttgcagatgacgtgattctatatttaaaaaccctatcatctcagccccaaaactccttaagctgataagcaacttcagcaaagtctcaggatacaaaatcaatgtgcaagaatcacaagcattcctatacatcaacaatagacaagcagagagccaaatcataaatgagttcccattcacaattgctataaagagaataaaatacctaggaatacagctgacaagagatgtgaagaacctcttcaaggagaactacaaaccactgctcaaggaaataagagaggacacaaacaaatggaaaaacattccatccttatggataggaagaatcaatatcgtgaaaatggccatattgcccaaagtagttcatagattcaatgctattcccatcaaactaccattgacattcttcacagaattagaaaaaaactactttaaatttcatgtggaaccaaaaagagcctgtagagccaagacaatcctaagcaaaaagaacaaaactggaggtatcatgttacctgacttcaaactatattaaaaggctacagtaaccaaaacagcatgatactggtaccaaaacagacatacaggccaatgtaacagaacagagacctcagaaataacactgcacatctgcaaccatttgatctttaacaaacctgacaaaaacaagcaatggggaaaggattccctattttataaatagtgctgggaaaactggctagccacatgcagaaaacagaaactggaccccttctttacaccttctacaaaaattaactcaagatgaactaaagacttaaatgtaaaacccaaagccataaaaaccctagaagaaaacctaggcaataccattcaagacataggcatgggcaaagacttcatgactaaaacaccaaaaacaatggcaacaaaagcaaaaattgacaaatgggatctaattaaactaaagagcttctgcacagcaaaagaaactatcatcagagtgaacaggcaacctacagaatgggagaaaatttttgcaatctacccatctgacaaagttctaatatccagaatctataaggaacttaaacaaatatacaagtaaaaaacaaacaaccccatcaaatagtgggcaaaggatatgaacagacacttctcaaaagaagacatttgtgccaccaacaaacatatgaaaaaaagctcaacatcactgatcattagataaatgcaaatcagaactacagtgagataccatctcacaccagtcagaatggcgattattaaaaagtcaaaaagcggacaggcacaggggctcacacctgtaatcccagcactttgggaggctgaggtgggcagatcatgaagacaggagtccgagaccaggggttcgagaccagcctgaccaacatggtgaagtggtgaaaccccatctctactaaaaatacaaaatttagccgggtgtggtggtgcgcacttgtaatcccagctactcaggaggctgaggcaggaggggaattgcttgaacccgggaggcagagggtgcagtgagccaagatcgtgccactgcactccagcctgggcaacagagagagacttcctcaaaaaaaaaaaaaaaaaaaaaaaaaaaaaaaacttccagaagtaatagaagctggagaggctgtgaagaaataggaatgcttttacactgttggtgggaatgtaaattagttcaaccatcattgaagacactgtggtgattcctcaaggatctagaaccagaaataccatttgacccagcaagcccattactgggtatatacccaaaggattataaatctttctactataaagacacatgtacgtttattgaagcactatttacaatagcaaagacattaaaccaacccaaatagcaattaatgataaactagataaagaaaatgtagtacatatacaccacgaagtactgtacagccatgaaaacgaatgagataaagtcctttgcagggacatggatgaagctggaagccaccaccctcagtaaactaacacgggacagaaaaccaagcaccatatcttctcactcctaattcggagttgagtagtgagaacacatggacatggggagagaaaaaacagacaccggggcctcttggagggtggtaggggagaggagggaacctagatgatgggttaatagtggagcaaaccaccatgacacacatatacctatacaacaaacacatgtatcctggaacttaaagtaaaataaaattaaaaattaaaaaaagaagcttaatcaatgaggatagaattaaaagttcattttcccaatgattcagctggtatggaactcagtttttatttcattatacttaaatcaatttagtattatatgtgtcccttttatgtttcttatataatgcaaagtaaacttcactgagaagaatatgaattattgcaaacttggttgctattttgaaactttataggttcataccaacacaatgtgaggacactttgcaaacacattaaaacaaatattaggttttcatacgaggaaaatgtgcaattaccaaaggtaaacttgaaaatactatctttcaataaatgggtcctcacttttatttggaatgagtcattttatcctgaaatagtgcccaaaggctaggagcagactgaccccaagcaggactgcttgcaaaaacattggtttggaaatcactgggcagtactgccctagcactgtgcctgggataaagtttctttcatcatttaaagtttcccattcactcttatcaagtatgaaatgtaataccccttgtagttcaaagaaattttgttttgcttccctttctctcagcgttgctccagtattgacccaaagcctccttgataagtcagttagcctgatatcactaaacacgtggacagtaaatgttctgacagccgaggaagcctcggggaaaggaaaagaagtaggaagcaaacagccccctgctgtttgggccagaatttacctcaatttcacttccagaatggcagagagagaggattagtaatgttccttctggagccatcagcaggtaatagtgctttcctgctcatcaattaggcccacggctgtcactgccacctgggtctccttgggggacttggctgcatcccagtgtgtgagacacagagggaacagagtcagaaagttactgaccactgcttaagcagagccactcagtgctgggtcattggttggcaacatataccagtacgtttagaatcatgatttttgacagaaaatggaactccaaaatataagacataaaattgaaagtgatgccatacagcagaatagatttgagggagaaagcatctccatatgtacatttctttttccctaaagaccctgtttattctgaccttagcctgacctcttcttaaaatcctgttgccgcaaactggagcaatgaggtcacctcaattctaccttgactgcttcctgctaatagtttagaatcctaaatagttctgcatgcttctctaggttgtttcagccaaaccagccagtcaccctgaggtatgcaatacagatgccatattaagactcattatgtctaaaaaagtgacatgtcgtacttacaaagtcaaactgaaatatgtctacctgtgtggcaatgtttggcaaaattactattgaaatcttcagagagattttggtgattatacagtctctcatcggaaacatagtgatagaagtaaaactgtttgaatgaaggtaagatggggcgatgctaatttgtatctacgtcgtcagagctgtttacgtcaatgttttcaaacaaggcgttttattgagaataacacatagcataaagtcaagatcagagtttgtttttcaatgaagctaattctatctcatttttaatgtatatctttagccaatggggtacaactggccagtgacctcttggagaaatagtgagcacagttcttcatttgtctaatataagagattgtgtattacataggactaaggaaaatttatcattgtgacaggaaaagataaatcatctaataactgaatgataccatatgtagaaactttcaaaaatatttagtactttctaccctttagagtggctcacttttgtctgcatccactctccttggtatcttgtagttgaaatcaacaatataaattcagtgacttctgctagcctggaaacaaagccctgattgatggttctagcagggaataggtaggcacagataggagctgagcctttattttcaagtagcatcaagccggacacaaatcaatcaaatcagaacttgccgctacccagacatgaagctgttcatggataataggatgcttccacttatcatttttatcttacatcaggagatgttaagtaattccagtcatccttgaataaaactgcaggatgaaatattcatcactgtgtttcaaaacaaaattaacctttcaaaaatctttaaactctttcaaatataaattttccataacacacatagtaagggaaagaggattttccaggcataaaagtgggaaacaatgatacaagttacacatccttacacatcatataggataaaactcactcattcttatcaaaaataaatatttcttaggtctgcaacaacttcaggtccaagaagcacttgacaaaactattcagactttgtctttggggagctttaggtgtcagacttgagctctgaaactcaagtcacatccggaatatctagggaattacatcagtcatgagaagcaagttcatagtagcagagttttgttttgccagaatataagagtgaataccaacagcaatacctaatattgccatgtgtgtactaggttgtaattacattgaagtggaatgcttcaagtttagaaatcagccttcataacctcacaaggtggtttttttttttttttttttttttttttttcacttacaaggggcactgatattttttagagctggtagtcacacatcaacaaaattcattttctcttatgagaaactaagattatatcagagtgtgtttatatgtgtgtgcttcttccttctaccctgcagctcttgctagtataaagctgcctctgatgtggaaatgtggatgcctaccaaaaatagtgccacatgctgccatttatggatgtatcccaggggatgtgaaagagggttctcaagccctactagtcttattttagtaaattctttcatctgttgtatttttcagttcaaatcggaagagtttgttgcttgtctaatactagatgatgcattacattgaaaatgagaaatccacatagcaacaagaatacagtgaaagcgcaggcttctacttaaaagctgagtaataccacatgtaggatgctaaatgtttataaaactttgtgggtgggttcatggaatcaaggcctttccttcgatttggagacctgtttacagctgtactcagtagaaaggaaaatatcactgggcttgccacttccaaaataccactagggaaagaatgactaacttggctggacatttagttttcaacttaaaaatagtattaatatagagtttatttttttctatttcttgattggaaagttggtttaattattgtgttgccatttggcacttaactttagctttgcatcctttggaaataagcacacattttattatattttaacatactaagggatttatgttgggtttaaaaatatgatggaagaattttatcatgtcaaagcacaaaacaaccataccaataatgcattataggtgatgatcaatgcatttaggttcagtcctccttagaccataagcatacaccttcctgtttgggaaaggtggaagttgtccatctggttcagcctctactaaccttgtaaaggaagaggctcacaaaaattccttcaagaagctgcgtgccagggttccctaagaccacccataggctggttcagcatgaatttgccaactcattttgtttttatatgtgaaatattgtaaataaatggtagaaatgtccataaattcaaagtatacaatgtttacttaatctgcatacttgtcttatcacagacttacgagaatgtttttaaggacctccacggaggaagattccacagttttaataagcgatttattttacaattcaactaacatgaagtatatactatctgacatataatctttaatatgtaaattagttccatctccttttgataaaatctgagtgaaaataggaaattacttattcataatcttataaatattgatagatttaaaaatcattcttagggttccatttagctttcagccagaacgtatatatgtatgtttattttatatatatatttcaggtggggattttgccagttgctgaatatgcctattcaattgcatcttccagaactggggaaattagaggaccaactgggccaactgtgagataaatttgagccaaaacaccattgatcacttgatccccatcaccccctactgtgactggtagactacagtgacactttggctctccaagtattagtgtcactaatgctctaaatgtttcttttcctttctccaatgcatagtcatcttggtaaatggtgacaggtccatttgaacaaggttggaagaagaattaacagtaaacttttgacagtgtagcaaggctcttcctcaacaggatccaggccccttcattcaaggggttctgagtgtacactgctatttactatagtaaccttccagttaccttagaataatatatatttattcaatttattaactgttgtgcagtattgaatagtcattcacctaggaacaaatgttttaatttgttccaagtttctaatgctcttgcaatgcaacaaattagtgcacactctctcttgaacatgtgtcctcctcttggttagattcaaagaagtcatatgttggaaccaaggagatatatatatgtgtgtatatatatatatatatatatatgtgtatatatatatatgtatgtgtatatatatatatgtgtatatatatatgtgtatatatatatatcctttttgaaaatttcttattttcactcagattttatcaaaagagatggaactaattcacatattaaagattatacgtcagatagtatatacttcatgttggttgaattgtaaaataaatatatatatatggatatgtatgatttcctatgttagaacacacacactatgttgcatccaaatttaatcaccaacagtgctgtgaaaaagcaaatttccttaccattgacatcatggaaagacaaacggtaatgggaaacatagaggagtggcattctcggcagtgcgatatctccgttcatgaaaagagctagtccttctaagaccacagacacatggcttcctgtttgtgaggaaagggagttgtacatttgtttaatcacacctccatccttggaagagaactcaagaaaactgctttgctcattttctaatttggtagtttgtcttttaattgctgaattgtaagagttcttcatatatcctgtataatagtctcttttcagatatttgatttgcaaacatattcttcaattttatgaatagtcttttcattgacttgatagtatcctttgaagcacaaagctttccatttttagtttgtgttttggtgtcacatataagaaacgactctgtaatccaatatcatgaaggcttatgtctatattttcttctaagggttttctagttttaacttttatatttagaatttgataacttttgagttgatttttttatatggtgtgagttggaaatgcatagattttggaaatgcaaattgaattttgaagcatctttttttgaaaagattatttattccccttatgaattttctttgtatccttgtcaatactcaattggccataaatacaagagtttatttttggcctctcaattccattccattaatctatatgtctatccatataacaattccctgtagttttgattactgtggctatttattatgttttgaaatagagaaaatgtgagtcttgcaactttgttgttctttttcaagactgatatgactattctcattcccttacatttctatatgaattttatttttatttatttaacatttaatttatgggtaaatagtagttgtatatttatgagatgcatgagatattttaatacaggcatacaatgtataacaataacatcaacgtgaatggaatattcatcacctcaagcatatagtatcaaatatggtaaatatgccacattttctttatccatttgtcagttgatgtacacttaggttggttccaaatcttggctattgtgtacagtgctgcaataaacataagcatgcagatatctcttaaatataatgattttcttattgggagtatttaccagcagtgagattgctggatcatatggtagttctatttttaattttttaaggaaccttcaactgttctccagagtggctgtaatgatgtatattccaaccaacagtgtaggagggagggttcccattttttcattttcttgtcagtgtttattattgtctgtcttttggctaaaagccatttttaactggggtgagatgatatctcattgtagttctgatttgcatttttctgatgaccaataatgagcaccttttcataaacctgttgccatttgtaggtattcttttgagaaatatctattcaagtcttttgcccatttttaatttgattttttttcctattgagttgtttgagctccttatatattctagctattcattccttgtcagaaaatagtttgtaaatatttcctcccattctgtgggttgtatcttcactttgttgattgtttcctttgctgtgcagaaactttttaacttgatgtgatcccatttgcccacttttgctttggttgcctctgttttttggggtattactcagaagatctctgcccaagaataatgtcctggaaagatcacccaatgctttcttttagtagttttatagtttgaggtctcagaattcatcttagatttaaatctttaatccattttgatttgatttttgtatatggtgagagacaagggtatagtttcattctgcatatgaatatccagttttctcagcactatttattgaagagactgtccttttcccaatataggctcttggcacctttattgaaaatcggttcattgtagatgtatgaatttatttctgtgttctctattatgttccattgatctatgtatctgttttttgtgtgtttgtttgtttgtttgttttggagacagagtctcactctgtcaccaggctggagtgcagtggcacgatcttggttcacttcaacctccgcctccctggttcaagtgattctcctgtctcagcttcccgagtagctgggactacaggcgcgctccaccatgcccagctaatttttgtatttttagtagagacggggtttcaccatgttggccaggatgatctcgatgtcttcaccttgtgatcctcctgcctcggcctcccaaagtgctgggattacaggagtgagcaaccgtgcccagccaaatctatgtatctgttttaatgtaaacatcatgctgttttggttactatagcaatatagtatattttgtagtcagataatatgattcctctggttttattctttctgctcaggatatctttggctagtctagatttttgtggttctatataaattttaggattttttttctatttctgtgaaaaatgtaattgatattttgatataattcaatttctttttgtattatatatttataaaaactttctatttctcattgggttattttcagtagttgtgtcttcctagaattgtgttcatttcattgataatacctaatgtattagcataaaattataaataatggctccccagcaattatttttatttctgtaaggttgatagtaatgtgtctttttcattccagattttagtaatttgactgttctattacttttttttccctcttggtcagtcatgctaaatgtttgttagttttgttaatattttaaaagaatcaatttttagttttattgattttctctattgtattctagttcatattgtttctcctcattcacttttttcctattctaatttattgtccttatgcttacattgcatttagtttgcatttctttttcagtatcttcaagtgaaatgataaattattgatttgagatctttattcatttttaatgtaaggatttactactgtgaattttcatttcaacactaaagtagctgcatcctataaatttgatatattttgttttcatttttatttatctgaaagtgtctttttactttcccttgtaatttattctctgatctatttattatttaaatatattgtttagtttccacatatttgttaacgtcccaaattttattaaattattgatttctgatttcatgtagttgtggtaagaaaacacactatatctaattttaatcctttaaaatttaccgaggcttgctgtgtggcctcatttatggtctgtattaaagaatgttccatgtgcattagagggtaatgtatattctagtgctgttgtgtagagtgttctatatgtgcctaataggtttagttcataggattattcaagccttttattttcttaattttctgtctagttattccttgatttattgaagtgggttattgatgctgatagctgtaaatatttaattgtttatttctctctcaattctctcagtatatgtttcacattattttgtggcattttttagaacaaatatgtttataattgtcatatttccctgggttaagcctcttatcactataaaatattcttttttgtctctagtaactattgttgcattttgttgtattaaaatattttatctgatattagtataaccaattcagatttatttatgttacagttgtcaagctatatatttttctatcattttagttgtaatctatttgtgtctctaagtttaaagggtatctcttatagacagcatatagttgaattgtgtttcttttgttttgtatttaatccattctgccaatctctgtcttttcttgtgtttgaagtgtttcatttgtttacattaagtatagttatatgctaaactaataaattatatcttatgtctatcattttgtttctttttgatttgtctgtgtcttttttctctgttcttctattagtgtgtgtgtgtgtgtgtgtgtgtgtttgtgtgtgcgtgcgtgagagagagagacagagacagagagagagagacagagagagagagagaaaggatatattttatttttatatctgggtaacatagttaatttccttactgtatttttttactgtctttttgaattattttcttattgttgtcttagtgatttcggtttctaacaatctaattcagattaaaatgctacttaagtttgtttccaaaatagttgtttacatgtagttctagttattccccccttttctgctattatctcatacaactttttatctatatacagcctattcccatcaacagagatgtgtaagtattgctttatgccgttgtttttgaaattagataaaagaaaaaagtagttgcaagcaaaataatacatttgtaggtcctttctacttagatacatgtttacctgtaacagtattctttttttttttttaatttaacttctattttaagttcatgggtacgtatatgtgtaggtttgttatataggtaaacttctatcataggggtttttgtacagattatttcatcacccagttattaagcctagtacccatgagttatttttcctgatcttctttctcctctcaccctctaccctctgataggccccattatgcagagtcgagttcttgtgaagctttctttcaattcttactctggagatctctttagtatttcttgtaggacaaatctgttagcattaaatatcaccagttcctgtttacgtaagactgtcttaatttctccttttctgtagaatagttttcttggatatgcaattcttggttgactttttttttttttttaacaaaagaagaatagagaaaaaaagggccaaaaagaatattagaagacataatgatcagtgataaatactaatctccacattcaagctcaataatttccaagtaaaataactcaatgacaactgcacttagacacattataatgaaactgttgaaagccaaattcccactgtgcatgtattggtatacatgatggggtcccacaggtgtctgagcctctattcattttccttcatttgtttttctttctgtctctgctactggataatttcaattgacccatttgcatgtttactaattctgtcttctgccaactcaaatttgctcttgaatcttgagaatattttattccagttattttacttctcaactacagaatttctattttttattatttctatctctttattgatattctctgtttggtaaaacatcattcttgtaattttatctagttctttatacattatttcctttagttatttgaatgaacttaaagcagctaatttaaataattagtcaatctaactctgggcttcctcagagatagctcctatttaatgtttgtttatttcccttggatgtgctatacctttttatttctttgaacatataatactttttaattgaattctagatactttaaatagtataatatgccaacctgaaatcagctatcccccagttcttttgtttttttctcttcacttttgctgctgtttgattcatgactttccaggactaattttgtgaagtcagagttcgaagtctctgattggctagcttatgatgactaatgattgtacagaaattctacttgaacctaaaagcttccagtctttgctaagaggctctgtgtttttagagaacatccattcaatggttaagaaagcagttcaaaactatgacataggtttcatctcctgtttgcatagagccttaggattagcaagtgctggaagactgaggccttctcagttcttaacttgacatgtccagagtgctgggcatgtggaaatcccttcccgtgagtacaagtttctagatttccaggaatataatgtagcccttgttcttttaagtgttttagtcaccttttcttctgagcttatagctcagattatccctttaaatgttttgttttccccaactgttattgctgcctcagtcagcaacagttttgaaaaattgctgcttagggcgggcgtggtggctcacatctttaatcccagcactttgggaggccacggtgggtggacctcttgaggtcaggagtttgagaccagcctggccaacatggtgaaattccacttctacaaaaatacaaaaattagcctggtgcagtggcacatgcctgtagttcaagctactcagaggttgaggtgggagaatgttttgaatcgggaggcagaggttgcagcctgggtgacagagtgagactgtcttaaaaaaaagagaattaaaaaaaagttgctgcttaatatttttgctgttttaacgaaaacctccagggtagaggctaacctcactgatcagcactgagtcgtatcaaataaaaccaatccttgtgagtggaattttcaaggctactgcaaaacagatcacataataaaaataatgacagttaattgagaatgaggcattggaggagctccaacccggtttttttgttttgttttgttttgtttttctgtttgctgctaagatgctggttgtaaatgtaattgtgagactgttagttttcaaagccacaatggaactagggatggggtggtaataggacaagctacaatgtcacaaagttgctattcttactgtgattcagccatcttcttaaggaaatgctccctggattatggaagctttcatcgaaattccatagttctgaaaaagtagatattgacaatttttgccatcattttctttgtttaatgaaggacaggacttccagaggttcttggtcttccattctgactgatgtcttccatatgcattttaaacgatgatcaaaatcagtggtaataatcaacaaataggataaatcaaactttccagatagtcacgtgcagcaacaatttccattggtatctcctgattgcccagcctataggcactatcacaacggaaaggcagggccataaaagaaaccagaatcccccttctttgcaatgctggagttacttttctaccctgagcacagcttcaatttgataagaaactttaaattgcaaaagataagattaggtgtttattttaaaaactttattggctatttgttacatttacttttctatatgcagtttagagttacgtgtcaagttccataaaaattcctacaatggttttgattgagatgcactgaattcctagattaatttggtgagaactaatctatttacaatattaagattttccatccatggacattttatatcttgcatatgtacagtttttaaatgactcttagtaaagttttatacttatctttataaattttttgcatatttctttttagatttagttgtaggtccatacagttattgtacctgttgtgaatattttaaaaatcaactatattttttattattagtgttgggtttgggctgctgatctattatctaatagatctaatagatgctgatttactagatgtctacttttgagtttcatttttaagtgctaatactgtttttctaatttttctaaggcttaatgaaattattacatttaacaaatcaatgacagctttacttcttactttaaaatctatgtgactccaatttactttttgaatttaaaacaatgttaaaaattgtggcgatggtggcatcctcaactgtttttctattgaaaagttttgttgttaaggtatgttacgttttgtatatagtttttatcaggctaaggaagtgtctttatattacaaataactttttaaatgaataaatgctaagcttcatcttttttcagaatctgtaaagatacttctcttttaatctggttattaaacaggttgctacttaattttattaataccttttcctcctaatggttgattattttctaaactttgaactaaaaaaaataatttttactctctgttcccttaaatacactgctggatatgatatgccaatattttaaattgttttccatttttatacataaagtgaggttaatctgtaatgtcattttgttttgatgtattttctcgtgttagcattgattagcatcttaccatagtcataatttctcacacctttattcacctttgaattataaactctccagatttttcattgctcagaaattatgggtctcagtaggtaccataatattaaacgaagagatctaaacagtgcttttaaaagttcatttctctgcattcacaaatttatcttaagttaatattcagtatcagttactttaatgtagagatccatttctaatgttcttatatatagtcagtcattacatctcttgtatttttataatatactcaattttcataaatggatcatgggacattaattgatatctctttttggggtcgtaaacaagacttttatttctacctgtatgatacaatgcaggacatgaaaaaggagatcgctacctttccctttctcttctgtttttaaattctgagataaattttatccttttgtgtgttcagtgtccatagcagtgacaaactaacttatacttaagatatgtgagttagatagctggtttatataaagtacattctttaaaagagaagataagcagaaatgagattcatagcagggaaattctaactcttcatccaagaatcactttcttctcttctgaaaaatgaaacacgagaactttcacttaacacttacctccataagaaactcacaaacttagtaaaacatttgttcatgaactcttattatgtgtgtgaaaacagtggcttatgtatccagctttaactatcatctctgctctcagttcatatatagtgcaaggaactcccaaagtggtttctacttcactccagtgggatatgaaagtaattctttctaccaaccccccaaaaaattatgatagaaagagaattaacctagcaaccaggacatccaattaaccttctatctttatcactaaatgtagtgagacattgggcaaggggcatttttatgtctccaaatactccttccatataaaatgaggggtttgaaatagacacctccaaggtctgctccatatgtagaatcctatgatattgtattgattagagccataatatgtaagtgttagttgatagcttaaaactggaagtttaacctttatcttagagacacatttgatgttgaaattagctgatatatatttgaaagagcttagctttgatctagtgcatagactcaaaacagcatgatgtcttttaaatataacttaaacataaaatgacagtctgaagggagaattactgttaggtccaatttttaaaaaggagtgtatattgcaattgcatcctttattaaccagaaactcagagtccttataaaatgtggaccctagtttgtctgttttattctaagaagagtcttatacagagcttcaactaatagttgtaataaagtataattaagaattcaagatttaccacaaatatataccttttgtgtttgtgcttgtgtgtgtgtgtgtgtgtgtgcgtgtgtgtgtattagagacagggtctcactttgttgcccgagctggagttcagtggtgctatcacgactccctgcagccttggtctcccaggctcaagtgatcctctcacctcagtcacccaagtagttgggatacagatgcacaccaccctgtccagcaaacttttttaaatttttggaatggttaatttttaaatattgtgggtacactgtaggtttatatagttatgggttacatgatatgttttgatacaggtacacaatgtacaataatcacataaggataagcagggtatctatccccttgaacatttatcctttgtgttacaaacaatccaattatactcttttagttatttttaaatgtacaattaaattattattgactatagtcaccctgttgggctagcaaataataggtcttatttattcttcctatattttgtactcattaaccattccaacttcccccccaactgccccctcactacctttcctggcctctagtaaccattcttctactcttatctccatgaattcaattgttttaatttctaactcccacaaataagtgagaacatgcagtttgtctttctgtgcctggcttgtttcacatatcataacaacctccagttttatccatgtggttgcaaatgacaagatgtcattcttttttactccactgtatatatgtaccacactttctttatccattcatatgttgtcatattttctccctccctccctctctccttcccttccttttttccttccttccttcctttccttccttctatctctcttctctctctttctctcttccctctctttccttccttcctttgtttccttccttctctctctctttctctcttctctctttccttccttcctttctttcttccttccttcctccctccctccctcccttccttccttccttccctcccttcccttccctttccttccttccttcctttcttccctctctcttctctcttttttctctcttctctctccttccttccttcccttcccttccttcctcccttcttttcttttttctttttttttcttttatttttcttttctcttattttctttctttctttctttttttggtagagatgagggtttctaccagagaccatggagggtctctccatctcgcccaggctggtttcacactcctaggctaagggatccttctgcctcagactcccagactgctgagattatgggtgtgagtcgctgctcctggcctagccactccattcagccttatttttaaatatttattgaatttaaatactgaataatatttaataagtattattcaatatttattacattgttaagcacttaaatgatttaagactaaatttaaaacttgtgatttcctttaattatgatgaagtaagattataatctgaaagaatattttatttaaaattatgatggatatctatataaatgtaagatttactgaccaaaaatggaattcattttcaatgtggatgttatttccctatttgttaatctgcagtgtgatgataagtttcccattggcttttatatttctttattttttcctttaattgtatttatatgagaaagataactagggacttcaattaggacacattggaggggtcagaaaccacataatggaattaagtcatgaagtttggagatagaggcattccaagagtggagtgacctttgagaattttgtggtggaagtgaaatttatataggtctctattttgattttagagtagaaatagtgtcgtgatagtatgatttataataagaaatatgtatttgatcttcaaactgttttctggcacccagcttcttaaaagtcttgaaatctccaaagtgttaagtatcttttttatatgctaattagaggactgatggctgagagcttctggataccttcaagatgggaaccaaaggagctgaaagttgagttgaacatccatggccaatgatttaatcaatcatgcttaggtaatgaaacctccataaaaatacaataggactgggtttggagagcttccaagttggtgaataagaacatacccacatttgagagggagacgtaactatatgagggaacagaagttcctgagcttggaacccttccgaccctctgaatctcaccctatgtacctcataatctagttatttattcacatcctttaaaatattctttgtaataaattggcaatgttttgggaagccaaggcaggaagatctcttgagtccaggggttcaagaacagcctgggcaacatggcaaaaccccatctttatcaaaataaaatacaaaaattagccaggagtagtgatgcaaacctgtagccccagctacttaagaggctgaagtgggaggattgcttgagccaggaggttgaggttgctgtgagtcatgattgtgccactgcaccccagcctggcaacagaacagagcaaaaccttgcctcaaatagtaataatgataatataatataatataatataatataatataatataatataatatattgataatagtaagtagagtgttgccatgagttctgtgaagtgttttagcaaattcattcaacctgaggaggaggtcattccatatttatagctatttggtgcgacacacaggcaaagcaacctaaggtttgccattggcatgtgaactgaagcagtccagtgggactgagtatttcatctgtgagatctgatgcttactccttgtatatagtgtcagaattgaattgaattatatgacagccagttggtatctgctggagaactggttgttggtggggagaaatctatacagattttggttaccagaagtgaaacattgcattctgtattgagagttagaacagaaaaagtatttttttttaactctcttacagtacaaacttagaataaatttatatcttaaaaaaaccatgtgactcagaaataaaacagcaataaacaatgaacaaaaaatccagaaacagacattatctaagtaacttgttacggtttgagtgtgcctgccaaacttcatgtgttggaaaaacatacaacagtgctgagaggcagagcctttaaaaggtgattaggtcatgagggctcttccaccatgaatggattaatgccattatcactggagtgggttattgtgggagcagattcctgatgtaaggaagagtttggcacccttccctatctcttgcacatgtactgttttgtccttccaccatgggatgatgcagcaagaaggtccttgtcagatgaggcccctcagtcttgtacttcctggcctccagaactgtgagccaaatacatttctatttattacagcttatgcaatcttggggattctgtaatagcatcacaaaacagactaagccataacttgttacctaaattgaacttactgacatatctgagttctgtaagtattctttgtactataattttcacccatttacaggttgtaacttcctaagacttagagagttggcaagtaaaacagttgacttaaaaagtgtgttgtaatttgcatttaagagccaagaaatgtacccaaaaaagagaaatcacctacagaaaatgtatgttttttttttcccttgggttggagtctctaggaaaaagtccttaaaactataataaatgaggcataaaatgtgattgtaataaagcctttgtcaatagagagagttgcaaatagtaagatgaaaggttttccttcattttctttctcctgatctgtgatgagtatataatctagtcttagttttgttctcaaatcgtaccaatggttttaatcaaaattcacttaagggtgattatttaaaaataaactttcgaatgatgtattgtgcattttaaacactctcacctatcatcatccaggaaaatgtatatatttatatttttttgtctcattaactactttcacattttgtcttctccagccagaagttttactaaagtgatggcaaagaagaaaacagatgcccagaatgaatgtgttacaatatattgcacaatagtgatagcaaattccacaaagcaaatcagtgacagactagcctatttttttgttactccattttatattctagactccaaactatatgtaaaagaaaataagtcataaaaatctaaagtagttacaaatacaaaaagaagtaagtaaggtacacgtaaccaaataagataaatgagttaaaatctaaaacatattaatttaaattctgctgaaatttagtaaagaatacatgatcaaaaacaatataagaaagaattctggacctgacatttcaaatgccaattattgtagtttatttaaattaattgatttcaattactcagaattaaccttgcaattaatagttatgtacgtatgttttatttatttatttaaaattattttcttattcaaaggattaaaaataagctcatctgcattgtacatttaccttaacattatataagataattgttaaaaaataactctataccgccttgtatttgaaaaggaaatacaattacttatcaattacacaaaaatagaagttattttcaattgcacaaaaagatgatcgcacatatattgccttagtgtcataataaacagcccaattatattatttattgttctctcaatagcagagtagaatcttagaaacttgagtccaggaaacgtgcttgtggatttcaagttgtggtgacttcattaaaataactattagattgtattattagaaatagattatttcttccaccattttttcctttttttttttcttgtacttacagtgggtggactttatacacttttcagtccgtttctcctatcctggacagtgaattacagactctgaagcagatctaaagcaacagacacaattgtaaaagaggaggtatgaagttcgactatataaaaatgttaacttattcaaacttagtactgcctgtgatctatcctcaagaaggaagaatgaggcagctacaggtcagaatgctgcaagtaatttgggaaatgttaaaaagaaaaaagagaggaaaaaagaaaagcttcggaagaagttatatcaggaagataaaataatagtgatgaactattctacattgtatcatccattacacatgccaaaatactataacgtatgaaagactcttgtcaacatacagtaatgtgatgactgatactaattagacaggttttactctacacataagtctggctcttatagttcttgctactcataaacataaggggttactgattcaatgacaggcagaatttcctgctgaaccagaaagaagataatggtttagagattaaatttgaaagtgttaagtgggagacatattcaaaacagttaacactgattaatatttttggaggaagaaaatgtttgtattaacatgacggtattatagaaagcgatagcattacttattgcttcatttagttatttactaaacaacagggacatctgaactttttcccaagtggaatgaatttatcttccctcacgctttttgctaagaaaagcactcccacgagaagtgatttaaaaagataaatacaatcaggatattccatccaactttttctacaaattaagtcagatagatgtagaagacaatacatgtacctatgtttaaaaggatgattacaaataaaaacattttatgaaaacagaaaatctcagtctactcaatgttcttctaaagacaaattgttcatagcaccattagtcataactcaactaaatttcactatgggtttccagtgcccgcattcttgacttgttcctttgaggcaatataaaagagagattttacaacgggcttgtaaaacatgaggtcttataggtattataagttactatacatatgtatgtattttgagtttaactgtttcagctgaagaaatatatttacttgatttttccctttattactaacatttacctcctacttagaaaagtagacctgaaaaaataagaaattagaagtgaaatattcaaaaatgtcctcattcctacacatttgtggttgctgtctataaattgttttcactgaaacattttctcttggatttaacactgataaggttcacctggaaccccacaaaaccctgatagactacaatcttttgtctttatacagtttacaatgtgttttttcataaatgaaacttcagtttatctcatcaggaaaactctataaattatcccaggaaactgaggctgagagaaatttaactaatttatttaaggtcctaactttgtttcccatgatattatccatggaacactgactttacaaaggaaaagagtaaaggcaaaaattgcagtcaggtaaaagaaacaaaaaaaatgtaatctttacttattttcgggaaaaccagagaatgatgacatttattcttaattatatctaacttgacttgaaatagtataactctccttttttccctctcttgacaatagcatgactctacactttattactatatccacaggtgctagaaacagcctctggcgcatagtagatactcagtaaatattcacacaattaacaagttgcattttgtacctgtaaacctctaatattttaaaacgtcaactgaattaagtgaagtgttgaaactgaactgctcatattcacaaattgtgaactagacattgtttaatcccttcagtgctgctctattactgtcactctttgggatgttaatgaaatatgttaatatgtcaaacatcctggatgaaaagtaaatgtgaaatgcaagatgtgtattatttttctgactgcaaatgcaattgagcacttctgttaaatatgattcatattttgtctaacacagaaaatccctcacgtttctattctctcacactatgcacattttaaatacatcttaaaggatcaaaaagcagctaggtggtatgatatttattttcctttaatccattgttatccctttacgttgcatggctattcagtattttcctcaataccttgtagtattttaagctgtacttaaagaaatgcccttgagcatatcttattttcatatgtagtttggtagactgttacaattgtgcttattattttaagcagaattcatatgttattgatgaaaataaaactggccccatttaaaagtatcacggcagttaaagtttatgataagatgtgtgatgagttggtgtgattgaatcattactgaatagagacataaatttccaatagtaccaccacacgggactgaaacatatagaacaggatgtctggccatggggtgaagggaagggcgaagtgtgtgttctctctttcactaggggaatgtttctcccaccaaggcctttaacactcacagactgcttttccctatggttggtgtccattaatcttaccacctcctgcccagctgagtcagcatttacagattcagcactttctcaacaagcaaatggctctttagttgttagatcttgcccaagagaaacaccctgcacagtgggaaataatcaggcctcatacatttacaattcaaaaaggttaggtaacaatttcagtcaatgtaaataggcttctttggacactccttatcgcctagatgatcttgatggtgagaatgatatgaatgtttctctaccaatattaaaattttaattcctcataaaagaaacacaaatagctaaagatgtccatatattatcctgttgtaaaataaaccttctcatactatatacacatttttgagtttcaggtagttttgatttattccttttgtaaatatttaagaagattattctatttttctgctaataaatgtttaatctactgatattcccttttcctcggatggaaaaatctcaacggtcttttggacagtcttcaatttctttcaaaaataaaagagtgtgataaatcagctgtcatgtattggttaagaaacaggcatttttagaaacgttacagattccttgatagactaaatttcaaatatttcacctatattttcacctaactgaaaacaaaattttctaagtgcatgttttcacagattgccggagaataagcatttcattaattgatcctgggcttaagactatatctttaaaatttgtactacagttttgattataaatttgacagctaaatgtaaaagacatataaccttaagagtacatcttactgtagacagagcaaagaagcagatactttcaaatttatggcattcccttagtgtgtaccatgtattcgactcttaaaaatagttttctacagcttccgttttatattccttgatttagtatgttccttaggttgataaaccaatccttgagagcaagtgccataccttgctcatgtgttaataaacatagtgacatctcgcataaatgatatgtaataatgtttattggatttagtgacagggaaaagtgctctctggccttgccattacgaatgcatgcctctactaatcactctcaaactttagtgttagggattttttgcaagatgcttgtataaaatgcagattcagctgtctcatatgcagttattcttgtttagtaggcctgagtatggcttcagaatctgaacttgtacaaacatcatgataatactgacacaagtgtttcctgaagagtgctttgaaaaatactgctttttaaaagttaagcatgttgttcttccatgagtagatccttgaattctttcagtaggctaatttttaagacaatgccctcttacatatgtattgctccagggatgcttcacatgcccgtgttttgcataaaataaggcagagagtctttgaatctgatgcacagttgattgacaacttgtaatactggaaggtcagcactaattactgagcctcatttgcatgcgaaattttgaaagatggaaactaaagtgtctgtggcattttctgccaataaattacctgcctgacaggaaggcgtcactgctcatcaacgctggtagtgtgtaagctggtacttgttcagttaaggagaagagaaatagtgcctcagagagttatcttcctgggaataattactataggtgtcaacaggctggaaaaagaagggagccctttgctagtctgtgagttaagtttgtgaatgatgaaaggtctgattgtaatgatcatcaaaatctctatcccacatctaggtttgctcatttgtcactgattataagagcatgagaaagagctcaggaaatagacagtaattaggtggttaagaacaaaatctctttacttactccatggattcctgagacacttctaagatgaggttactgctctgaaaggtaatgttttggggtagactgcaagagccaacaaaaaggatgaagtctgcattttctggggccagaatatttggagcacctgaggctttggtttgtgtctccatagaggtttgctaacttcctttacaaatttagaactgttctaagtcaatgtctttcctctttgctctactgcttacaggttctggtgctggctagaagcatcctttgattttcataaacttttctttgtagccatcaaatagcagtttggagccccctcttggagacggaacatatttgaatatttgctaggagacaactgaagcctagggatggtaagtagaggcctttcatctggtttacatagctcagagttcactaccatcatcaacactgatcacttcagagttctgtagctctgttctgtgttaaccctctcagacccctatggcctctgagagacctgacccctactttgagacacactgaactggaaataataactcccatatgggagaagaatactccagccccaagagcttatcaagctttgttttttctatgactactaagaaaaggagtgtgtattggaagcaattctctcagcttatagctattttgataggggttctatatttaataaaggttaaatccattgaaactgtgagtcaaaggcacttttcatgtccaacaatttcacctactttagaagcctgcctcttcccactctccccatgcttgctcaaagcgaaaaatgggcggcattggttttgtttagtaggcaaatggcccttcccccaaagaatatgaataagtattttcaatctgaacttgtgcatcactcttataagtctctctcctctacacaaaagaaatctctttgtagtaattgcaagacttaattagccagtgttcaaacaaaggcatcctttgttcacctatcaacagcctgctttcatcgatagttccctgactctctgaagactactctttttctaagttttgcagacttgtattttcagctttggggtcctttgatataagtgctcgctttcctctccccggtgtcttttcttggcctcatccccactgtagaaaactccttcatggttggtggtgatctgatcacctttccagtctgctaattcctagtcttcagtagtggtacagaagcagatttttgaaacagcagcaatgctgggggaataacgggccactgaaagagttgaatttcatttagttccatttttttttttccttcttcaagtcagagctagagcaatagcagggaagggtgaggaattatgagcacctgaaaaatactagaaagataagccagtgaatgcactgtaaaaatgtaagctctgtctcctttaagaacaaaaggaaaaaaaggacatcatatataattccacaggtttaaaaaaaagtttaaatcacttattagctaatttatggctatcacattctgagcattaccagatattactctcattgaagttgccttctttctctcctctgcttatgtaaatcctactcaaacatttcatgacactttttatgttgacatttaaaaggcttatgtcctagagattgctgttttctttcctaggtaataatcttaaaatttacataccttttggagcctgacatctgtagactcaaatctataatgtttctgccactaacttaaaaaaaaaacaactcagagtctcagttgttagtgcagaggaagttctcactgcccttaagtaatcccttcagaaaatgtacctattatcatgattattcctacctcatggtaagtgatgcttgtaatttatatccttaaagctcaatatctatggcattcataagcgtagatctccatatcaaatagaaggttttcaaaatcatttattgtttctatagagctctctattaaatccgttaagcagaaatattaatttacattaccacgacatttgaatttgaaagataattcatggcttacaaaaagatgttttaaaataataaacacattcttacaataaatttgcactcagtcatcttgagttgtcatcagacactactgcaactaatcaggatgttcttcacctgtttcaggagagaatttactaactcttccaaagtttaccaatgcaataccagttctgacaatttcacagatgttagattccaagtatcgaatacaaaacaaaacgaacttgtgttttagcttttccaatgaaatttttatgattcccagaagacgtttgtttaatttcactacactatctcatcaattatttgtgtgctacatgccctatcacagttacaactctacttctccctaacacgacttcaagaacacagtgtacatctctcgtttatcatgaatttgcctgctctgaccacttttctgaaagaagtatcttttttccagttcagaaaaaagccacttccttgatcttcagatatttctgcacaaaaagattttgtttactgatgaacttatttgtataagcaactggcctcatttagcagtcatgatgtcaaatcaactcagtgtaaaatagcaaactgtgtccgcccatctatacttgatttcttcttttactatctgccctatgatatcaactgtactctattaagttagagtacatactcttctagtttattgcagaccttatttaattaacatttaaagaaaacaggtataaatcatattttacttttcttatcataaaaatgataatctctggaagaaataaataccctcaaacaatagtaagcagattactaacaacattctgtatttatttcaaggcagctttctatcaaggttaaattcagtttttaaacaaactcattagtgatgatttgctctacatttaaacctccttaaattctcaacttggttaatattttctcaagtattatcaataataaaccattttggatatcaaccgtagaaggagaaaaacaagccacgtgttatgaaaaggacacagcagtattcttgatcttgaaagaccttcagtacaatgcaatagttcagtcataaatccattagaatataacaataaatataaggaaacttataatacatgcaaaaggaataataacaaggtgagaacattgaggattggggtggtcagggaaaaattacgttttgttaagtcatataataagcagactctaaacaattgtgaaaaattatcgtgaaggaagaagaaacagtgagtttcattacacactatacataagtgattttaggcattttaagagtacagatttaaagtctacttttctagtttaccaagtttggtttaagtagtcatttatattaaaaagttaatccttaataaaattatatgaacatttaattaactgaattggatttaaaaactctttttagcatatactcttccattggttgagatacagtaatacgcttaaattaaaagtctattttcctttctatcttgtaatggtttgcaaacttttttaaatctgaaagtcctattactctattttaagtatgaataagattcaaaagaactttcctttcagttgttacagtatgctgttccagactgagttgatttgacatgctgaaaatccattcatattactttcaaattcatttaagacattaagacaaacaaatctgcatttttacttcattaagtaatttacagaaaatgatggattttaatgctattttggaaactgaaacattcaactagaacaaaaacttctttgattctatttgattagagataacaaggaaaataaaacgacgtgaagagcagaaatgctgcaaaaagacatatttatcagcttggcgctatcatctgtctcttaattttgtcgcataaaaatcattaacgttactggccaggcatggcggtggctcacacctgtaatcccagcactttgagaggcggaggcgggcagatcacttgaggtcaggagttcgagaccagcctggccaacatggtgaaaacccgtgtctcctgaaatacaaaaattagccaggatggtggtgcatgcctctagtcccagctacttgggaggctgaggcaggagaatcgcttgaaccatggggtggtggaagttgcagtgagccaagattgcaccactgcactccagctagggtgacagagtaagactctgtctcaaaaaatatatataaataaatgaaataaaaataaacaaataaataaaataagaccgtcaatgttattacttaaatctgcgcacattgaatgaaaaataatggaatttgaaaaacagtcattttactgtgcgttttaactgccttgatttcccacctccctgtttccccccttcatattctattaaaaaagcactccatctattgataactacatacaacttctaattttagttctattttttcaaactttagcgtataaagctttactgggtgcaccatttacttctcccaacttcttgggactcaggatctttggtctttcctcccatctttatcaaaacttgctccgaataaatctggttttatagtgacttttagtatcctttcactaggggactatttaacctaaattaataattttcaagcataagttacatgggaaaaaggtcagtttttggttgcaggaacatcctaacacccattaaaaactctctgtgtaagcagttacttactggcccggcacagtggctcatgcctgtaatcccagaactttgggaggcctaagtaggcagatcacctgaggtcgggtgttggagaccagcctgaccaacatggagaaaccttgtctctactaaaaatacaaaattagctgggcatggtgtcacatgcctgtaatcccagctacccgagaggctgaggcaggagaatggctagaacctgggaggtagaggttgtagagagctgagatggcatcattgcactccagcctggacaacaagagcaaaactccatctcaaaacaaaaacaaaaacaaaaacaaaaaacagttacttactttacgtaaggcaagagattaggagtgaatttaagcttcctatacaacaaaatgtaaatattgcatagtatagcacctgagaaaagactaatataaaactaaggcaaagaggatagacacaaaaattcatcctaaaatatgtatagagacactttcacttattaaattaataaccaaatattaattatagatattcctgagaaataaaatattttattaaaaataaacagaaacaaagataccattccatggttacatgttcggataagacagaaaaaagactaaaatgatgcagaattagtaaatctagtactgaagtttccaataagatgggctggtgactgtctataattgaataataatactctaagtacatgtttaaagttaattatttttcatattttaccacttttcacaaaaatcttttgagttagatagtgaaaatgctatgctttccattttactacaaatttagagcttttcaaggcattaagaagatgtgagagagaaacagtatggatttgaatgagatttagtcttaatcacacatatttagcaaagtttttcaacttggaagaaatagaaagcggccttatccaaaacctttcatgatatctgtgctgtgctgtacacaatcggctgttgattctcacaatagcctgtctatgaaacttgtgtggtctatcttaggaagccaaaagagtgagataatgacaatagcacttattataaaagccacatttttgatcatcctatttgtggtttaaatttccctttattaagaaaaactggctgatgtaaaatcacttgctagacagtacagactcagcttccctctcctccaattttccacagaaccactggccaccacacacattgctgtcaaattgttctgtttcttgtcagctgcacactgggcagaatagggggctggttatgcactaattaggagggtggacttatttaaaagtttcattctaagaaatatagctgccaaatattagcttatcggaaagttttttgaggagaaaaggcagggatagaagaactacaaaataaaattttcatttatttgggccaggatatggaaagaaatttgtcttgagaatggcaccaatattaaaggaaattcttctctgaaactagaaaaagctgcagtattgtccacttgaaactgatgactttagaaaaaaaaatgcaaaacattctcatgtgaatttgactaaattgctgtttttttctgaaataattatagactaataaaggtgctaaatttataggaaagacattaatgtagcttgacagaaataacagtgtaaacctgtagtatattgaaagttcccacaacaaatttatctgttaacgttgttaattatgtatggagagtgccataaattgaagtttttcccgatttgaaaaaattgacttgtgctaaattctccttaacatgtaattaagacatatgccaagggttattttaacatatcatatttatgattaaagaatagtatgaaagtaaaaaaattgactaagagagtatataaatgactaaaagattatataaataatctatctctgtatgtacatatatgaactctaagtgcatatgaataaatacaaaatacaagagaaagattatttgcatacacattaagaacagtcatcctctgataatgaaacaggtgatttgcttaactgtattttatatgattctccgctgggaacaatttacttattaatgactacaatataatgttttaatcttttgtttttgaatattgagggattttaaagcaccgagcaaactaaactgagtactaaataatttataatggtactacagtaacaagaaaagaggcttatgagttcatatttgagcataaattttacaattttaaaatgaaacatgatcgtgacagaaaaaacaaaagcacttctttcctgcctaatagtagattagaagcactaaaaggatttagggtggcaagaaacatctaatgtttgaaatgatatttagtagccaagatgcaaatatcaaaatgaacttcagtgaaaaataccctacattttaaagatacttgtcacaatgggccatttagtaacacaaatgacaacttttagaaataaattaactaatacattttactgaaagtatacaataattctccatatagctgttctttgtgttaatcttggataaaacctgaggatgtagagtaattcaatgaagtggggtatgtacactttttagttctgaatagctgagtaactgaattgtgcataaaactgactaagaatcaaaagccatgacacatcaactaaactatggaaattagcaatcttattcttgataatatattaaaaaagaggaatcaaaatatgacaataattaacagtggcattgttgtgactacaagctattgagttattgtacaagatagaattaaacctgtggttcattaggaaaggagttagcataatggttttattgaaatcgttgtaatgaaagacaatttcacacacagaaaatatagtttgagttcatgcagatgttcatgtatttaaaaattaaattaaatttataggtcaacctgctgttgattctgtgcatgattttttcttaatttcaatatacgaaaaatttaaatttaaaacaatataaaagtaaggaaatgtggggaaaaagactcatgatcataccacacaaactgtattcatattttaacgttttaactaatgcaaatgtaaattaagtgtaaattttgatataaatgtaaagcaacattcaaaatttaataagcattttttattacttatatataggttatgatgagatacttaagattgaaatattacaaaagtaaattttaagctaaattaaacagcttaaaaccagctgaaatgcataacttggctgaagttgcatgacactggctccaggggctcatcaaggctctatctattctctctatcatttggctttacctccttctctgttgcagtttgcttaattcagctatgaggaaaactccataattaaccaccaatgccctgagccccacatccttccatctaagaaaccccagtggaaagagaacttctctattcaaagcacactcaataaatcaggaaagaacttgcatggttcttgcttaagttagatggttattgtatctaatgaactggactaataagtactgatcaatcctgggtcatgtgccacaattgctgaggattttttttttttttttttttttttgaaacagaatcttgctctgtcactcgcgctggagtgcagtggcacgatctcagctcactgcaacctccaccccctgggttgaagcaattctcctgcctcagcttcccgaatagctgagactacaggcacgggccaccacgcctgggtaatttttttttttttttttttttttgtatttttagtagagagggggttttgccatgttgaccaggctggtctcaaagtcctgacctcaagtggtctcccaaagtgctaggattacaggcgtaagccaccgtgcctggccaatatttctaaaagaattacaatgaacacagaatatgtagataggtggaaagagagaacaactacagttgtacaaagaatccaaaataagttgtttctgattatttatttttgtttgcttactctctttatattagcttatatttggagatgttcaaattttaggcttttatagaaagagctagtgaggttttgtattcatttagtttactatttttttttctatactgaagaacaattaatactgaagatctgctttttaaagctggagacaaattattagtaaaacttcctgagcccaagataatacccaatagatcttctctgattgtttcttgtttttcattattctttttaaattttgttaatccaattctcaaacattttgcttgacatagaaatcattaattttgctagtattattaaattgaataattatgtatattatttatatgtatttattttattctctttcattatatcacctttcacaaatatatgtgtttaattttatttcttggtttgttttgcctatgattgatctatctgtggggtttctgtgaatatgcatttgtaatctagctttcagatttctttctttttccttttttctttttcttttcttttcttttttttttttttttgaggtggagtctcactctgttgccaggctggagtatgcagtggcgcgatctcggctcactgcaacctctgcctccggggttcaagcgattctcatgcctcagactctagagtacctaggactaccggcgtgcgccaccacacccagataatttttttgtacttttagtagaaacgggatttcaccatgttggccaggatggtctcgatccccccttttttttttttttttttgagatggagtctcaatctgtcacccaagccggagtgcagtggcgcaatcttggctcactgcaagctccacctcccaggttcaagccattctcttgcctcagcctcccaggtagctgggactacaggtgcccgccaccacacccagctaattttttgtatttttagtagagacggggtttcaccatgttagccaggatggtctcgatctcctgacctagcgatctgcccaccttggactcccgaagtgctgggattacaggcgtgagccaccacacccggctggtctcgatttcttgaacttgtgatcttcccatctcagcctcccaaatagatttcaggtttcttaataaattattctgtctatatattttttaatgcatattttgcatttaaatctacaatttttctataattgctatctttatgtttttcttttcataaaatatttaatcaaataattatctcacataatttatctctcttcttgtcttctattccatgtttctcttctccttgcctttatttatttattgggattttctgtatagatcataaggtactctttgaatagagattatcttaattcattctttccaagtcaaatgacttttatttatttttttcctgccttatgcacagaaaaagatattaggtgtgatgctgaacagaaataatgatagtgacatcatgccttgttcttgatattaaagagaagtacttactatttcagtgtttgctgcaggcattcatcaatatataaaagctttctgttcctggtttgctgagatatttcatcacttgtagttgttgaattttgccaaatgctttttctccatctattgagatgattactttttttttcctcctgttgatatggtgaattagtttgattgaagtatgaaagttgtactagattttcatttctgggataaattcctcttgtttctgatgtattaaccttttgatatattgctagattctatttactgatatttttaatggaggagttttgcatctatattcatgagggattatgtttcatagtttgttttattgcagtgcctttgcttttattatcagattatgctagcttcatgacaaaaatgagctggaaagtgtttcctcttctattttctagaagagttttttttcagaaatgatatttttttcttgcttaaatgtgtgataaaatttacctgtagagctatttgatcctgaaaatttctctgtgatatttttcaactaaatattaatttataaagagttatggggccattcaagtcattgcttcatgggtgaactttggttgtctttcaaggatttgtccatttcactgaagttgctgaacttaagagcataaagttgtttatgatatccttttttatagttcaattttcttagggcttttatggatatctcttctttctttgctgctgctgctaatttgcttcttgtctttttttttccccttgagctgctaggctacagttttatcaattttattgatactttcaaagacttgaagtgggagcagactatgccactctaaaatgtgccactttggtataaggattattttgagctaaaagcacttcaaaaacagcaaatgtaagcaggcattcatctctcacgtttcttcctgaaaacagaagataaaaactcccatgttaaagatgtccttcctgtaccaggagaaaagaaacattcttcggtggggaatcatagccaagagaattctgaacaatgagaccttgttaaaacaattagtatcttcttttaacctcccctatagtttagttacttttcaaaaactgcctctctttgttcaacttagaataaaggtatttatgtttcaccagttttttgtgtctttatttccttatagtggctcctgtgtcacataaattttatataaatttgtatgcttttcgtatgttaatctgtcttatgccaaattatcaggcccagccagataccctaagaattaaaagtttttgcacctacagaaccatctttttgtttctttttttattgtatattttaattttacttattttcttatgatacttattctccctgctttctttgaatttaatttattcttctctttatttccaaaaaaagatttagattactgatttgagactatttttctcttctaatattagtgttaatgctataaattttcccctaagtatttttagcagaatatcacaatgttgagatccagtatttttatttccattcaatacaaaatatcttaccatttttcttttacttctttaacccatgaggcatttaggagtgtgctgtttaatttacaaacatttgaggagttttcagatatctcagttagtaatttctaaaataattgcactttagttaaagtctaatcttatttgatttacatttatttaatttgctcagatttagtttttggggggcccagaatatgacttaacattgtgaatatcccatatccataatgtgtattatttttaagtacatttaaaatgttcacagtggtattctaggctccatattcttggctgatagttttagacttaggtcaatgttattcaaagtttatcaggatttgggttttgctgttgctatagttacctgcaatttgccattggcttcaaattcctttagattttttcttttatttttttgacagggtcttgttccattgctcaggctggagtgcagtgatgccatcactgctcactgatgtctcaacctccagggctcaagtgatcatcacgcctcatgctcccaagtagctgggactacaggcacatgccatgaaacctggctaattttgtttactttttgtagagatgaggtcttgtcatgatgcccagggtagtctcgaactcctggcctcaagtaatcctccaacctcaccctcccaaagtgctgtgattacaggtgtgagccattgcacccatcctagaatttcttatatgtgcatatttggccacaaagttttcttctaagtcttcttcactctcaggttcaggatttccctttatgtgtatgtctcataaagcgtttgtttgcgttcttgtcttttcataagaaatagactgctgttgcttgatacttggtacttgctatcctctattgagagacagggggtttcttctgctgtcctagtttagtctcaatggttggcaaaccctgtattcctgggtctcagggattgagactattctcattctggggctgaaggtcacttctaaatggtcctatttctcctcaagtctttggaattgtctaaagagattacctcaaaattttgaatctgatgggttcagaaacagtaatcattttacagattataatgatttctccttttgtgagagtgggagttacattttttccagcttcctataccctaagcagaagccagaagtctatccctttcttttaaataataaataatacttccatgtattttcctttgagtacatatttgaccttttatcatcagtttttatattttaaaatttgtggtccatagtaatttttaaaatttaatgtctgtattaacagttcagagcttatattatttttccttgtttgtatttctgacactgtgttggttaatactgtgtcaacttgattggattgaaggatgctaaggattgatcctgggcattgctaaaggagattaacatttgagtcagtgggctgggaaaggcagacccacccataatctgggtgggcaccatctaatcacctgccagcacagctagaatataaatcaggcagaaaagcatgaaaagactagactgtgctagcctcccagactacatctttctcccatgctgggtgcttcttgactgaacatcagactccaagttattcgttttttttttttttcttttctttcttttttttttttttttttttttttttttgagatggagtctcaatctgtcacccaggctggagtgcagtggcacgatctcggcttactgcaagctctgcctcccaggttcacgccattctcctgcctcagcctcccgagtagctgggactgcaggcgcccaccactaagcccggctaatttttttgcatttttagtagagatggggtttcaccatgttagccaggatcgtctcattccccctacctcgtgatccacccacctcagcctcccagagtgctgggattacaggcgtgagccaccgcgcccagccaagttattcagttttggaactcagacttggctttccttgctcctcagcttgcagacagcctattgcgggaccttgtgatcatgtgagttaatccttaataaactcccctttatatatatatatattctctccatatatatatatatatatatatatatatatatatatattctctccatatatatatatatatatatattctctttatatatatctattctctttatatatatatattctctatatatatattctctttatatatatattccctttatatatatatatattccctttatatatatatttaaggagagaatatatatatataagatctctatatatacagaactaataataggacatatatatgtatatatatatatatatatacacactctatcttgagagagacagaactaataataggatatatatataggattatatatataggatatcatatatatcctatatatactatatattagtatatatataacaataagatatatgtaggatatatgtaggatatcctatatatatactatatattagtatatataataatagaatatatatcctattattaattctgtctctctagagaaccctgactaatacagatactataagtatttgctatcattcctaatgtttttataataagagcaagtgaaacatgcaatatcttctatttgcatcagtatattaccaatttttaatgccccttactaattaatgagaatttttatgcctcaagtaactaattttcaatgacactgaaaaattgactgaaattcaataacaaaaatagtgttaaaactaatgataactatattattcaagagcttaattatagggtgaattcaaagtgagcattgaggtacagaaaaaatgtattttattctagaatatatgcttttcttatataacgtaacctatattcaaagattttttaatgtaagttatatacactgttgattattattgaagttactgttatctagaaacccttaagatgcttaaccagctaaaccagtctgtaattgttcattttggaattggattttattgctgtcccttagtttatctacaaggagatttgctgcatttgatttagtttcaccttgttgaggccttttttacatgctaatattgtcatccaaaatactatcccttgcagcttcatatcaacttttatttaaataatcatattttcataagcggtgataagagttaaacagaacaggactgagaaaaaagccttatgctctgccactggaaatgtttccttaagttgacattattttataaataggcatgtttgtatattcctatttcatttattacaaatctatagtctcaactcaaagctacttgctgccatcttttcctcacatattatataaatgatctggtttaaagccattttgaaattcagatctgtctcgtgtatttcaagatccatttaataatttattctgaaattatacttgtgacttatgtgtatgtttggagaaaattactatagtagattgattgcaaaaatggcttaattcactactcctccctttatgcgtaccttttgcattatatatatattttttctttttctgtgtctttttccttttttttttttttttttgagacagagtctctgtctcccagactggagtgcagtgtcatgatctcggctcactacaacctctgcctcccaggttcaagcgattctcctgcctcggcctgccgagtagctgagactacaggcccccggcaccaagcctggctgatttattgtatttttagtggagatggggtttcaccgttttagccagaatggtctcaatctcctgacctcgtgatccacccgcctcggcctccgaaagtgctgagattacaggcgtgagtcaccgtgcccggccctgcattatatttttacagcttctttaattaaggggtactctctgttttattcctaaatctgggtgtaaaaattgtgctttgaccaacagaatgtggctgaagtgtcaatatgacagatctattcctacgcctcaagaagacttgagtactagcacggttccctggaattctgcctcataatgacaacaagcccaggatagccaactggaggatgggagaccaatggagcagagctgggttgcccagcggaggaggctatctggaccagctagttgaatacagacagattagtgatcccagagaagttatctgagtctgggcctagattagcagaactacccatacactcatgaaaaataataaatgtttgttattttaagccattaagtttttggcatgttttattgttcacctagataactaactcattgattaccttttatgaaaaaggaaacaatgattcatatggacatttgttgacacatcttccactcaaatgattattcagaagtcatctgtaagtctatatttgatcttgtcaacaaatttgttactctaggcttgaggcgacatatggtttatctaattttgtagttgtgatttatttgtagtgacactatcaagaaaaatcataggagtgatttacttccttataaatgacttttgcaggtataagataaggtagtaattgagtacaagtgcaatatatttattatttttgctttagaatctaatgtaatttgagtatgattaattttcataactataatcacttccaaggtatatcaaaggtaaggacactatttacattttctcttagtaattactattaaaataaatttatattacttggaaaggagggaatatcattttttctctcatatttgtttattaatatgtattcattttctagattaactagttattatcataaacagactatctgggccctaagatgagtggggagatgggagaaaggtcagttgctatgggaaatgatggggggaaagtacgaaacacaatctcaggagtcatcagtcttccttattagagaggttggggtaaggtcattggttgtcccagttgggcaattctatgtaggcaagagtgagccacaaagatttttttttctcctatatacttagtccatggagctataatttgtgtattgattgtgctttcttttgtggaagaaatctattataaaagatagaaaagaaacagaagtgtaggtgttttccaaaattatggcataaattcagaatgttttagattactgcatttgtcatctaaaacatttgtgtcaatttgtgtttgcacatgaatctattacttctacctatgctttgtataatgctcagtttattaagtataaagaactactaagatgttttctctaaacattttaagactatttacacaattaataaattaaaaattccaaatgaaattttaaacatctcttagatatttattgactactgacttagtggaattctcctaaatattttaataaaataatagctttgtgccaccattcttttaatacttcaaataatataaaaataaacaaaacatgtaaaaatatcagatgatccaaaatttcttgttatatcggcttaacctactaaatagtacccagaaactctaaggataccacccagcatttgtctcacatgccctgcaggtaactttaataaggctaaaattttagaatcacctgcctatgagatacttcttcattggtagcacatctattttttcctccttttgttctcaactgagctttaccatatattttaagtttacagaaacattgcgtggaaatgacagaaagttcccatatgtcctctctgctaagtctgcatgattagtctcttgaaattgccgaaatattctgtggcttcttagtctggaataaatgcatcattaatagaatcttatatctgtttaaataaataaatcatgtgaattcgaattttctagtatttttttctttgttattttgcctagttaattttattaaagttaataggtagagtcctccaatttctgtcatctagaaaagaaaattggccaaatatatgtttttcaactattttcccataatcctcctgtttttactcacttaagtgcatacctctattctccactgaaaagaaagtttcttgggggtttattttcaccttactcttcacttacagcagctcatgtttgcattaactaatgtaaagatgggactgtactgactaaacttaattgaaacaaaacatgtttgttggtctacacttctgtttttgtaattgtggcttttttagaaaatgtctggtaagggttaaccaaatgccaatttaagatgtgatcggaactgaaggaaatgatgtctcaaaaattacgtcctgataaagcgtatccttatgcaccaaatagagtccaagtaaataattcaaagtcattgctaaactgcaagtttgagctgcatagtaaatgcagatggaaatcacttaggtaatgtaactggagattaagaaatgtatacttatatttgaaagatatttctcatttcagattgaaactgtaaaatgtttctttgatgttcatgtaactttgattctaagccctttcaaatcttatacactgcaaatcaacttatgaaatgaatactcagaatcctatagttctatatcctgaaaataaatatgtcttcctctgggccaataaatgtaaacatattcagctgaaactgaaattccaaattatgactacattcaaacatctttctgaagattatatataaatcaaaatacccagatatacatttagaaagatgtttgaataaaatcataatatttatatatgaatatatacacagttatacttacagtgtgcatatctttttcttggaaaactttttatttaaattaaaatagttaaatggtttttttaaaagaatattatttttgatttatagattgtaattgctttacctttgaccattattttatggggaatgtaataatatagagaattaacactgtcgagtacaaaaactaaagatttaaacagatagcttttaaatatacatgctcctatttcctgcaaatgttatatattattttacatttcattctttttagcatgtgagctatatgatgattttaaaccttttgatagaccagcttctgccatgaattttctgttggcactaacctccacatttgctcttctgtgttgtttttatcactgggtactggaaggtgggaaacttattttccaagctccattgccagctgatttctggttaggttctacctaaccatctaacaaagggatgcactacgtcagaggttagaaagtgagataaagacaagttagttgttcctggttcttgcagtggcagaaactgcagggaaccaccataggttactagggacagcagaagtatcggtggttctggcatggatggtttcagagttgctgtgatccaaggttattagggtgccttcagcagcataagtaattgtgattccagcagcactggtaacagcagctgcagctgatgtaagtttctccatgccggctgctatgggacctctagaagctctgcaattttattttctttagttaaaactcacctctctcatgtgctactccaacactttaagacatttaaggccacgtctctctctgggcttttctctgctctctaaaagaatttctttttattgggctagaaaatgacttataaatgagaaaaacttggcttattcattggaacaattcgaagataagacagggcatacacagaccacacactgtgaacaacatgacttgacatagagaatagagttttcagtgttagtgttgaggagatcattgaagataagtctcagtagtagagtcaactaacatttgataggacatcatctagtcttttctaaaaactgatgttaagaacacgtagcatgacatctactctcaacaatttttaagtatattgggaagactgctatattagaaatgaataagaaagaccttttgttgcataatagctatcttactgtgcatgtgtatttttgttacatctactctaaggattcacttcttaatgggataccccttgaatatgttaaatacccataaacacttaagctgtggacttagagccagtatattttgttctaagcccaggtttctcttctgacaaattacagggatatcaaaatttcccattcctcatctggaaaatgaattccctaatccaaaactactttgcagagcctttgtcaggatcaaatgggataatgtatgttaaggtgtttttagaagggctgaattctgcatgcatgccagttattattgcagaagattacttcacagctggaaatggaaggactgtgactccaaaacttaaagaaggtggctcttgaatcaaacagtgactctgcacatagctacttacatagcttctgtgagcacattctcttctgtgagctgtgaagtcaggaacagccctggaataggtgagagatccatgagacaaatgataggaaagagggaagcacaggcaagagacatgaattggccattgttacaaattatcatcattgtccttctcatactcaatcaggtggccttagagctgctgcttcttgctcctgtgccctgtgcattgtgcgtcctgaatgcctaagggttgtgcaagaaaaatcaaagtttatgcaatcaacattttggaaaccttattgcacatcagagccaataggaaaatcttcctaactaaagattcaagtatatcacccttctatttgtatttactagatacagatgtcacctaagattctgaatgattcgagtgccccagaaaattcatctgaataggtctgaactaaagcaccatttctcagatgtatgacctctggaccaatttaattgaaatgatcttttttacctgtttaaatatctaatttctaagcctgagcccagaccattgaatcagagtctctgaatggtgggtcctggagcctataatttaacaactaacccaagggtttgtaattcatacttaattttggcaactaagactagtgggcaaggtcaccacaaggccaagttctgcacctgctctctcaccccctgcaacactctcactcactttgcatctaattttattgcatccaaaaataaatgttaaccttgctttaaaccaaaattaaagacaactaagtttaaagtgaaaatccactaataagtaaataatggcattggcttttctaagctttacctagctctttcctggtttccaccatagccacttctgcggttggcattatccttccatatttcagggttcatttcacttgaaataggtttgggactcatgcagtttccataacctagaatgttccattgactcatttatctggttaactcctagtcgttattccaaattcatcttattgccatctctaaggaatattttctagtctctgaagtacaggttattcactgccttgtatatagaatccagaaccctttctgttacatatatcacatactattataaatgtctatttatttgtcttagtctccgtaagtctcctagaccaggttcagcaaactttttctgtgatgtgcagatagtacttattcttggcttgcaggtgattgggtttctttcataattattcactctgtccttgcagcatataagcagcaacagacaataagcataaaaattttctgataaatttttatttacaaaaatagtcagtggaaggtgggtcttagtttggtccatgagtcttagtttgctgacctctgcactaggctgttagctaaacatggccattcttatttactattgtggcctcaaatagaacagttcctggccaatgataagcacaccatacagattcattgcatgtaatgtgtaatttgtatagaatttagttcagctgctaataaacaagcaaacaaagtggtttaaataaggtgtagaagtttgtttccctatcacatgaaagaattttggaggtaagccaggcagggttgataaaaaaagcttcagtgttctccgtgttttcagtcatgggctcctgttggtgtacatactctaccattcttaccatgtggctttcattctcaaaaggacttcattcatgcagaaatgaggaatggaggaagtacatttaagatgacttcctggaagtctgacatacgtctatgtacatgaaattgtccaggacttagtcccgtggacatatttagctttaagagaggataggaaaagtggatgtttagcaagaactactgcgatcagctaaaaatcgatgcccaacaacaaagggaaaaagagaatatagatgttggtgttcaacatgcatgttaatgactgattttggttgttgcctggtactttgttccaatattatgtctatgtatcagtaaactaaccccaaatgtcatctaccccaaatggctgaaatgtggcagaggcaaagagcaaatccacctcctagtgttcctttctaccttctgattgtgctatttcataaacagagaagagagagactcaagcactttccattttgattttgtttctgagtggcaccagaagttcataagtgagtgaccttcctaaaaattgtattttgtgattaatgcactcatacttaatctcttgttctacacttcaggaaaactaaagcaactgctcttgtgcatgagaggcagcctgaaacatgcataattacaagtgtttacatctgtttccaaactctaaaccagaacacagaattactcttgtactggggcttgcacagtggtctcatttgtttatttactttttggttcttgaattatatgtaaacatgcacaatgacaacaatgttataatatctgacatctgtcacatggtgacgttagcacacaggaagagattttggttttctttatgaagagtggatatttgatcttcaccagaagaattttcggattgtaggcttaaaaaatagaaacttgttaaacttacttgttttctattaacgagtccctttttcttctcccattcatactgtacttgaacaaatggaacaatatgcttttctctgtctctgaatttctgtcccttctctggctctatgtgtgtcttgtcttcctcttccgtctctatttacctatctacatacctacctgtttttagacacagacattagtaaataagtgaataattataaatctgatttgctttagatattatttcaatactcaactttattttttttattattatactttttcctttctttttttattattattatacattaagttttagggtacatgtgcacaatgtgcaggtttgttacaaatgtatacatgtgccatgttggtgtgctgcacccgttaactcatcatttagcattaagtatatctcctaatgctatccctcccccctccccccactccacaacagtccctggagtgtgatgttccccaccctgtgtccaagtgttctcattgttcaatttccacctatgagtgagaacatgaggtgtttggttctgtccttgcaatagtttgctcagaatgttggtttccagcttcatccatgcccctacaaaggacatgaactcatcctttttatggctgcatagtattccatggtgtatatgtgccacattttcttaatccagtctatcattgttggacttttgggttggctccaagtctttgctattgtgaatagtgccacaataaacatacgtgtgcatgtgtctttatagcagcgtgatttataatcctttgggtatatgcccagtaatgggatggttgggtcaaatggtatttctagttctagatccttgaggaattgccgcattgtcttccacaatggttgaactagttcacagtcccaccaacagtgtaaaagctttcccatttctccacatcctctccagcacctgttgttttctactcaagttttacaggacattaataattccttgatttgataatagaagaatttaaactttctacttcttggctcaccaattttattaatgtggccatgtgtaatttgagggagtgaagaccttagactattgttcttatccttaggttactagtgcttttttcttaataatatattcaaatggaagtacccattctataatccttattattgtgtttatttttattcctcttccattcccttacatttgacatttatattaataaataaagcattgatgtttattatgagaagatatttcagaactatcagtggtcctctaactttagggtacagaataatcacatgtgcaacttgtgaaaatgcagatcccaggtctttgtttctagagattctgatcaagtacatgggaaatgtgactaacaaatctgtactttaaattatgcagggtctgtggttcatgcctttataataatggggcaggtatgttttaggtatgtttgcctgcttctgtttatatcattttcctaatgtgaagcataatttggtgatatgtgtgtgaatgtgtactgtttctgttacagtgggttttggaggtattttctttcctctcttctagattagcaactttcttttcttgggctgctgctctgaagtgtctcctccccactcactttcctccccaactcccagtttacttcatttatacctggcactatcaatgctaaagttctttcagcagggccacttcacgtttgccacctagaagcacatggtaaaattcagataatgacagaatgtagtgatgctggcttgcttttcattcagttatggttttgttatcttccttttcattcccttgtatttctacttcttcctgcatagcatgtgtatgtgttcttgtctaccttgaaatttaatacctatgaaagcctaaatgttgttagattctaatagattttgagccgggtgtttttttgtttgtttgtttgagacagggtcttgctctgtcgcccaggctggagtgcagtggtgtgatctcagctcactgcaacctccgcctccagagttcaagcgattctcctacctcagcctccctagtagctaagattatacgcacctaccaccatgcccagctaaattatatatttttagtagagacggagtttcaccatgttggccaggctgatcttgaactcctgacctcaggtgatccacccgcctccacctcccaaaatgctaggattacaggcttgagccacggcacccagcccagttttgtataaaaataagtctagttttcaccttaatttcatttcttggtgtttatgtcttacagaaatgcaatctcctgttgtacaaatgtgcctaatcataaaacagttgcgtgcagtactgtacttcaaagtgtatttcaagttattcactgtggcttttgtgacagattctttcaaatgatcatgctttttgaaaaacagttccttttatgaacagataaatatatgtctatcaaatacaaaacttctaatgtaaaaaaaaagtctaaagtgttttcttaattgtagtctattttattttttctctccttgaaaattacatggattcttttaagaattaaaatttgaggagtaaggtttttgggggattggttggcattacagaattattggcagttggggaatattgaagattgcctctaacacgcaattaaacctggataaatgttagtagatagttctacctggttgtgtatcttttttagccttggtaatggcagagggttgtaagaaatggcactttttaactttaagaatctttttaagaaaatggtacaacatacggtaatgagctttcttgatgtgggctaagaatagtaaaacaagttgccattgtcttctctgtaagtgtcagatacaggagtgggctatgctccaatttttgcaggagatgacatatctagaaccaattccacactgggaatattagaccaacaacctggaatgagaacaaatcaataattttttctattgacaagggcagacagactctgaaacttcttaactcaattactgggccacagtttctaggactggactacaaaatagggttcaacttcaacgaaagcaggaagatataagataaaaaatgtttctgtatttatatgcttgtatgcatataatcaatatgaaaaacttattaatggctagccattagtttgcatgatatttaaaataacattctgtagagcccctattttaagaaattatgtctttatttgaagtaaggcaaaggttaattgaaaatatatatttatatatttttttttaccaaatgtatgttaatctatatcatttgttgttcacgcatttcttcctttattattattttttagtatatgcatttgaaaaagaatggagacaaggtaattacacacttttcatgagtttgaggaaaaagtccgcttatcaagagttactagttattcaagggaaatggcatgctgtataaattaatatcttcatcataaagtaaatacaagggaaaatattgttccaaagggctaaatttcagcacggaatgacctcttaaagagaggtataccacaatcagccaaatcaaagtgttcaaaacaattttgtagtattctgaagaatattacttctgtagatatgagaaaagcaggctccatgctttacagttaagcataaagttcacaaaacctctaaaactgaatgctgctgatgacataagtgcaaaccatttaaaaacagagaaactatcaggcaagatatgttctatcaagcctccttccctcctgtggaaaaataaaatcaaaaaaagaggtctccattattttctgtgaaggaaatgattccacttttgacccttacccactccttcatgcgtatttttcaaaattatttattcttttgccttgctgcttttacttttatttgccatatatctttcttattcagggacaaaagttaacctttacacacatcagcttattttctatgtagcttgtttattactttaaaggtgacataaaataattagttcttttttatgtgttaaatttgttgaatgaatagtctacacttagagtttctattttttaatatttattatttgatttgtcacctgtgtgtagtcttcaacacacttcttttaaaaagtcaatgtcacccgatttccaaatgcagtaactgtctttgagtccttattcacctggatttttgtgtcatcccagtattgatgcaactccatccttttaaaagatttattttcttgggtttcactgggtagagttctctgctaggtctgtctctatacaacttctcatgtaacaaattccttccttcatttttcaaattatctctatcttacctggccctcatatcatctgctttccaaattcatgacaacgactaacacttatttttggttcaaccacaaatctgtctatgcagttccaatcaaaatgagtcgtattctcatattttcatctgcatggtgtcatccctcagcttctatgtagggatagcaaattctacacgtgctgcttgtttttttattttttatatttatttatttatttatttatttatttatttatttatttatttttgagacagagtcttgctctgtcacccaggctggagtgcaatggcgcgatctcggctcactgcaacctcagcctcctgggttcaagtgattctcctgcctcagcctccctagtaggtgggattacagatgtcaaccacaatgcccagctacttttttgtatttttagtagagaatgggtttcaccatgttgaccgggctggtctcgaattccacgtgcttcttataatcacctacattaccatattacaaactcaaaaattcctgttaaaaaaaaaacttaaaagcttcccaatgtatataaatacaatgtgtaagaaattggattcccactttttctatctacagaatacattttatcaacatagggttctactgattcctctgctgaaatttaactttaaaattttgctacatttatgatactgtcatctattgctttcatattccctatatttacatatatgtcttttctcctttcgaaattgaaaaatcatgaaagacaaatcaatttctctttcttctaattctcctagcccagttcctgacacacaaatatttaccactattatggcttaaattttaagtatttttctgaagctgttagatatttaggtagtaagtaaatggttcttttaacataaaatctatgtaatagaacatacagggtatttaaaacataaaccacctcctttttctccctgaaacttaacactaaagtttctaattatttattagcatgaatacaatcacctcaaaactcctctttgtataaccacaatattggcgttgaaggaatgtatagctatcttcctatggccgactgagtcaatggagcagcatgaaaaagtgtggaggcacagcacagcacaccagatagacagaaacaaatattttatttttattgtgggtttagatggttataacccattggaaagaaagtaaataggcatggcatgctttaaagctcagcaacaagcatatgaaaaaacactcaatatcactaatcgttagagaaatgcaaatcaaaactacagtgagaaaccacttcacaccagtcagaatggctgttattgcaagctcaaaaaataacagatgctggcaaggttgcagagaaaagggaactcttttttattttttattgttgagacggagtctcgctctgtcacacaggttgtagtgcagtggcgcgatcttggttcactgcaatcttcactgggactacaggcacccaccatcacccctggctaattttttgtattttttttttttagtagagacggggtttcaccgtgttagccaggatggtctcgatctcctgacctcatgatctgttagcctcagcctcccgaagtgctggtattacaggcactcaccaccaagcctggctaatttttgtattttttacaagagtttcaccatcttggccaggctggtcttgaactcctgacctcaagttatctgcccatgttggcctcccaaagtgctgggattaaaggcgtgagccaccgcacccagccagaaaagggagctcatatactcactgccagtgggagcgtaaagtagtttagccattgtggaatgcagtgtggcaattcctcaaagaagtaaaaacagaactactgtttgacccagcaatcccactgcagggtatatatccaaaggaatataaataattctgccataatgacttctgttcacttatgttcactgcagcactattcacaatagcaaagatgtagaatcaatctaaatgcccatcaacagtagactggttaaataaaatgtggtagatatatacaccatggaatactatacagccgtaaaataggacaagattatgtcatttgtaggaacaaggatggaactggagagcattatccttagaaactaacacaggaacaaaaaaccaaatatttcacgttctcacttgtatttgggagctaaataatgaaaacacatggacagaaaaaggggaaaacagacactggggcctacttgatggttaaggctcgggggaggaagaggttgaaggttaaaaaaaaaaaaaaactgttggattccaagcctagcacctgggtgacaaaataatttgtataccaaaccactgagtcataagcttacctatatagcaaagctacacatgcacctctgaacctaacataaaagttaaaatattgttttaaagaagctcaccccactgtgtatatagcactagacacatgattaatcttgaacctcttaagttgctctccctaaaccgttctaaaggaatcatgtcagtaaccactactaattttactgctgaactgtttctggatgttatttgagactaaatgacttaattttgaggaaatgttcacaagacataaatgcaagcaaaaaaaaaaaaaaatggtcaggttagaaattagaaatgtgtccatgaggagatccctaatggaagatttaattttgtatatgctttcctctcctcagaaggagaaatgcaatgtaactgatgtgaatatttccctttaaacttctttattttcctttatactcaaatttcatttttatctacatcaattctgatctaaggagtagcaaacagattatgcccctcagaaatgtatttggttcacatttctcgaatctgaactctcatctgcttctagtcatagctatagtaactgagaactagaccagtcataacagcagacaaaagttaatagctgtctttgcatatttgggtgctgcaccaagctgattttcattttgagaacgtggatttcgtcctttaatcagacctttaatggatttggtctgattttggcatatcttggcctcaacggtcattatggtaaaacttgagagatttttattagccaatatacacactgtttttccctagtataaacagctctttcataaaaaaaaaatctctaatttttaaaatattatcttattcatggtaggtagagtgccttcctttatttttcccagccttgcagcccatttcaaagtcctcatgcccaagggatattctacctgggaacctggattgctaaactatcaactctttcttctccaggaagagtttcagtatttttagatacagaggattgagatagagttcttaaaaacaatttatacctccttcagccatcatttatttagatacttcagaaaaagtaatatatttagctctctgctgaccctgctgtatgctcaggattttgtagcattctattgaaaacttaaaaacttaatatcatttctgtataatgatatttacaaaccagtgttgactatggaaagtccatgctcatctgcaaacatcagattactaagagtgtcacggccattgtctcaaaatcacttcattccagcttcaaaagttataatatatttactattcatatgtagtatatgagtccttaaatcataacttcatgagaattctcaccagtttggaaaattttcaaaaattaccagtataaattgttccacaacactgggatataagaaatatgacttaaaataaggacagttttgaaatcaaaggaaatatttctaatcttccacttcttgactaaaagaacataaaacgctagttatttgggggaatcctttcccttactttgtttaagagaagttgtgtggatttaaaggtgccccttctcctaaaggccacactgctctttctcccttccatggactacaggaaaaggtgatcacctattgagaagctgagtttaggatttcaaaatggtacctgcctaatggcaaaggcggctatggcccaaggcagagttaagagtgaaggggaagattacttggtgttgggagtagagactgtaacttagggaagcaaaaatagagagagttcatatgcctgtaattgtggaaaatacctggaagaaattgagtcctggggttttgctatagccatttctgtaacagaatcagcaaaatataatctaaaactgctcaaaccaatagcataaaaaaaaaccagattatcttgaagggtatcactcttcacccaaactgccagctagaaacctggaaaaatctcatctcaataccacccaacaggttgaactgatttccacgttgtcagcactttatgtatgatgctctaaaagagtaacagtttttaaaaaatataaatatttaccctcaagtaagaaaatacttgaaaattgtaagtgatattgttcaaggacacaatcactactgagagataaaagttttatattccctattgggctggtatgaactctttagctaagacccctaactcctgtttattagaatcctatcttgtagaactgccaggaaatgtctgcagtatcaccctcagacttttaggaacctcaacagtgaggcacatataaacaaacttacacgggtataccagaactctctgtctcaagtatactttgtattttggcattatatgtttccaggcatcttatttgaggagtgaagatccaggccaaaattccatatgttcttaccagcctgaccctaggcaattataagactttgcctgccaggcctcagggtgcagcgaagctgacctccttacaccagatttgtacatggtcagtacgttgcaattttctgaagggaattgcaattaaggactcatgtccgcatgagccagccatgctcagatgcatatcctacattcctgcattcctcaggtgactctgtttagaggccttttatcaggaggtgtgatggtttatattgagtgtcaacttgattggattgaaggatgcaaagtattgttcctgggcgtgtctgtgaagatgttgccaagggagattaacatatgagtcagtggactgggaaaggcagacctaccctcaactgggtgggcacaatctaatcagctgtcaatggggccagaataaaagcaggcagaagaaagtgaaaagactagaccagtgtactcttccaacctacatctttctcccatgctggatgcttcctgcctttgaaaactggactccaacttcttcggcttttggactcttggaccttcactcctggactgaaggctgcactgtcagcttccctacttttgaggttttgggactcagactggcttccttgctccacagtttgtagacggtccattgtgagacttcaccttgtgattgtgtcagtcagtactccttaacaaactccccttatatatacatctatcctattagttctgtccatccagagaaccctaatacaggaggccttaactaagactttttttccaattagtacttcactcctaacattctcccctcttctttctcctaatctttgagtccatagaacaatcaaagccttttgttcagagatcctcaacattgacaaggtctcccacctatgctgatccacccaacctttacctgtgccattctgtaaaaacaaaatagagcattaaaaagcttgtgcctatttttgccgcctgctaacactacctcagcaactgaaaagagacttgattgtcacattcagtttggcttgtcctacttgaccacctagacacctggaagctggacagtatggtgaagtacaccggtctttttcccagacactgctgaggattaacaaagtagctggggaaaattaattgggagcagggtgtgggagaagggaatgttccctctctttatccagcttgtggttaacatatccaatcaagttttaatctataccaagtttggccaactgcccacaagataattattataggatgtatgaattacacttagaagataaaagatgtaagtagcatgtgtctatacaaatacaaactgcatattcttttggtgtatattgtctttcttgagaattatcaggccactctcattgaatatctctgttgaaactcagccaattcttcatattgtggtttacaaggtatgagcagctaaagggatagaatgcagagaatgtcctccaattggcacgagtgagctagagcaatttttccttcagtgttgtggatgacactcttaagctgaagctgacagatggaacccagagaaaggtattgggaaagaaacaggagagataagcacattcttcagggttcctgtgtattagataaaaaaaaagcatatagttggctacccagaggccccctgcagttctgcaagtcatcgtattcatctgcagaagacattttaacaacctggattctcaaagacgactcatattgtcaggaaaggtgtgcactttccaagtccagggcattattccaatagacatttcccaaatttaataagcatacataaacaaatcacctgagaccttattccaatgcagattctgattcagtagataggagacgaaactttatatttctaagaagctctcagaagtgatgtcactgctgctggtttgtggaccatactttgagtaagaagttaatagcgtataatgaaaaggcaccctgtggacttgtgcgctgtacaacctgcaaaaatatttacagtggcccagccatctgtactcgaggaactggaaaccatgtgacttcttatatttttcataagtttcttttaatcatcaaaggaaacaaacaaacaaaaaccccaaaaccaaaatttctctcactcacacaatacattcttctggccgctgacccctttccaaaaaacagctctttgctagcctaaattactatttttactcaatggagaaataaagagagttttttttccccttaattgtatgtgatagtgaaaccattttctctttgcactggagttcggttctaccatttacttaattgatgtagttcatcaaaaggattagttattcaccatcactgaaatagggtcaggtaactctgctctgaataaacattctattattttgaagattattcagtgtttttcactctgttctctatggacaataggaatcagacgtatttccttgaactgaaaagattccagggtccaattctaactgcttcatatgaagtaaagcctctcatcagtatacatgtccagaggattatagctcacattctcaataggagaccaagttacttgttgtcttgcttagtgtgttttgtgctgctgtaacaaaataccataaactgggtagcttgtaaacaaaataatttttttctcacagttctgaaggctgggcagtccaaaatcaaggcagactttgtgtctggtgaaagaatactttctgacttatagacagcgccattctgctgtcttgtcacacaatagaaagagtaaggggtctctctcaggcctcatttataagagcactcataaatcccatttatgaagggatctactctaccctcaacccaatttcctcccaaaggccccaccttttattaccatcatcttgggggtgagtatttcaacatacgaattttgaaggaatacaaactttcagactataagcattcactttatgacatggcattacacatataatattaaggcttgcttcaagtcttctggtggctacctacacagctcttcattcttgcctggcatgaagcatagcttttagtgttcagctttaattatccacagctgacagtcatggaaagtgcaagacataaaatagctccaaagctagagagaatctaatttacatgagtcatagagcagagatgctttcagctataatggagtaagaagaatcatatgtattctctagtattacacaattaaaaacatggactatatatgtaaaaatgatttgcatatagtagacaataggaggcgcaagtcagtcatcctggaaggaagaaaaccaagcaacatgagccctgggattgcccagtagtagcaatagagttgagcatctgaagaggccaaacataaaacatttaaaaagcaaagaagagaagagaagatagctgcacagagagaaccttgcacagagagaactctggagatgtggaacagattctccttgtattaccagctgagtactgatcagcaaattctttcagggaaaacatatcaggctggagaaaaaaaggaggcagaataactatcaagactcgtatagtattggcaatagattacatttcctagagcaaaagacagcaaggagcctcaggtgaagtattcaggaagttactgcctctgaagttggaccaaattagtctaaaggtaaccttagtcctgcctaaaacagcttctaaatgaacctcagaagaatcaaactatattcaagtaatttgactctctcttacaacaaagatgaaaaatatttaaaggactacagagaaaaatctatcataaaaattaataattttcaaataattatcattcatttaaagaatcagaagtgcctaactcatatgacaaattcaatcaatagaaacgtgctaagaaatgatgtatatgataaaattactggacaaagacactaaaacagctactgtaaacatacagcttgtatccaaaaagttaaaagaaaggcatgaatatattaatgggagatgtggaagatagaaaaaataggcaaatcaaatttgtagagatggaaattacgaaatatcagatgacaaatacaaagtcttagatgacaaatacactggatggtatcaagaccagaagaaatactattgtacaaaatgttagtgacatttaagacacagaaataaaatctctttaatagaacacagagaaaaaaattctgaaaaataatgaaaaatatatcagtgagctacgggacaaattcagtcagtgaaatacgtttgatttaaagtactaaggaggggagaagagaaagaaattattgaaaaaaagatttaaaaatttacaaattttataaaatgttaaacttacctttccaataatattataaaacttaaacagaaaaaaaacattaaaaacgactctaagacatttaataatcaaatcctttaaaccagtgttgaagacaaaaatctgaaaagcagctggagcaaaccaatcaacaacaacaacaacaacaaaaaaaaaacaacaaaagccacattctatacaaaagaaaaaaaatagatcattatgttagcagacttcttattgaaaacaatgtcagaaataaaattagagaaatagctttaaaataaaaaaaaaatactggatgaacaattcaaagcttatggaataagaaaaaacttcaaattttccatacagaaaaactatctttcaaaaataaaagttaagtaaggacccagtcctggcagcattcatcacctgctaactgaagggcccttggacccagaataacaagcagtgatacccaggtagtacactgagggccttgggtgagcctctgagacttgctggctttaggtgagactcagcacattatcagttgtggtggatatggggcaaaactccttctgcttaagaaaaacagagggaaaagtaaaaggggactttatcttgcacttaagataccagcagggttacatggcagtagagcaccaaatgggctgttggggtccccagttatagagctgtactcttagacagcatttctgaacctgcctgggtgagaagggagcccactgccctgaagggtgaatcccagatcagacagcattcaccacagctgtcttaagagccactgggccttaaggaaacattggcagtagtctggcagtatttcctgtggccagaagtggtggcagatatggggtgaggctcttttgcctttggaaaagggagggaagagtgtgaaggactgtatcttgtggttttagtgccagctcagccacagtacaataaaacaccaggcaggcttataagttttttgactctagtccctgactccctgacagcacctctggacacatctggcatgtgggggaccttgctaccttgaagtgaaggatgcagacttagctggctttgccacttgttgattagagagtccaaaggccttgagagaacataggcagtatccagggagtggttaaagcaggccttgggtaggatccagtgctatgctagcttcaggtctgacccagcacagttgtaatggttaatactgagtgccaccttgattggattgaagaatgcaaagtatcgttccttgttgggtctatgaggatgttgccagaggagattaacattaaaggcagtggagtgggagaggaagcccatctaatcagcagctagcacaactagcataaagcaggcagaagttggaaggacttggcttgttgagtcttctagccttcatctttcttctgtgctggatgcttcctgccctggaacattaaactccaagttcttcagcttttggactcttggagttacaccagtgatttgccagggggttgggcctttggccacagactgttggcttccctacttttgaggtttggggactcagactggcttcctggctcctcagcttgcagatagccttcacctagtgattgtgtgagtcaaaactccttaataaattcccttcatatatacatctatcctactagttctgtccctttagggaaccctgactaatgcaacagtcatagtggttttggccacaggggtgcttgtggacacacccacctttaagtggctcatgtttggaagaaacaaacagagaagggaagagaataagagtctctatctgacaatccagataattcttctggattttattcaagacaatcaaggcagtacctctatgagtttgcaagaaccatagcattactggatttggggtggtcactgaaagcagacagaacttagatcacaaggaccaaagtcgtttcaaatatcaggaaagccttcctaagaaggatgggtacaaacaagcccagagagtgaagactacaataaataacaatcttttcaatgcccagacactgaagaacatgtactggtatcagcatcatccacaacaacatgacctcattaaatgaaaagcatcaagaactaattctggagaaacagagatatatagccttaccgacaaagaattcaaaatagttgtgctgaggaaactccaagagattcaaaataacacgagaaggaattcagaattctatcatataaatttagcaaagagataaaaataattaaaaagaatcaagcagaaattctggagctgaaaaatgtaattgacacactgaagaatacatcagagtcctttaatagcagaattgatcaagcagaagaaaaaattagcttgagaacaggctatttaaaaatacacagaagagacaaagaaaaggagtgaaacatcatgaagcacacctgcagcatctagaaaatagccctaaaaaggcaaatccaagggttattggcttaaagaggaggtagagaaagaaatagaggtaggaagtttattcaaagggataataacagtgacctttccaaacctatagaaagatatcaatatccaaatataagaaggttatcaaacactaagcagatttaacccaaagaagattacctcaaggcatttagtaaccaaactcctaaagagcagggatagggaaagaatcctaaaaacagcaagagaaaagaaaaaaataacatataatgaagcttcaatacatctggcagcacttttcaatggaagttttgcagcccaggagagagtggcatgacatatttaaagtgctgaagggaaaaaaataaataaactttaccctaaaatagtatatccagcaacaatatccttcaaacatgaaggagaaataaagactcccagacaaacaaaagctgtgggatttcattaacaccagacctgttctacaagcaacactaaagagagtattttaatcagaaagaaaaggaaattaatgagccataagtagttacctgaaggtataaaactcactggtaatagtaagtacacaaagaaacacagactattataacactgtggctgtggtgtgtaaactactcttaccttaattagaaagactaaacaataaatacatcaaaaataataactgtaagaacttttaaagacacagtcagtacaataagatatgcatagaaaccacaaaacattaaaaagtaaggggatgaagttaaggcataagagtttgtattaattttcattttgcttgtttgtttatgcaaatagtgttaagctgtcatcaggttaaaataatggattatatgacagtatttgcaagactcatgtcaaccacaagccaaaaaacataccatggagacacaaaaaataaaaagcaagaaactaaatcataccaccagagaaaatcacctttgccaaaggaaaacagaaaggaaaggagaccaaaaaaaaaaaaaagccccagaaaaaaaattaacaaaatgacaagagtaagtccttacttatcaataattacactgaatgtaaatagactaaataacaatcaaaatacatagactggctgaatagatgaaaaaaaaagacttatttatctgctgcctaaaagaaacacccttcacctataaatatacacatagaccaagaataaaagattgaaaaaagatattcaatgtcaatgagaaacaaaaaagaatgtgagtagctatatttatatcagacaatatagatttcaagactgaaattataagaacagacaaagacggtcactatataatgataaatgggtcagttcagcaagaggatatagctattgtaaatatatatgcactcaacctgagcactcagatatataaagcaaatattactagagctgaagagagagataggtcccaatgcaacaatagctggaaacttcaacactccactttcagcactgtacagatattccagacagaaaatcaacaaacgaacattagacttaatctgcactatagaccaaatggatctaatagatatttacaggacatttcatccaagagctgcagaatacacattcttttactttgcacatggttcattctgaaggataggctatatgttaggtcacaaaatgtatcttaaagcaataaaaaaaattgaaataatatcaagcatcttctctgaccacaatggaataaaactaaaaattaataacaggaggaatattggcaaatatgcaaatacatggaaattaaacaatatgctcctaatgaccagtgggtcaatgagaaaattaagaaggaaattaaaaaatttctggaaaccaatgatcatgggatacatgctgtaaaacctatgggatacagtaaaggaagtacaaagagagacgattatagtgataagtgcatacatcaaaaaaaaaaggaaaaacttcaaataaacagtctaacattgcatcttaagaaactagaaaagcaagagaaaatcaaatccaaaattagtagaaaaaaagaaataataaagatcagagcagaaataaatttcagtgaaaaaaatacaaaagatcaatgaaacaaaaacttggttttctgaaaagtttaacaaaattgacaaatcttaatccagactaagaaaaataagagaagatacaaataaataaaatcagaaataaaaaaggtgacttacaactgatactgcagaaattaaaaggattattagtaggtactataagcaaccatatgccaataaattggaaaatctagaagaaatggacaaattcctagacacatacaacctgccatgttaaacaaggagaaatccaaaacctgagcagaacaataacaagtaacaagattgaaaacgtaataaaaactctcccagtaaagaaaaatgcaggtcccaatggcttcactgttgacttctacgaagcatttaaagaactaataccaatcccactcaaactattttaaaaaacaagcgaatagggaatactttccacctcattctatgaggccagtattacctgataccaaaaccagacaaagacacatctacaaaagaaaactacaggacagtatttctgatgaatattgatgcaaaaatactcaacaaaatactagcaaactgaaatcaacaatacattagaaattttatccatcatgagcaagtgagatttatccctgggatgcaaggatggctcaacataggcaaatgtgatacatcatatcaacagaatgaaggataaaattcaatgttcatttcaactgatgctgaaaaagcatttgataaaattcaacattcccacttgataaagaccctcaaaaactggggagaaaatgaacatacttcaaataataaaaactatatacaacagacccacagctagtatcacagtgaatagggaaaaactgaaagcctttcctctaagatctggaacatggcaaggatggtcattgtcaccactgttattcaacatagcattggaagtcctagctagagcaatcagataaaagaaagatataaaagacacccaaattggaaaggaaaaggtcaaattatccttgtttgcagatgatatgatcttacacctggaaaaacctggagactccaaaagagaactattatgattgacaaacaaataaaatttcaagatacaaaatcaacatacaaaaatcagtagcatttctatatgccaacagtgaacaatgtgaaaaagaaatttaaaaagtaatcctatttacaatatccacacataaaattaaatacctaggagttagctgaagaagtgaaagatctctgtaatgagaactataaaatactgataaaagaaattgagaagaacacaaaaaaaagaaaaatattccacattcatgggaatcagtattgtcaaatgtttatattacccaaagcaacctacagattcaatgctatcactatcaaaataccaatgacattccttgcaaaaatagaaaaaacaattctaaaatttatatggaaccacacctccccaacacacacacagaatagccaaagttaacttgagaaaaaagaatgaaactggaggaatcacattacctgacttcaaattatgctataatgctatagtaaccaaagcagcatgatactggcattaaaaaaaaaaaaaaaaaaagatatatagaccaatggaacagaatagggaactcagaaacaaatccaaacacgtacagtgaactcatttttgacaaaggtgccaaggacatacactggggaaaatgtcatctctgcaacaaatagtggtgggaaactggatatccatacacagaaaaatgaaactagacccctatctctcatcatatacaaaatcaaatcaatatggattagagactttaatctaaggcctcaaactatgaaattactacaagaaaacattggggaaaatctccaggacataggtgtgtgcaaaaatttcttgagcaatacctgtggggtattaaatagaaaactcgtttttgataaaaactctcaggaaactagtaaaaaaaaaaaacaaaaaacaaaaaaaaaaaaaacaaagaggagagaggtaatttccttaacctgctataaaacaaccagaacaagcctacagctaactttatactcaatgggagatgctgatacttttctttgacataaagatcaaggcaagtatatataatttctgacttctgttaaacatgtgcaggtgttctccagtgcactaaaccaggaaaaagaaataaaacacattcagattgaaaagaaggaaaactgtctttattggcagataacatgatagtcttgggatccttaaggtgttgcttttctagccagaaacctctgtggccgttggcatctttgtccgagttttgctcaggcctgctgggcttgttccatctacttggcctggcaggctgcacttggcttgtgttatgggcccaaattcgacacctgccaagggcaaaccaggaatggaatggtgaggggtgcatgtgcaagtgagcgcagggtccagccactgtgcacagccaggcatgaaggctgctatggcggggcaggtagctccaggcaccggcaaaggtgccggctccatgcatgcatgtggctggatctgatgcactgcaagcagcttctgctgtgggcactcatgtctggacaaggggaatgcagtgacatccagaagcttggagatgccagaaactgcagagccccaaagagggtgtcagagtcctggcttggggaccccctaggtctgggacccctaaagggcagcagccctttttttctcattgcctgcaatgtggtaaccagtcacggggaggtgggggggggggggcggggtggcggtttcagccctgctttgtgttacagctctttcagtcccactattcagtgagtcccaagtttttgtcccatgtccagaaagaatgacatatgcagacaactggagagtaagcaagggagacagtgagtgatagaatagcccttcagagacccgaagtgggtagtttctttccacaggcaggtccttctgatgagcgcagcccttggtggagaagagacccagggtgggtatctgcaggcaggtcatcctgacctatctgtaggcaggtcgtcccaatgagtgtccagctctcagcagagaggagacccggagtgggtagagctcctttctgcaggcaggttgtcgtgaggagtgcagccctcagcaaacaggagactcggagtgggtagagctcttttttctgcaaacacgtggtcggatgggttaaggagactcaaattgggtagctccctctcacagctggtagtcagttatctctgtgagtctgactgtgtctgggatttttatggtctcagaagggaggaactgcgtgctgattggtccgtgggcagccgtgggcaggactggaaaaaagcatcgtgtaagttctcattgagggccgtggactccaactggatttgacagcctggccctcaggcttcagggatgacagccagcccccacgcttcagggcttgaggtggggggagggggcttcgctggggacccactcctttatgctcaggagcctatctgtctcctgctgccatcaatcaggttgtccaaggcacgcagagtgtttgtgctgaggggtgccttgcaggcccactctgagctgccctcagcacctcattggccttccttccatgcttgttagtgcctgaaacccagaaggggccgtggcagcagggttctgtcgtgtcagcaccgccctgagcatacagacaccagctgggttgcaacaaatgtctgggcttggcttcaactttgctctaaaattggagtgggcgctggcagtggggggagggcaggcagcaggagcaggcaattctgagcctgtcagcgggtcttcccaggctcctgagagcatagggatgcccgggtacacagctatggctgggaggctgcagctgtgctcaggaacatggggctcctaccccaccaacttggaagagggttcccacctgttcctggctcccgctggctccatggaatgtgcagccccagtcatgccctccctattgcagctggcatcttcacagtggccactccagatgggccaccactgccatcaatagtttatgtagaaattcctaaggattttcccacagatctaccaaaaaaggtagaggaaaaaataggtgagtttagcaaggttgcagaataaaagtcagtacacatacattgattttacttctatatgctatcaaaaaataactctgaattcaaataaaaataccatttgcaatagaacaaggatatgaaatacttagtaatcaatctggcaaaagatgtgcaagacctgtacactgcaaattgcacaatgttgccaagataaattaagaaacctaagtgaatggtgagtaataccacattcatggtttggaaaattccatatttttgagatttctgcttttccgaaattgatatgttaattcaattcaatcacattcaaaactagtcatttatcttttctttcagaaactgacatgctgattttaacattcatttgaaaaggcaaaccaactagaatagcccaaactttgcaaaaggagaataaagttggagaatgcattaattataaactatacttattttaaaatgaaaataaatataacaattctaaaactagagttattatcaaataaacttattttagctcattgtaaaactacagtagtcaagacaacatgactctgatgtgaagacaaacatataaattggtgaaatagaagaggaaatctgaaaacagtcccacacatatctgttcaattgatttttagaataattgccaagaaactccaatggagaaagtttaatgttttccacaaatggtgctataacaataggatatttatagacaataaaattacgcttagtccttaactcacactatgttaaaacatttactcaaaatagatcattgccctaaatgtgaaagctaaaataatacactttctagaaaaggaaactaaaatgaaaatcctagtgaccttggtttgggcaaatattttataaatagggaacaaataccaaaaacaataaataaattattgataaactggacctaataaaaatgtaacgcttttgctgtttaaaagacacttgagaaaatgtaagaaaagtcccagcctgggacaaaatattttcaagacttgtatctagaatatataaataacttttgcaactcaatcgcaacacaaacgacctttcaaaaatcatggtcaaaagttttgaatggacactttactaaaaaatatataaaaatgtcccactagcacatgtacacaattctgtttatgaattgttattagataaatacaaattaaaaccggaatgagataccagtacatggcttttaaaaagttgaaaattaaaaatcctgaccaaatcaagtattggtaaagatgtggaataattgaacctattgatatgaaatacttgaaaagcaaactaatctatagttataggtaacagaccagaaattgtctgggattggctgaagggtagaggatagggcagggagatcaggaaggaagggttataaaagagcatgagaaaccttttggggtggttgatattttcattaacttgattacaatgatacttctctaggtatattcacatgtcaaaagtcatcaagttaaattctgtaaatacttgccatttattatgccaattattcttaaataaagtccttttttatcccccacgaggtggagtctcattttgttgcccaggctggagtgcagtggcatgatcttggctcaccacaacctctgccacccgggttcaagcaattctcctgcctcagcctcctgagtagctgggattacaggctcccaccaccacactcggcctggctaatttttgtattttttagtagagacagggtttcaccatgttgatcaggctggtctcgaactcctgaccttgtgatccacccacctcaggctcccaaagtgctgggattacagacgtgagttctaaaaaagaaagaaagaaaaggaaaatatcccattggtaggaggtatgtctctgcagtttccaagccaactttgagacagtagcgccattataccttaagtcagtaataaagtcactttattatgctttaattgtcctaatcgttacgggggataaagtttttaaatttactttttaaatgttttagctttctaattttatttatttcttgtatcttccatcctcccactgaatttctgaagactccttcttgcccttaaatgttttggatgaaaaagtgatgtgttttgtgattaaaatcaagaacatcctaccaagacattatacattttatacaccactggaaattcatgtcataatgtaatttcttctgtaacttcaaataatattttttttctgcaaattatcatcaggaaatcttttatagggaaaattatctgtacttcctaaactaacaaaaagtaagtaacactgaactctctactagcagctaatataaaatagcaattgcttttaataaatcatcccaagaagctattgctggccttaatggagagctcattgaaaaacagtggacatgatataatgacaattgaattgtttcctttatttggtatattggctaagctttggttttactactatttagctcagatgatataaatgatctttaatcttaaattataaaaataaaattaaactatcattttctcaaatgtatatagtatatagataaaacacaaggttaggtacagttgatgaagtaaaggctttgaaactcttcagtgaatataacagaaataaactctcagttgtaaaagagccacaggtgctttgcatttgttttactccctcctccatatcccatttctattccacatcacttctcccttctcatggagacattttatcctcaatgttctggagtttccatgtttttttctttctttttttgatccaaaccttttctcaaaacttgatcatgttataaaatcttcacaaattacttcttcaagagagggcaatatttatgtcaaaagtctgaatttgtatttattattttgataggaaatatttatatcaaaaagtgagttatatagatattttagctttagtgaaagatgaggggagtcttttatttactattaatttattatgtggctagagtatcatgatgtggggtgagagaagtttggatgtatcaaataggcaggtggactttgctactataaatgaagtcacacaatatagttggtcctgcactctgcctgtgtggatggataagaaatataaagatgttcgttcctgagacctgaaaattaggtatcttctgatccagaagttgacctaaagtgtaattgtttgtaaaatgaaagagtttaagctgccctcctaattcacatttattttctacaggttttgtgaagggaaaagatgatatgattctattgcactatatcaattttgtagtaccttttatttatttatgtttactaggaaaaaaaaaaaacccaggtgacttctgaggccttcagaatcactgctctgagttcaactgacagacctctagattacatttgtattttcaaattagccagctttctatgatggttatctaaaaatagaaggaagaaaatgaaaacaaagttttttaaaactcccttgtgatatcaggtaataatttaaaaagttttattctcactctttctggagtacattctaatatggaatttgataccacttaaaattgaattttttatgggagggagaaataagatttccacatttcctttgatatttgcatattttatttcctgttagatttgattatgtttttccttcctgtttcttgaatattgattttctgtctctatatggaagaacaaacactgaatgtgcacaaaagaacactgctctaggttcttgagaaacattaataaatgaaacaaaaatattcctctgcaatgtacattctagagttttttcttgagtattcttagcaagcagagctaacatttattattttaggaatgctattttcagagaacactgaaataaattagattttattttaattgaaagggctctttttatctgcctcatgtctgttaaaatataattttcaggcaggtaaaattgtgactctcatagtaacatgaaatgaacagttgtcaaagattttatttaacccactaattaatgaggaatagagtaagatgttaggactaattcaaatgtgaattatcaagattgatcttctgtacaagattcatttgcattgccatgagcaggaatcatttccaggaaatatttgcattatttcgggttctccaggttaacttctgtctatcacagatggatacctctgtagaattagataatcccagaggagcagttatacaatgctcagcattccattcaaaggacactcagtgatctctttctctcatttcaaactcttgcacaaattttcctgacttagcatatttgccattatactggtgctattacaattttgctaagcctcattaaagtatcacacttgataattagaaaaaaaattttattatgacttttaaaaattggttcatctgaaattgaatttaactgaaagacaaaataagtgaattctagagacaaaggctttgagaattacttactttagactgcaattcatttgtttaaattatagcatccagattctcaaccaattagtggagtgagactccatctgaagtaaatgttgatgcctgggaggtaaagttgttaactactcccctaaattatcataactttagccaatttgaaaaaatacaacgaaaaaatttccttactaaattttaatcactctaaagttcagggtattatatcaaaaagtaatcataaccacttatctcttattttgcctcactgatttttccctatttatttttacaggtcaataactagagcatgcaaaataattcttcaatttcctgtgtgtgcttttctcgtgaaaccaagtagtttaagtactatgaaagtagctatattttgaattttatatttactgcttaaaagagtagatgtaaatactttttaaaagcagatttctttctaacagttgcttttgtttttcttggtaactcttgaatattgtcaatcctatgtcaacatttaagtttaaaaaaagctcttcttagattttagttttctgttacaattattttattcctattttagacatgactgtaatctgtagttttgcacaatttcatgacctatttttgtttatatttttctgtattatccggtgaatacatcagtttgaagagataaactttcatcctgtcatgagtaatacctactcaaaaacgtagcagtatcacgttacccatatctccccacatcaagttcagtgcagacccagtaatttctttctccctacaacaaaatggagttaatccatcttgtccactaacacaaagtacatgaaatatttcacaggcaattaaagtgacagaaaaatatataactctcgccggaaccaatttgggatgcaccttgtgagctgctttctcgggcacctctgcaccaactttgtttctctgctctgccactgtacagtagtttcatttcaagtcacggattctggataccaaccaagctggcaaatgaaaaataacacagccagggccatttcacccaccagtgatctctgtctgtgagataattcctccctgaggtttctttctctccactactgtgttcttaaaggcctaacacagggcagcggactggtgccactgtctaaggtttcaattaagacgtggagatatcaaagaagtaacaaacaggcctccacaacaatgcctcatggtttgctctcagttctggttaagagatggcaagatacttgaaaaatgtagttcattaatcctcacaacagaccccggaggttgagaggacagaaatggagccagcaacaggatcgagtttgaatagcttctctgttggttgtgtacattgggagctgactgtgaaatctatgtggacatactgaaccctatggttaacctcatggtgcaaatgtgttgatcaaaggcactctgtcagtatctgattaagagccatgtaagaacactgaagacatttccttctgcttaacaactctgattacagggggctcctggagtgagttttcctgtaagcagtcaagcaggtccctgggctccagctgtagctatagggtttcccaatggcagagcttcctgttgctgaaggcttcaattcattcacagcttgtaaatcagtagcctgtaaatcaacagattgagctactactgtttaaaacacagtttcctcaacaagcttccttctggttttgttttcatatatcaagggtatgaaaaaaaagtgtccaaattttaacacctggaccgatggggtctcagcaggagaggtatgttgcactaagctctgcagttttgtttttgtttcagcggagcaaggacttagtgactaaaatcaagacagcatttccttagagaaatgacaggggacaattttagaaaactgaaaatttcttatgctgcatgcaccgcagcaatttttaatgtccgataagaggtacaacaaaaagctaaaactggaatgagaatcaccacattaattgtttgactctccagtattaaacatgtatagataccattttgaaattgatctgaagtgtttaatcaaactattttgaacattttatatggcttaaaggctgttaaaactgaatcaacagcaaaaggactgattaattgcagaaaatcttctattattaatgattaattgtacagaaagctatacatcaagaaagctaactgaaaatgtgtcaaacatctaaattatggcttcatctattattactaagtatgtttgttagatggcaataacaggtaccatatagtctatacaatattataacaagcttttattcattatggtcatgtttatttgacagagcagaattatgtgaaaagtaatttgtaaatcatattatgttcaaagttaatattaagtgttgataatgagtagccaagaaaattaacaacttcattttatcctggctcctatatgaaatgcaacaaactcacatggaaacttaatttattttccttgtcagcaatctggaactatcaatatattgattctatttatatgattgtctctaggttctatgagaaccgtagggaagagaatttgggaactaatcctttgaataacattattattattatcctttaagcagacttggatttgagggctgatccaggttctgggaaatgagtctttataagccagaaatctccctctgagataggatagagatgatgtcttgctccattttggtaagaaaggctaagagcgacacaaatgttcacacactagtagctcccagcattgcccttgggggacttggttgaactttttagacagggaagtattatttcctaggaaaacactacatagtgaaggtcaaaatgggtaagttaggaggcaaatattacttggaggtacaaaggttttcttttagcacaaaggagctgaaactcaagagtcagaagagcttagtggcaacatttggaggcaagtggcaaatacactattcccaacctttggggaaaggaaagcacaagacataaaaaatatcccttcctagtgaacaaaagtgagaattacaattaacatccagaaattaccatcctaaagaaagggaagtggaataaaatttcaggaataagtttagatggtattggaactcacggcatccctcacgaaagctgaacactagctattatgtcttatggttgatattgcctgacaaacagctatatattcctattaattcagtttgaaaatgaaagcagtcatatatttttccacctatcagtttcccatgctaatctttatcaaattgtttccctctgtcctcaaaccctctctacatttctacccaacacattagccattcattttttttttttcggaactcccattcttccccaaagggaccacaaatacatacctaagaagtatagacttaggaaaagagagaagcattttgcagatgcctgcaggagagaggctagatttgatttagatagcttaaggacctagaactaggacaaataattagtaggtataggaaagcaaagttgtctcaggacaaagctatatttgagttattaaatttggaaatatctaatttacaattagttacttcctatcactggaagcatgttataaaagtgtagtggccaattactatcagtatgttgtagaataaagtcccttcctaaaatgaaagtcggcaatgcaattttaaaaattcacttttaataggtaaacattattagagtaacaaatcaaatcagtttcaaaacataatttgtggatacttacacacttgtagtcattgctgtcagttactgtcacattaaaacaattatccaaaaatcatgaaaatttcttgctgcaacatttagtattattgtaccctcataagtcctcaattaattgtaaataaatttgttagcagcagccttatttgtatttgatttgggctcagaatacttttcagacaatggaaaggttgttgatagcccacaagcatagaaaaagtaatcttaggaagcatgactaagtattcaaattaccaataccatgattccagatcttgataattttactgtgaatccacgtacctaagccttctagtttatgaattttactttttagtttcatgactgaagtaggtaacctgacaaaatttaaggacatttagaaatatgtactttgctggaaccagttgtgatgtatcttcacttgggaagaagtggcttttgccagctgggaagagctcaaggttctcctgcctctgtttcagagcccctggtgatttgaggactgattcatgttcagttccccggagaatatagttaaattgagaaaaaaacaatcatcataaatcatatatgatgtctcaagacgtaacatttttcacataactcagaggctactccagtcatgacacttgaatgacatacaataataaggcacagggacctccaattatcagatcaaggtggtctcagaaaatggtagtgtttttttttttaaattgcaatatgtggctaaaacattgtgattaaacactaggtcaagttagcagagaaaccatctcatcttaatccctatacaactcattaaattgagatttcagcaaaatgtaacagaattataggaagaatcacataaagtgactcagaaatgggaaatacttgcggcatcagatctctgctttaagggtttttaaaaatctcttatatacaactttattatagagataaaacattatagaggactgggtagtaccttcaaaagtaatagctcaaatttccatgcattttcttcagttgtttagatctcataaactaaatattttctttaattgtcaaagatttgtacatgttacaactatacacatatatacattacaaaaaatattcttaggtcttggtaaaattctaactattagatttaagtgaaacagttcctttaaaaagtcaaaacattcactctaaattaaaactaagagagaaagagtctattgatgaatattatttttatggccattacctagtaattcatggagaaaactgaactcaaaaatcagagattaaatctccaatgcctcccttttacctactcccacccaccgtttgtgggtcttccaaagctttccttaacctgatttccaaatttatctcccactgttcaggtatagtatcattttttgctaatatcacatttatttgtcactatttcctgcacataccttatactttcttacctcttacctatttccagcaatttgtaaaaccagaatgcttatgaaaaccatactcatattttaggatctctttaaaatatcttcttgtttacatagtttcataaatctactccgaaacatagtggatccctctttttctaaacttcttacgcttagtatacaattcttcccaaacttttcatttcatgacatgtgcagaaaaccagtagaactgtagagcacactgaggtaagctaggatgtctttttacaagattggagacaacctaaatagaggctccaaaggctgcagatgcagcaggcccattggtgatgaatacttcagcacagctataaacaggtatgcctgtcgaacagaaataaattctatatcaattatttgacaggttttcaggtgctgtcttatatcattacctgtatcattcctcattattagatttttcttgtcctatatcctgaacagatcacctactgtttgaaaacaggattaattccttataattgtatttatttatttaaaattgtggtaaaatatacataccataaaatttgttattttaaccattttaagggtatagttagtgacattaagtatattcacattgctgtgcaactatcaccactatctacctccagaatgtttttcatctttccaaactgaagctgtaaccattatgcagtaattctgcattcgcctcttcccttagtcaaccacacattctacattcagtttcaataaatctgactactctaagtaccttttataagtggaattatacattatttgtccttttgtgactggcttatttcacttagcataatgttttcaaagttcattgataattgttttagacatgatagtaatatgttgcacatcaccacctagaagattctcaatatatattatttgtttatttttcaatgctcttctctgagcaccttacatttaatagcaacaatttaagtatgagaggatttcatttctgactactttagaaattgtgaatcatttctaagtgctattgcacttgatatctttgattttctgttaaactcttgtaataagaatcaatgtagccatttgtttgaagggagttattactgtcttagctactaattgactttaatcaatggattatagtttatcacccaaaattgcattgtcttaaattgaccctaataattcaattattttaaattagattatagtgtcacagtcattgataagactatgtatcttgatagttcttgttcttcagagggtgtctaatagacttgttaaaattactgtttctaaaattcataattttcttgtaaatgattgttagttatttgtttatataagtaaatttagtacacagtacttctttgttattggttaaactaacaaccttatcctctgtgcaagattatatatataatctatgtcatactaataaaaactagccaataaataatttattaatattaaaataaaataatttttgaaaataatttagacttgtgaaatgaatactgaaagataatacaaaacttaaccatttttttctagtgcctaccttgtttccatgttttctgatttctgttgcttttcattacataattcaatggttttctaaaaaaattataaatgagttcacctacatagtcctgcaagcaatctagataaagtatattgctgcagaatgcttttttatattgaggtatttattcttttcttatagatttattttgaatatttcttggccaatgcacctgggcatcatgacatttaaagctgtgatctgatttcatacaggcattgactctaagagaataaagctaaaatgattaatttacattgtacataaatatgtaaaatagtgataagacatttgactaaaacaggtttataatagcaagcaacagcaatagtgactaagataatgcagatattttgctacttcacatgctaactcccaaggtatactaagaattgagtaaatttttctgcataaatttcctactaattttagttctacaattgtcgatgacggttttgcagaataaaataaaattttatgaacagttacagaaagatattctgctaccaggatttttttttttttccagatggagtttcactcttgttgcccaagctggagtgcaatggcacaatcttggctcactgcaacctctgcttctcaggttcaagtgattctcccacctcagcctccctagtagctgggattacaggcacacaccacatcgcctggctaagtttttgtatttttagtagaaatagggtttcaccatattagccaggctggtcttgaactcctgacctcaggtgatatgcccaccttggccttccaaagtgctgggattatctggtaccagttttaaaataaaaaagaaaatataaatttgatatttctaatccattacatcgaatgtaagacttcagatttatctacaggaaaacttccctattaatagttaatttagatgagagcatttccttattgctaaacttcagggatttttgttgcatgagtcataatataaaaaaaaatctacagataatgcacacattataaatatattcctcaaataaacaacatcataaagtatgattaacttgtaactcatcatattctactcatattcttaaccattcaataaataaacgatatggtttatgtaaaatggaaatccgtatttttttacacccattttcctggtccagaccttattcactttataatccaggacttgattaaaaaacagaagccactgtatgcaaaatataaatggtttaatataaatttagatgattgtttttaagaactggcggactattagcgagaagtctattaaaaatcagataagctaccgccaaacattaaataagcatacactggaaagctcactttaaagcatcaaggtgatcatatgttgttctcaaagatttactagaaagctcctgtaattcccaggaatttctatgaagttttcacctcttatcttagttattagcaacaaagagtgcttagtgaaaagtgggaaaccactgagaatctcaaatctccatgcgtatgactacatttgatttctccttcttttctgtctttcatatcttggactgggtccccttcattagcaaattaaccttgaataaaacaagaaagacacttctagctaatacagttcctaacatgcagagcagactgggaaaaagatagtgataatgtcaagttgaaaactgataacctgacaatttatttttgctgtacattgctttttcatttttcagttttgaataagctttaggttaacgtgctataactacccacataactgaagacttttcattctttccttgaaagaggagatacaaagtctgatatgccattcacacatctcagtgtgaagttcatttatcttctaatcagttacaaactatgtatccatatatacatatgtggatatagatgtatttataattgaaacattgaaatattggactaagtaatattaatgcatttatattcaatataaggaaaaaggtaaaatggaaaaattaatgtatgcaaatatataaatattaaataaaaataattaaatctataataacagcacattcatgaaactggatacatggccatggatggtatttgcaacttctttcttccactaaccattttatgatcatcttgattttagccaccatcttagcatgccagggagttttacctttcgtggtggctgtgcctttatgcatgaaagactcgtgttattagtggtcctgcctgggttgggtttctgtactttgcattagcttttacttttcaacatgaaaaccaccacattagtcccattatgtatttatagctctctattttgagttatccttgccaagacagtaagcccttcctttacctctggattcaacagcataaaaaactaatgtgactgaaagacaggtgaacaactcagcttccttttcaattgagcctttgttgtttccattggtgaaaacattctgatgtcaagcagagtctgaggtggctggtaaagaggacaggctggcatacgtagtatagattatcttatctacttgattattgagagcctcctatgcatcctgttggtgagtatgcaattaatttgtgcctttacaaaaggtccattctaatatttctactccagaacatgtcactagtgttgttgttttttcctctaaaattcagccaaatcattagtcactgcccatgaaattatgtagatatgtgtctctggccatttctttcagacagtgaacactcaaaattaatgtttaaagttctgctgactgggaggattacttatactattacctcctagggccactgccgaatgaataaggcaacagtttagtaaatacacacgcatcagtcacagtgatgactatcaataagtaaccacaaatgcttctttgggtaaaatcattctcactactattccaatcatgctatagtaacaaagcttatcttgtttctgaaggtgaagtattgtcattgttctttgcttctcaaagactctattattccccactggattcaggaagctgttttcaatggtggcatcttacactgtaatttgtggcctaaacataattgtttttaataacgtaggtactctttttatctctgtaaagagaagct

SEQ ID NO: 310 - DNA, 18012 bp, Homo sapiens
gtgccatcctcttctttctacttaaagatgcactttttaaaacggcaatgtatttgtccttctcttcttccaaatctcaaaaatactcagtgaattctaataaataatagattaagttttctgtgattattttagccagttcattagggaattggggtcttgcagaagtatataaattttttaattgtttaacttgactcacatttttattagaatttgtttatattttaatcaaggcttttcattctgctgcattttgtggggcataattatgttttcataaggacatatatgatacaacatatgaattaataactaaacaggagacttagacttacttccaaatcctttttgaggataaaaaaataatgggaaagagcatcacttctagctgtagaacagcaagcaaaaaaactagaaagtttgcagattcacaacttttcatggagtcatcagagaactaaggtcgtagggcaaccagctaacctgaaacttaggaggagacatgagcacttgttttcctggagcagatactgccagatagcagtaagaatttagctgaatttttaagtcgaattggtaaagccagttgtgcactagaaagataatatagcaaccctattgactgcagatatgaggggaatttgcactgcagtcttttctccatagacttcaatgtatactcaatatctataatatttatagatattatacaatttattttgtaaatcaaaaaaaaaaaaaaaagatcgtctacagccctctgaaagcatctcttctgatacaggcatagcataagaagtacaggaatcactccgagaaaggcaggaatcatcacctggatccttctccccttccccctacagaagaaaagccttaaactgctaagtgtaggacagctattgtctgaaaaacagtgtaaaaggaagacctaaagttgagagtggagcagatactgagaaaagaaatggctatccatgtattacccatcctcaacacaagagaatactagaggaatttgaagcctgtgatgccaggtaactttggtaacaacaaatcccaaacctagcttaactcctgagtagaatgattcaaaccgcagatctagcagaaggacagtcattctcatttaaagacataaacactatttactcattctttaatgtcctacgcaagatatttagttttaaacaaaatgtacaagacgtgtacaatggcaagaaaaaaatgggcacactgccaaaataaaaagaattttataaaagcaaagatatgacttacataataaaactgtgagacagaaaagttttaattactgtcattaatattttaaagactcaaatggaaaaagtgaacaatatacacatcacataggtaattttagcaggcagctggaaagcataagaaagagtcagatggaaatactagaactgaaaaacatagcaacaaaagtgaagaatgcatttgataggctcatcaatatggttggtacacctgaggacagaattattatacttgaaaacgggtaaattgagagctgaggtagaatagtgtatttgcaatcttctgggaagtagtcttaaatatgtgtacttgtaatcccagatggagaaacagagaacaggaccaaagaaatatttaaggaaataatggcaaataattctctgaaattaatgacaaagaaattaaggaggatttaatgagaaaaaaatcaatgagagacaccaaaacaaattgaagaagctcagagaacgatacacacataaacacatgtataaaaaggaacccatattcaaattgctaaacaccgaagttaaaaagaaaatttggaagacatcccaagaaaaagacatattatgtacagtggacttgttatcagaaacaaggcaagtcagaagacaaaagggtgacatcttgaaagtgatgaaagaaaacaactctcaactccgaattttataaccactgaaagttatcatgatgaaggagaaatgaagatgttgtttgacatataaaaatggggagaatttattgtcagcagagcttctatataagaaatattaaaggaggttctttagggatatggaatgtaataccagagttaaacttggttattgatatggtttggttctgtgtccccaccgaaatctcacatcaaattgtaattgccacatgtcaggggagggacctggttggcagttattggatcatgggtgcagatttcccccttgctgttctcatgatggtgagtgagttctcatgacatctggcttttaaaatttgtagcactcccaccttcacttgccctctctcctgctcttctgtggaaagatgtaccttgtttccccttcaccttctgccatgattataagtttcctgaggcctcctagtcatgcttcctgtcaagcctgtggaactgtgtgtcaattaaccctcttttcttcataaattacccagtctcagttagttctttacagcagtgtgaaaacagactagtatagctatacagaaagaagtgaagggcgctgaaaataaaatgaatgaaggtaaaaataaaacatgtttctcatatttttagttgctctagaagataactgaccacttattaaaaagtaatagcaatgcgatatttatttatcttacatgtaaaaataaaatatgtgacaaaatactacagatgttgtgtaggagaagtattgggatatagtgttacaacattcttataatacatattaaacaatataacatttgggagttgactaaagatatgtaacttaaactagggtaagtattagacacattttgaaaaattatgtattgtaagtgaataccagaggtaatatggtatcataaaatatatttaatcaaaaaaagagaagaagaggaaaaaaataaacaacatatggaacaagtagagaacagacagaaagatggtagatttttaatttaacagtgttaataattacattaaatgaaaatagtctaaacacattaatttaaaaactgaatgacagattgggtaacaagagcaagatccaaatatatactgtgtacaagaaacccacttaatgtgtatggatatatatagaaaagtaaaagaatagagaaagacagattatggaagcatcaaccaaaaaaactagaattgctatattaatatcattagactttaaataacatatattaacaaggttaaacatgaacattaaataatgacaaagaaatcaattttccaagaagacaccttcagtcccaaaaaactatttaaatatatatgtacttaacaacataaattcaaaatatataaggtgaaaatgaatagacttgaaaggataaatagataaatccataattatattggaaggctgtaacagtcctttctcactaattaataaaacaaccaaataggaaatgagtaagtataaagaagacctgagcaacacaataagcacgatcagccaatttgatctaatttatatttatataacagtctaagcaacaatgcagctaaagcaactcttcaaggaaaactttatagatttgatgcttatataatatcagaacagaaaaaaactaaaattcatgatctaatctaccatcctaagatactataaaagtaagtgcaaattaaatccaggacaagcagaaggaaaaactaataaatatagaagcagcaatcaaataaattggaaacagactaatcaagagaatgaatgaaattaaaagctggtatttgaaaaaaggcattaaaatataataaacctatttttgaaagatatacaacacgaactttcactaaaaatataggttatgtgagtagtcctgtttgtatttaaaaatcacttaatgaagaagcctgtaggctcagatagattaactagtgaagtctattaaccttttaagaaaaaaataatataaattctacccagtcacttcccgaaaggagaagtagcactttcgatttatctaatactgaaaccagccacagacatcaccaagaaaagaaattgccaaccaacacaccaatacctctcatgaatatagatacaagaatcttcaataaaattttaagaaaaatcatctagtagcatattaaaaggatattatattatgagaaaattgtatttatccagaaaatccaaaattgatttaacattagaaaatcaatgtaattaatcatattaataaagaagaaaattcatatgatgatctcataaatgcagaaaaagcatttgacaaaattcaacatctattcctgttaaacttctcaaaatactaaaaaataggaagataattcgttaaccttaaataagacacttattatagaaataactggcatcatatttattagtggaaagctcagtgcttttccactaagatcagaaacaaggtatatgaacctacatttcctttttttttttttttttttttacattgtccttgtggcatgcaaccttactaaaatcacgtatttgttttaggatttgttttatagattgttggggattttctacatagaaaccattactgtatgtaaatagatattgggtgcgaaagatacagtcacagaacaaacctataccattattattaattaattttcttaaaaaggtgcagaaaattcaatagagaaatgtattttcaatgaattgtgcagaaagcaattagagatctatatctaaaaaatgaacatagacccatgattcacaccttatataaaggttaaatcaaaatgtattataagtctgaatgtaaagcaacatgtaaaacttttgaagaaatacaatatttgtaacttggagttcaacaaattcttagatatgataccaaagtcatcatccataaaagaaaatataaatatatttaactttaagaatataaatttttgctcttgagaagacattattaagacaatgggaagcaaaccacagactgggagaacatattttcaagtcaattaattgacaaaggatttatattcagaatatataaagaactcatacaactcaataataattaaaaactatctaattaaaacaaatgaataaaaaattaacaggtacttcaccaaaaaaagacatatgaatggcaaataagcacatgaaaatatgctcaacctcattatctgttaggaaatggaaatttaaaacaaaatgagataccactacacacctattattataactttataaaaactgaaaggggccgagcgtggtggcttacgcctgtaatcccagcactttgggatgctgaggcggttggatcatgaggtcaggagttggagaccagcctggccaatatagtgaaaccccatctctactaaaaatacaaaaaattagccaggcatggtggcaggtgcctgtaatcccagctactcgggaggctgaggcaagagaatctcttgaacccggggggtggaggttgcagtgagctgagattgtgccattgcactccagctctggcgacagagcaggactccatctcaaaaaaacaagcaaacaaacaaacaaaaaaaaccctgagtgctggggagaacctggagtgactggagccctcagacattgctggagagaatgcaaatggctgtcatgacactttgggaaacggtttggtagtttcttataaagttaaacttactttatgactcagccatcacactacaaggtatatactcaagagaaatgaaaacttaggttcacacaaaatcttatacgtaaatattatagcagctttatttataatcaccaaaaattggaagcaattaacatgcattcaaccagtgaatgcataaacaaatggtggtataaccttaaaatggacactcagccctaaaaactaaatgaactattgatatacacacacagggtaacaaactacatttttccatttatatgacatattggaaaatatcatgtaaataaaatgttttgaacaaaattagagtcagtaggtgcagttttggtttcacttggctttctatttattattatttgtataaatttaaggcatacaagagcaattttgttacatggatatattgcataatggtaaagtctgagcttttagtataaccatcacttgaatagtgtacgtcgtactcattaaataatttctcatccttcactaccctgtcacactcccatcctttcaagcttttccactgtccattatccacactctgtgtccatttattaatgtacacattgtttagttccgacttataagtgagaaaatgtggtatttggctttctgtttctgagttatttcacttaagataatggcttctagttcatctgtgttgatacaaaagatatgatttcagtctttttatggctgaatagtagtccattgaaaaaatgctcaacaccgctaatcacagataactgcaagttaaaaccgtcgtgaggtatcatcttacaccagtcaaaatggctattattaaaaagtcaaaaaataacagaagttagcaaagataaggaggaaatggaatacttatacacgtttagtgggaatgtaaattagtacaatgtctatggaaaaaaatatgatgctgtctcagagaactaaaaatagaactaccatttgatcaagaaacccactactgggtatattcacttgtatatttatcacagcactattcacaatagtaaagatatggagtcaactaagtgtttatcaatgaatgattggataaagtaaatgtgaagtatatatacacacacacatagacacacttggatttcttattgctcatctcgtctcttatggtatgtgcgtttgtatgtttgtgtgatgcttttattagtaagcattttacattaaaatattatttgccatataaatgaatgcgaataacctgtagcttaattatttttatgtggtataagtatttattagaaatcaaatggacgttgaaatttagtatcatatagaactttaaattaaccccggaagtaagttatatttcctccacactcgttaatgtcactgcaagttgtttctccatcacagaatataaatgggagtatatagcaaatgtctagcatgctatgtacaataaataatgtatgattaattagtcattttttaagtggaaaattattttaaagtagtttgaactatgatttaatttttaaatacacttaaacagtatgttagattagcaaaggcagaaatattttcatcactttgttatttattgatgcctagaccaatgtttggaacatagtagacctctgattaatatttgttgaattatttattgaatacatttggaataataatacatcataactaaatataacaaaaccatttttctaaggtatactttaggaaaatctagaataaatatgaattttggggttgtagcattgttatattatgaatatggattgaacactcattaataggagagagaggaataaagaataaataatctttgagatgaagatatttccatgtctaatattgtaggtaacaaaaatgatagacttatatcttttagaaagagttacctggctttctattatgtactgcttttctgatgatttcattgctttagtatttttaacttgtttctaataagagctgattggttatttctccccttagtatatataaatgtagctattctaaataatcatttattaacacaaattaaatttttatttcatttattgatacagtttgccagcgattagtgtccgagttaagaaatactgttatagcaacagcaatttccctagaggacttcttaaatcataaagtgagagtatttcaaattatatttgcttcacttaaatgtatctgttctgaaaatggcaacattgatcccatgatatacctgatatattctaattgcctagaacgtaaaccacaaattctgcattgcagatactatcacagtaaatgctgcttaacttatgcaaaatttatagaatgatgacaaaacaaaagcttctgagaggataagtgtttcaccacaagcggtttctgtatctgactccatttctaaactgtaaatcagccttaaattatcattgagtcctatgatagacactagtaatggtaagaaaatatgccattttaagctatattcttattgacctgtatgtttatatgagtgtgaatatgtgtgtacctgtgtgtacatgtttatgtatgcacaccttttttacacgttattttttaactaaaatattttttctttactttactttactttacaccatcatgcattgttactttgacctctacaacctaacaaatatctgccctctaatccaatgggaaggaacaaaatcctgtaagagtgtaggaaacctgaggatggtctacaaggttggctgcccattggaaacacttgtggaattttaaagagatatcgatatctttgttccacccaaggaattctgattaaaaatttattgtatgtacattggatatctgtatttaaaaaaaatctccccaagtgatcctaatatgcagtaaaatctgaaaatccttcctctagaaaacaaaaataaaagtgcctaataaacaatgattactgtgtattctgaaaccagaaacaaccattttcttaaccttttatggtttaaaaaagtatggtaggaaagttattttaaaaggaattaaaggtgattttatgtgacatatgtttatttttttaatgcaatcttcattataatggttttgaattaaggtataacctgtttttcttgtggagtgtatgcaatagaaaatcacccaacttaagagtcagaaaacatgagtgtgtgtggtggttctgccacttcttaaatatattgccttggctgggttctcctataagacttactttcttattgcccatggtagtacaattgttatagcatttcaaaaattaaatggtgtgtttataataaaggctatatataacaaacccaaagctaacatgggtttcccatactgaacaggcaaaagttgaaagcattccctctaaacactggaactagacaaggatgcctcctttcaccattcttactcaacatagcactggaagtcctagccagagcacttaggcaacagaaagaaataaaggtatccaaactgggaaagaggaagtcaaattgtacctttttgcacatgacatgatattagatacagaaaaacataaagactcaaccaagaaactcttggaactgataaatgaattcagtaaagttgtaggatacaaaatcaacatataaaaatcattatcattcatatatatcaacaatgaattagctggaaaagaagtcaagaaagtaatcttttttataaaagccacagcaaaaaattacatacctaagattacattttaccaaggaggtgaaagatctctacaattaaaagtataaaacactggtgaaagaggacataaaaatattgtaagatgactaggcacagtggctcatgcctgtaacctcagcactttgggaagctgatgcaggaagactgcttgagcctgggagttcaagacccacaacatagcaagggacaactctacaaattttttttaaaattagtcaggcctggtgtcatgcacctgtagtctcagccactgaggtggcaggattgcttgaacccgggaggttgatactgcagtgagccatatttgtgccacctcactacagcctgataataagaaaagaaagaaaaaatagtaagacaacccacgctcatggattgaaagaattaatattgttacaatgaccatactacccaaagcaatctcaggttcagtgcaatccctattaaaatttcaatgacatttttcacagaattagaaaaaatattaacatttgaattgaaccacaaaacactttgaatggccaatgccaagcaaaaataacaaagtcagagatatcacattacctgaattcaaaatatatgacaaagggataagtaaccaagcagcatgatattggtataaaaacagacacatagaccaatagaacagaatagaaaactcagatataaattcatgcatttatagccaactgaattacaagaaaggtgccaagaatgtgcgctggggaatgggtacccttttcaataaaagctaggaaaactggatatatgcatgcaagacaacgtaagtagactcctgccacttgtcaaatacaaatatcaactcaaaatgtattaaatatttaaatgtaaggcctgaaaatataaaatcactagaagaaaacataggagtaatgcttcaagacatgagtccaggcaaagattttatgggtaggactatgaaagcataggcatcaaaacaaaaatcagcaaaagggacattataagctaaaaaccttctgtacagcaaaggaaaaaaccgagtcaagacacaacctgcagaataggagaaaatatttgcaaattattagtccaagaagggattaatatccagaatatataaggaactcaaacaactcaatatttcccaaacaaatgattctattaaaaatggacaaaaaaatctgagtagacatttctcaatagaagacatacagatggccaataggcatatgaataaatgttcagcatcactcatcatcaaggaaatgcaaatcaaaaccacaatgaggtatcacctaacctcagttagaatagctattctcaaaaagacaaataataacaaaggctgctgaggatgcagagaaaaatgaagttttatactccattggtgggaacatcaattagtacagccattatggaaaacagtatggaagttcctcaaaaaaactaaaaatagaactaccatatgatccagtaatcccactaatggatatttatccaaatgaaaataaatcagtagatcaaagagttatctttacctccatgcttattgcagcactattcacaatagtcaagatatagaatcaacgtaagtactcctcaacagataaatggatcaagaaaaatgtggtatgtatacacaatggaatattattcagccattaaaagaaggaaatcaggtcgtctgcagctacatgagtgaacctggaagaccttatgttaaattaaatgaatcaggcacaaaaagataagtactgcatgttctcactcaagtggaagctaaaaaaacaaaaatgagtttatagaaatagagagtagaattacagttgttagaagctgggatgggtagcagggaggagaggagagggagaagttacctaatggatgcagaattacaactagatgggaggaaaaagttctagtgttctgtagcactgtagggtgaatatacctaacaataatttattgtatatgttaaaaatactagaagagaggattttaaatgcctcctacaaaaagaaatgagaaatatttgaggtgatggatatgctaattaccctaatttggtcattacacattgtatacatgtatagggatattgtatgctccatatatatgtacaattattatgtgtcaactaaaaacaaaagaaaaaagtgtctataattattcaggtataattttacactgttatctgtagcttactctggcctcttatgttgacaaactgtgttttttaagttcactttactgaatgacatatttactgttaactcatttcatgtagtttttattaaataattattcaatgcctactacatatctgtcagacacttgataagtgttgaatgcacagtgtcacgtgagacatggttcctgtctccagtgagttattgtccaatgcagaagaaagatacacacacacatgcacatgtgtattttggaggatagggtgaactaaaagtccaggattgcataagtaaaatgtgaaaatgctcaaatcaagaaggtcattgtgagttctttaaagcccaaaccaaatgtgttcaaatctaagtcatctttctgatgtatcttaggcattgaagttttggtgcactgagtagaatacatcgtgattatgaaatgttttcattgggacgtagtataaattaattgataatggtaaagactttgaaatcatattgtcttggttcaattttttcccctcaacacatcagctgtatgattatggataggtttttaacctttgggtttcactgtcctcatatgtaaagtaagcaaatagtgctaatacttcttggacttgttatgagaatgaataggtaatacctacaaaatgttttgagtgttgtccttacacatagggattagacaatatccactattattttaaagttactttaatgatattgcttatttgggaagcagattttttttgccttttctatatcagaatggttagttgaaaatattttacttttaaaataattattgaactgggaaaatgatttcatcagcaagatacagaaaaaagttggcaaaggtaaaaatacttttatttttcatcaaaatattaatatattatttttctgatttatggctcagacctattcattattattccttagatgctcgaatcctccatacaatgtggtacttttaaagagaacatctgtttttgtacaaagtgttgctatgaaacttcagtaggaaaacatagcaaacacatatacaaagtttagtactgcagctaaggcatgggattatattggtttggtttgttcattaaaaaaaggaaacaattattagctaaaccacacatttcagatgaataaggataagaaattcagggattatattgttctttggtaaaaaatctttgttttatagatttcagtgccttgaaggctcataggaaatgtagcttcttttatgtctaaatgtgttttgttatagaaattactcaagctatcttaaatgaagacctcaattgaagtttttagactatattattttgcttgtattccacaataactgtgttattacttccaatctttgattctgagaaatctggcctttattttttagagagagaaaatctcttgagagttttgagattagtgtagaaatatgcaattttttattccttctaaatttcacgcttttatattagaagatgttctgtgaggtttttttctggacagatattaagacagaatcaatcaaaaccaacgtaaacacactgttaaattcacacacaagaaaagaggtgtgtcatcaattaatttacataaattatctagctggctttgaaacctattgacatgtgagaagttcagagttccttcagcatagggcattctgttaagaatatacatgtttaaacagacaaaagaatttatatagataccatagacattttctgtaatgatatgaagtataatttgtatttactttcttcaaatatgggaatctctaatgtctttcaaaattaccatgatgttgaagacaatgtttatagtgatctcatatacaagtatagattttactgctctagtgatatcatttacaagtatagattttactgctctttcttctttgtttctgtgcaatctgttacaccaaccaaaaataagattgaaccgagatatgatttttagtaaacttggtgcttagtaaatttatttagatacttagtaaattaactaaaattaatttaggtgtttagtatatttattgaatgaaatctagcctaatatttataactggaatgttttataattgatttataaaaatcacaagtgatgttctttttatacagtatctatgtctttatcaagtcatagagattatatacttagtataaagagcaacatcaagattttgatggctggaaagaacactagaggaggacccctgaatatccattttcacttaacttatctgagtctgttaccttgagcataaaacggaaacgatgacattaccccagtaattatagttttgtgtttttccccagtcaccttagaaatatgtgctaagtacctcattatgtgctgctcataattttaaatactgtactgaggatttgctccctactttcaaagaaataccttatagtcagtgggggaaaaaaaactagcagacttttactacaaggtaatatgttatgacattataatttggttttatttgttggtcgcagcttaaatatcacctcttcagaggaatttcctgatcacccagtctaaagcagccttccagacaatatcataatcttttttaaagtgcacagcactatctaaattttctttcttatttgttcattatttttctgtctcccctcaaataaaatgtcagtcttatggctgcagatactatgttattcttttcacttctttaccctagtccttatcattatgcatatatatatatatatatatatatatattaggttttcattaatatttattgaataaatgaatgaaaggaaacttaaaaatacttgtgccatggcagcatagataaagagactttattaatttaaataattttttttctactatgttccagagacatactgtttgccccggggaatactttgttaatcttagtctggcgggaaggcattgatcagctttataattgcaaacaattgtaagtgctatggagaaatagtgaagggtggcatatgactatgttgaagaataaggtatttccctaatatgggagattagaagccttttgaggaagtttcacttgagctgaaatttgaactgtttgaactaaccaagtaaaagcaatgagaacatcatatgcaaaggccctgtgatgatgacagcagtagtctttgaagaaagtgaaagaaaaccagtatggattaactgtaatgggtgagcacttggtagagtgggagagatataactgaaatgctggacacagaacttgtaagtcactgtgctggtccatattagtagttgatatcggaaagcaaaatgtatacaggagaaacagtgtaaataaagcaaaagagtaaaaaaaagttagggatgcatacagtgtttgtcctttgacataactgggttactctgaaatatcaacattttcaaaatctcttctgtcaacactactataaggacttttatatatatatatatatatatatatatatatatatatatatacacacatgtatacataaaaacatgtattgcaaatagaaataaggtctctatttaaaaatctaacagttatttgctaatcacttatttttatacatataggcattagagaaaaaataaatattcatcaaagtgaattaaaaacaagtttacagtataatcagtagagaataggtcacattaaatacaaaatgtataattaagtcaaaatattcattgaatgtctgacttgcataggaagagacacaaggtctagtactattttcaaaaaatcagctgagacataaaacatacatgtgacaagcatcataacaaacatgtgacctacacaaatataaaaggaaatagctgagtaagagctaggcttggccaggtgcagtggcttatgcctataaccccagcacattaagaggcccaggttggtagacgggggcaaaacccagtctctacaaaaaattcaaaaattagctgggtgtggtggtggtggcatgtgcctgtagtcccagctactcacaaggctgaggcagaatatcacttgaacccagaaggcagaggttgcagtgagcagagatggcaccactgcactccagcctgggtgacagagttagactctgtctcaaaaaaataaaaaataaaaaataaaaaaatataagatttgggcttagtaaatatagaaggctttgtaggggatcaagtttgaattgcattttgagaaaagaagatgatgaatattaataaacacgtgaagtgaatgggagagaggctagtaatcaaaggcatgaagcccaagccatagaagtaagaactaatgaaatgtgtgaaattaacagatattaattttatggaaagataaagctcaagagtagaaaccttgattaaaaagatacctcgtcaattatctgaaggataagggaagaaagagcatttcagatggaggcactccctgtgtgaaagcttggatcattcagtgtcagtcatgtagcaagatgatgttagcttggagatgtagctatggtagaggctgaccactactaaaggagctaggtcattataggcctggtcatcttgctatagagctgtagtctggtgcattgaaaaagtactgagtgaaacagaagggagctaggacatgattacagagggctgggagggagatgatgaatataaaggaaaagggaagtgaggagagaaactagatgttagaggtatttagtcaattcagtaggatttaatgatttattgcagacagaatgaaggggaaggagaatgaaggataattcttatgtctgtttagctaattgaacacttaaggggaaccctgggccaacaaggtttttctttttttaatttttatttttttagaagagatagtgaattaaatgttatttgcatttaatcctaggtaattgagatacacaggatgagatatctagagggtagatagtcaggtccagccttggtgttacccatttggaagccatagcatcgtaatggattagattttagctgggcctaggaggatgaggtgtgttattggtcagtaccagggaaaaacagagggcttctgagctgcatggtgacatgtccatggagtaaggagaagacaggtatcactgaactcagcatgtgctggaataatatgtgataaggatgaatcatggatcagtaaggtgaggcaaatttatagatggaagtaacagaataagaggtgctacactttttaattgaagcaacttttagaaaaggaagatgaaattacacaatgaatgaactgcttaaggatgaataattgggtagacattggaagacaggactttatttcagtcaagtcatgtgaattgtggttactgtggttggaagatataggagaggtacataatagctgtcatataagagacaaagaataagagtaacatggaaatgtatgctcaaatgagacagatcaataattgtattcatgatttactgacacgaaatgctctttattgcctgtatcccaggtcttaccttgtttccagttagctgtgatttcaaagaagatactcctttgtgacccttgcttcagtcatctttccatttctttcttttctctttgtttctgctaacctgctgaggaggctgacagctctggacgcaagtgtttttgcttcaggagtagatgggagaaaagcatgtcctgtagttataatgctgctttttcctaggcagggagaagcagcccctaaattctagagaaaaatactgccttagttcaatgtagcagttctgatattcctgtgagtttaagaaaaaacaaacaaacccttcctccgctcaccaaacgaagcaataacaaaccaacaaaccagaaaccttaaagcagaggaaatccagattgtacttactcttcttctcactcacaaagaaaaggattcaccacatttttactgtcatggcattattgccgttaaagtctttttctttctctgtctagtaagtcttttttttcctgttcaatacagtttttttttgcttgttcattttttttccgatctagtggagagaacattgcaggattatgaataagaccctgagctggatgtcgtggctcatgcctgtaattccagtgttttgggaggatgaggcaggaggatcacttgagaccaggagttggagaccagcctgggcaaaatagtgagaccccatctctaccaaaaataaaaaaataaaaataaaaaaagaagaagatgggcatggtcatacatgcctgtagtcctagctacttgggaggctgaagcaggaggattgctgtagccaaagagtttgaggtttcagggagccctgatcatgccaccgagtacagtctagatgacagagcaagactttaaaaaattaaaattgaaaaaaggaccctgataaccatttgtagatacaaacacatttcaagttgggtctggtgggccgttttcctttagggttcaccacttgtggtgccatgttgcaaagacacagtgctatttatcatgtagctatctta

SEQ ID NO: 311 - DNA, 3947 bp, Homo sapiens
ttattggagaacagtaaacagtttgatgttgatgaagattaaggtaggtatgggaaacgcagtggagctggtggcagggtagttggggacacaggatttgcagctgcaaagacaggaaacttagaggtctgtgaaggttcacgtgtgccatgtaagagcctgagtctgcatcaggaagcacttgaggaggccctgaaggacttgcaacaacaaagaatgactttgcgctttggctgtgattcagtcaaagctttaatggcaagaccatggaatatcttttggaaatggtgtcataaagcttgattttattatgttgaaggatctctgagtaaagctgaatttgtcatttggaaatatgaattaactttatcatattcttcttgcatcttgttgatgtttgccgttgtgagcttcaagaactgaattgaaaaaaaaatgcaatagaccagagctctggccgggcaaggtggctcacgcctgtaatcccagcactttgggaggccgagacaggcggatcacgaggtcaggagattgagaccatcctggctaacacggtgaaaccccgtctctactaaaaatacaaaaaattagccgggcatggtggcgggcacctgtagtcccagctactctggaggctgaggcaggagaatggcgtgaaccctggaggcggagtttgcagtgagctgagatggcgccactgcagtccagcctgggcgacaaagcgagactccgtctcaaaaaaaaaaaaaaaaaaaaaaaaaaaaaaaaaaaaaagccagagctctattttatgagatcactctgtcacttgtatacaataaattttgtataagaccatatcgatctatgtatctatcacaaggaatagtgtaggttctaaacactttgatcaataaaacaagtagttttatatatgcatataaaaaggaagaaataaaacatattaatcaagcatagactataaaaacttctccacagggttcatttttctttgaaacaaactactagatgttttaggaaatctaatttcatgtgaagttttgctgcattttagttccatgaggaaaatttttcattcatactttttcagtgtcatttgataacaatacaaactagttcatatattcttttagagaatgtacttcacaatttgatttggttgcaatgttcataatatgctaccaaaaaattagtatcccttttaataaataagttgaagttaaaggaaatacccagtattgctgcacctgcctcaatcccatttctttacatgaaccggcctcatctgtgcactaataataaagctgaaccatggacatgccactgcagttggcctcccatagctctgcactacctgtttctgttctgggacagtttataagattatgccaagactggtttcccccaaacttgtctttgagtctcaggtagataaaacaggtatttacttttcagaaaagtaaagtccatagctatttattgaatgcttgctaatattgttaggcacagttctaggtgctgttcatgcattgtcacatgtaaggctcacagccaatgaggtaggtacttttattactcccagattacaaaggagaaatttgaggctcagacaggtgaaataacttctcaaagtcacccacagaagaagcagttgtatacaatgagcttgaattgaatgcaagttagtcaggctccatagctcataacttgccaacaccacattcttcttatactgtggtcaatactatgagaaatgtttcccacactacataagtttcttcaatgtacctcctagggttagtactttcaatgtgcctcccacttagggtacctagtcagtgtcctcactgtctttcagctctgtctactgaaatttagcctctccttggtttctgtggaatttggcaagtccagtgcagtgtctaactgggaccatctccttttggcagcatcaagttaggcttactgttagtatcctccaaacttgttgctctggtttgctggcagctggagtctagctttgacagttactcagaaatggagcattggccttttttctctagtgactcggtagttctttgaagaaagtcatgggaagaatatgagctttacactacaatgacctgaatgcaaacatcaactcagccatttattgttgtgcagcttttgtcaagtgatttgacctctttgagcctcagtttatcatctatataatggatattaaaatatatacatcattaggctttttgtcaatttaaattaaataatagaatctctctatattcatggaacccctgtatagttagcactcaatgaacctgccttgttacaactttaaaaaaattatattcacttaaaaaaatggggtataactgaggtttacatatgaagttatgggatacatatagatagtaaaatggttattacagtgaagcagactaacatatccatcacctcacatagttacgtgtgtgtggtgtgacaggagcagctaaaatctaggtatttaagaaagatccctaatacaatacaaatttattaatagtcctcatgttgtatattacatctctagacttgttcatcctacacatctgctactttgtattcgttggtatctccccattttctctcctccaccctgggccctgttagccctagattttttctgcaagtttgacctttttattttaatttcacatgtaattgagatcatgcaacattttttctttcagtgtctggcttatttcacttagcataatgccctctgggtccatccatgttgtggcggatggcaagatatcctttattcttgctgaataatattccattgtgtaggatgggtatatatatgccacatttcctttatccagttgactttggtcgtttccatatcttggctattgtgaacaatgctgcagtgaacatgggaatgaagatatctttacaaggtggtgatttcatctccttcagatatatatcaagaagatggattgctgggtcatatggtaatctatttttaacatatttaggaaccatcatactgacttccataatagctacaccaatcaacattttcaccaacagtgtataagggttttcttctctctacccccaccaccgtttgctatcacttgtctcattgataagagccatattaatgggtgtgaggtgatatttttatagtggttttcatttgcatatccctgatgattaaacatacattttcatatacctgttggcatttttatatcttctttggagaaatttctgttcaggtcttttgcacattttttaattgggttgtttttctgctattgagttgtgagggttttaaattttgaatatcaatcccttatcagatatgtgggttacaaatatttttcccactccacaggttgccttttaattttgttttttcctttgccagacagatagatgccttttagtttgatgtagtcctttttttttttttttttttttttttttttttttttttttgctgttgtagctgagcttttggtgtgatatctaaaaaatcttggccatggccatgtcagtttttcctctacgttcccttctaagacttttatggtttcagatcttacatttaagtcctttgttcattttgagttattctttctggatggtgtgaaatggtggttcaatctcactttttttttttttgaatgtggaaactcacttctgcaagcaccgtttatcgaagagaccacccttttccccattgtgttctcttggtgcccttgttgaaaattagctgatcataaatgtttggatttatttctaggttctcttctattccaccggtcgatgtttctgtttatctgccagacatcatacttcgtgattttaaattataatttgtaaccttagtttctcacagcagttctctctactgcttcttcatgtcagggttcttctactcgaat

SEQ ID NO: 312 - DNA, 1886 bp, Homo sapiens
tgacatacataacaaactttataatcaactgcatagttttgactgttaaaggtaaaaaggagctttatctcaattttttattatttcatatattttaattacaatagctgtataataaacattcatgtggcttaacatttttccatattcttacatagacataattattttaatacgagagttgtattttgtcaaccagatataactttgatttgcttaagcattctttttgttttgttttgtttttgtttttgggggggtggttttttgagatgtggtctcgctctgtcacccaggctggagaacagtggtgccatctcggctcactgcaacctccacctcccgggttcaagtgatactcctgcctcagcctcccaagtagctgggattacaggcacccaccacaactggccagctaattttttggtgtttttagtagagacagggtatcaccatcttggccacgctggtgttgaactcctggcctcaagtgatctgcccacctcggcctccaaaattgctgggattataggcatgagccacagtggccacttaagcattgtttattgaataaaaataatttcccttttaagttatgctgcaatatgtattcttgtgcatgaaattgtaagctttggcatgcattagggtattctttcttcaggtactttgattttagagagacagaactattagacttactagacatctattaggggaagaatttaactgaaataattattatcattgaaatgccaggggtttggtctaaggcccattgcttgcctcacagaagtccaatccctgagacaatgagtattgccagggaagaaggctttaactgggtgctgcaaccagggagacaagagagcagtctcaaatccatatcctcaattgactaaaattagaggtttatatagcagcaaaaaaaatgtaattatgtgtagggaaaacaggaattagtgaggggtattaaagaggagctggtcaacaggaagcagttggttggtttaggcagtcatgatgggtgagggggtctggtgtctcactgtccagatgcagtgatctggtaagtttcagttccttcaaaatgtctgggtggcctgatagttgatttcctaagaaaggaacttggataagacaaatacaattttctcaagttttaagactgagagggtgaatttctatgtttatataaaaaaatcataaatatcagttctatgggacagttgagccagtgtcattatgatcttccatctaatatctatttaaaatttaaaacatgatttctctaaagagtgaatttaatactataatgcaatagacttactatgaataaaagacagatttttttatacttaaattcagggtgcatgtacagatttgttacatgagtaaacttgtgtcaaggaggtttgttgtacagattattttatcacctgggtattaaccctagtacccattagttatttttcctgatactctttctcctcccaccctccatcctccaatagactacagtgtgtattgttcccctctatgtgtccacatgtcctcatgagttaactcccacttataagtgagagcacgtggtatgtggttttctgttcctgtattagtttgctaaggataatggcttccagctccatccatgtccctgcaaaggacatgatctcgttcttttttatggctgcatagtattccatggtgtatatataccacatttgctttatctagtctatcattgatggacatttagctggattccatgaaaagacagcttatttaaaaaaaataggagcccataaattttatcatttacctattaatgaaacctgcaaacctggaattaattaaaatactcttttgttggtactcattatgca

SEQ ID NO: 313 - DNA, 3160 bp, Homo sapiens
tgagaatctaagggcataagttagataaccgtgacacctgttttaaattagccttcagaagcctccgacagctgagaaattatttaacagggaaagaattgagttcatgaataaatattaatattaaatcaccacttccctagatttaagaggaagggtgggggactcaccaatagatggaggcagcaggtgtcctggagatgccactgtgcagggctcagagaagccagctgtggggtgggactacggagccaccgaccattggtcacctcgttcctgtccaagccgagaggggactctgtccatcagggaggctggcaggtggcagaggcaacatccaagcagctcacggcaactcaacaggtgctcgtttgagctccaaccttcccaggctgcggtcttagagggagagagactccacctgagagctgcccaaagcatggagcagactcccacccccatccctcagagaggggccactgtcccagcccagcctggccccattgtgactttcatgggtccagcactgttacctccgtgggcccctgcctccatgtaaaaatggtaaaatgtttattttatgaccacattggaataaagatgtattccaaagatgtaatccaggctggatttgtaattctatattcattattattttattcatttttttccctgattttaaaaggaatcaaaatgaaaacatattttgggccctgggcacggtccctactgggcctgatggaggcggcaactctctggctggggtcggggtgacggatgcttgagccagggaagcaggaactggtgaggaggggtcggcttgggggtgagggtctccaggggatggcagagccacccaagggatgtgaggatctggaaactcagatcccatcctttaggtccagatcacagattgaaattaagtaagaatcatcaatttctatgaataacaaaagtaataataatgagtatgaatgaatagcacactctgctttgactgtcctgacccccttggcattcttcaaaagcctccaagcaaaaggaaaagaaactgccaagcacattccaggctcagggccttcgccttagctctcctggcctggcatcctctttcctggtatttgagtgactcgctctcccttcttcttgggtcaccatcctagtgaggttcttcctggcttttggatcgaaatagcccctctactccctttatccactgttcttttcccctccttaattttctccatagcacttcctgcttccttatattccactgcgtgacacatggaaacatagggtataatagaatatacgctgcatgtggcgaggtgtagatgtttaccaggttgtagggactttgtttcattcttctttgtgcacttagcatctagaatagtgcctgccatgcagggtgctcaaaaaaccctgaatgaatgaatgaatgaaacatgtctggcacatacatggcagttacaaccatctttgtgcctagcgctttgggttgctgagccctcagccttcagtgaggaggtattggccttcttccaccattgcagagactgaggcctggacatacaaacaagcatgccccacagtcatacagttaaggtagatcaatagcttccctggataaaacaaagtgtagacaggtccaaggtttgagcaaaaaagtggtttggaaggcgcagttatggaaggatgagggaataagggggctgatgatttcccttcctactccaggttcagcatttcagtttctgtctgcaccagagccttctaggctctttgttggaaactgtggatgtcacactatagctcatacttacttatacagaatttaatatgcacctggcactgttctatgcattttacatatattaactcatttaaggcttatacaaccttgatgagttctgcagtattatccccacttcacagatgcagaaactgaggcaacatgaagttagataactcgtttgatatcacatggtattgtggtaagaggcggatcagggatttgaaatcaagaagaaagacattggagttggggacactggtttaagtgcctgccctgcagaacctaagcagatctgttttcccctgggcctcagtctccccctctgtaaaggagggaactgggccacagtctgtgatccctgcatcgggcagggctgagtgctcccttcttctgcatccaggcttcccaccagggaagggaatgagccctcctccttgctgcctcccctcctcctagtccccggctcagggcctgatgcctgcaggtggtggtggatcctcggtcgtgcggcggatgtgttctggcatcatttaacacctgcctcatatctccgaagccccatcctacacgtagctgtgagcacatagctctgccgaactccaaatagacataagccactgccctgctcggcttcttgtctaattatggctgcgacattgatgtgacagggtgcgtttaattacaggaccatgcacactgacccaaacgctgttttggcccagaattttccagcttgagcagcccaaacgctgtgtgtgatgataataataaggacctttagattgtgctggggattaaatgagataatacatgcttctggcagggagcagggcaccagccagtgacctgtggtcaggtcccagctcctccttccccttcctgctcctgacatggatgcccactctgcctagccatgccctggaaagacacccatcctatcttggctaggcagaatgtcagctctgtcttttttgaatttgtcctccaaggatttgcagaagatgggaacaggggaggccttctgaatatagtgactcttctcccagctcccagaagcacatctggcttggcagcatctttgggccacccaaagccagggtcccttggcccaggcagcatttgggtcagtgtgagggccttcagtaagcacacgttcccatcttgacaccactgccatcactagataagacactgagagggacggcgggctgtgttcattttgtgtctgatgagctctgctataaaatgaggaaagcagttcagagaaattaagcaacttgcccagagttgtccagctaggaatttccagagctgtactcagattcagaactctgggtgactgccctatgccaggcaccccca

SEQ ID NO: 314 - DNA, 2344 bp, Homo sapiens
attgtctccgaagtgagttacaatgaccaaaataacgttctgctttcaagataaagacaggcaatatttcggagttaatttcataaaaccgatcatccaaccattacctccctgtgtcgatgttaactgttgagtctaaaataacttcaactcctgcctcccttggtggccatggaacaggagtgatggaggttggctgtgacatacagctgtgttagatgggaagccactttacctttcccgatgctagaaaaaattattcatggaaacttctagcagcaattctctccccttaaggcacagtaaaaaaaaaaactagaaagtcaactggtttgattgggggtaggggcagagatcagtggatttaagggagttttatggtggtatccttggttgatcatcatggtggacttatagaatagggtcggcctttcctactgcccaggtctggtgttacacaagtggaataatgtgtctgtaagtggtttgtaaattatgaaactctgcccatgtctagactctttttttttttttttttttttttgagacggagtttcgctcttgttacccaggctgcagtgcaatggcacagtctcggctcactgcaacctccgccttccgggttcaagcgattctcctgcctcatccttctgagtagctgggattataagcatgtgtcaccacacccagctaattgcgtatttttagtagagagacggtttctccatgttggccaggctggtcttgaactcccgacctcacgtgatccactttcctcagcctcccagagtcctgggattacgggcatcagcccctgcacctggcctagattcttactattactaatacaattacgactactgtttattcttccccaagcaaaatatgcctgcttggtgtctcttcaccttagaagggtcatttcagatgaatggtgctgatgagtgtgatgagtgtgtttactcacccacccccaccacacacaccccagagagcattgcactgccacaggcatttcagaaaacacagcctcaaagtccacaaaaatgaggcactgatggtgggagcactggacatcattgtctacaggtgataacagaagagtgggagggagattggtgagccaggggtcttcgttgatgattctttgccacctggatctcctgtgaatacagtgggacacaggcaggtggcctcaccttacactgctcattctgttacctgactttgtatttgggattattctggcccaggaagtcatgtagagttgatatctgtgttcacagctgatctcccacctttgattgaacacttcctggggcatgggatctatcccaggcataggacacataaaaagctgctggcttttgaccttggccagagactgtaacagtgatgggaatggcgatgagaatggagatggtattggggttggggatgggatggaaatagaaatgagaattgagttggagatgaggatagagatgtgatagagattaagtgtggggacaggaatagaagtggtgataggaatggaggtgggatagagatgggggaggagatggagttgaagttggtcgtgagatggagacagaaatgaggagagaataggggatggagattgaggatggggagggatggaaatggagctgaatgtgaggatagagacagagatgagaatggagatggagtggagatggggatagaaataggaatggagatgaggatggggaaggggatgtggatgaggatgggatggagatagagatagaggtggagatgggcatggggtaaagataagaatagagaaggagattgagatcgagatggggaggagattgagatggggatggggataaagatgggggaagagatggagatggagatgggagtggggttggggatgggggtagatatgggtttggagatgaagatggggttggggatggtgataaaaacagggaaggagatggagatgaagatggagtggggatgagggtggaaatggggataaagataaggaaggagatgaagatggagatggggatggggatatggatgaattggggaaagggatggggatgaggatgagggtagggatgaggatggggatgggaacggagatgagggatgaggtgggcatggggatgggaatggagatgggggatgaggtggggatggggatgggaatgaagtggaggagcaggtggagagggggagtggggtgggaataggaatataaaaagggaagcctaagtgaaggaaggcttttattgggctatgaaactggcttttattgggctatgcaggcaggaatgccgtacttggtcaagagaagggaaaa

SEQ ID NO: 315 - DNA, 7034 bp, Homo sapiens
aaattaaagcaagaaaccaaatccttttcctgtttactcctacagtttttccctctttccagttccttgtttttatggtttttcctgccttgtgtttctccgttggcttttgttgcaatgtatgcacttggaaaaaatcttctgaatgatcctagtgatggggctttggcctcattgggcgttgtgtgcacgatcgggttgcattgcacactgccggcgcgatgagctcgcactccctaaaaaggcaatcattgtgtccaggaaaactctgctaggttaatggcacatgcccaggggctgaagtcacttggaccaaggtttgtagaacatgctccgtgtggctttcctgttggggcagggggattgggccagaggaatttaggtgtattaacacagcctgccaggtgcaataaatagccacctttgcctgaccttaacctcacctaagcgccatgctcctcaagagccctgggcaccccaggagtaactgaaaacctttggaggagagttacgctggtgttcttgggttagaggcgggtggcaggctggagaattaggttggaaataaaaatgagtcagtgttggtgatgcgttttgtgaaaccggaaagcttagttagaatgatagagaatacataacctgttctcagcaactttgttttaactgacaacaggattttcccagttttcccactaatgtctcttttctgttctaggatccatctgggatccacattgcattttgtcatcagttcaccttggactcctccaatccatgacgatttctcagtatttacttgtcttcccgacctggtgcttttgaagagtagctcttaggtatcttgtagaatttggatttgtctgattagactgaagtcttggatttgggggaagaatcgcacaaaggtgaagcgccctttccctcacatcctacagggacacacggcaccaatgtggcttcttactgaggatgctgacctcgatcaccaggctgaggtggtgtctgcaggtttctcctctataaagttactgcttctccctctccctgctctggaagcaagtcactaggtccagcccacatccagggaagtggacttaggctgcccatcctggcaggaggaggatcaaagaattagtgggcctgaggttagaaccatcaccatcattagtaaatttggagagagatactcagaggctatgcagatatcctgtgtcaccctgacgtattcatccatggataggtcattcttcttttagtgtgagtatcaaaagcaggttattcggtgcaaccagtgaacttgagagcagggactgggaagccctggagttgtcgtggctcagccccgtgcccctggctgtgttccttccctcctcactgccaagatgctgctgagccctggtctcacaaacacctttgagtggtctgctcactgctggggacatggactccgacaccttcctacccctcaccgttcccctctcctccgacttgccaccgccaaagccagcagtgacaaaggaggtgccaggggcagctgctccagcaggagctctctctgtactccggaccctgacatggatgaaaacaagatatgcttgggagataattctgttaactttgtcttcttttgggaggtgtggtggctaaatacttgaatgaaggttttatgatgggtggaaagagtaacaactttcttcatcctaactcaatgtcactcttcatgatgtactcagttattcccttttagaaattatcttaaacaagggtgagcaatggaatgtgagaaagatcaaagaaatgcagagcagactaagaaagatgaaacatctggattgcagagaagggtgacctttccctagaaaatatcaacactaaatctttacaaagccctgtccactgggttctagggagcgctgcaaatggactggtccctaagctctggcctgcttctccactcctgtgagacagttaacttttttcttttccttagctctgttcctcgccgtggggactctggataacaacagacaacaacagagcccgtggtagcagcagcgaaggagttaatatgcaccatgtgtctaagcccttttcattttacttctttgtaaatttttaacatatttatttaaaacataaacatcgatattctgattagttcgcaggaacaattattgtcattagggaagatggaaatttactagctattttcctcctttcatttttaaaaaaaaatatatatgtattacatttttttcttcaacttttattttaagttcaggcatacatatgcaggctgtgcaggtttgttgcacaggtaaatgtgtgccaaggggatttgctgcacagatcatcctatcttccaggtattaagcccagcatccattagctattcttcctgatgctctccctccccaccccaccctccgacaagccccactgtgtgtgagaacatgcggtgtttggttttcctattctgcgttagtttgctgaggataatggaagccctttccttaactcattaaatgggtaaatgtttgcccccacaagcccgcattcgtattttgaagccctaacccccagtgtagctgtatttggagatggggtctctaagaaagtaattaaggttaaatgaggtcataagggtggggccctgatccaatagaattattgcccttgtaagaagagacaccagagagctcactctgcctccgcatgcacacacagtgtgggccgtgtgtgcacacagcgagaaggtggccgtctgcaagccaggaacttgctggcactttgatctggaatgttccagtctccaaagctctgagaagatacatttctgttgtttaagccacccagtctgtggtgttttgttacagcagcctaagcagactgagacaggcagatactatcattcccatatgaaaattgaagagactgaatcatagaaaggggtcgcttgctgtattgctctgttgatttttccttctaatagttttgctttctacatttactgtaatgttcagttcatcaaggctcctgaccatgatggtttgttgtaaacttccccacttaacagtatcctctgcttcctttttcctcatttgacgtttttcactttgaattctcctttctccaatgttagcatctgaaaccctttgtgttgggcaggataggccaagtctgatgctgttacaaacattctgaagacccataggcctacagtgaccacagcttctctcttgggcacactggaggccattggcggtgtgcagggcctctgcttactgtagtctcagtccctgcccaatgggacgtggctctcatggcttctgctgtcagcacagactcattcactggctcttaacacttctgcccagaagtggcacagatggtggaaaggtgccaggtgggctcctctagccaatgtgagggcctttgtacaaaggagaaaaggggaaaaagagcccacccactggtgcagggctaggagagtagagggtgtcccttccctcagatgggtgcccccccaccctgcagcagggttgagggagcagaagcggggtcctgccctgttgcctggtggccgggcactcgctgcatgcagggcggagggataaggagcagagtcctgccctgttgcccagtggccgggcaatcactgcacgcagggtggagggagcaggagcagggtcacgccctgtcaccccgtggccggccactcactgcaggcaggtggagggagcaggagcagggtcacgccctgtcaccccgtggccggccactcactgcaggcaggtggagggagcaggggcagggtcacgccctgtcgccctgtggccggccactcactgcacgcagggttttgctgtctttatgtcttcagggcatttccatgagaagtggaggctgctgccaagacagcatttcaaaccattcttgaagcaggaaccacatctgcgtgtgaatttttccagaatctgggggaagaacttacttgtttcttcgatattctaaataatcagtacagcttccgacagcagtggcctccaaacctgaaatagaggcagtgtatgagtccacgagtctttttgcttggttttgccttgcttgctttacttggattctgacactccactcgcgtgtttccacattcaattccatttgaatgactttggtgcttctcagccagctgtggacccggcagccctgagccctagcccttcccctagcagccaactcagcacccgtgttctaaggacgcaggagtctagaaatagctgcgattcagagcatgttttcccgacaactgctgattctctcctgacaccctaatgctgctctttccctattttagggattgttctttgctgaaattatgtggcacacatcaaaagtgttctacaagtgtccggggtgttcattgtaatctggtataacaagatgcctcacggccaggtgccgttggctcctgcttgtaatcccagtgctttgggaggccaaggtgggaggatcccttgaggccaggagtttgagaccagcctggtcaacgtaatgagacccccatctctacaagaaaaaaaaaaaagataccgcagttcacgcagttcaggtatttgttccgtgaacttgggggagtcatataaactcaacttttctttgtctctcttgcctgtgatgagtaacagaaaccatcttcccagaaactatccccacccacccccagcccagcccgagcagcccagacccaggaaggaggtcagagcctgcgtgactgtgtggcaaggatccccctcaaagcaggcagtgatccccctcaaagcaggcagtgatgaccaggctccccaggggaaggaaaaatggttgattaccccacctcactttctcaagttcctgaaagcctcccatcttttcaggatgttttccttctgcttcctttctggggtgatattgcaatgcatgtgtcagtcccattgttctagctgccttgaaggagttccagaaacaggcatggctggtgtgagaggaggcgtccttgtcaccatcctttgttgcctcccatctgtggtcagcacggaggctgccctgggtcttggccggcccctggagctggaggaggtgctgggccatggtttggaagctcgcatggtcccagcctcagagccccgttctctgtgacctggctgggtcaaagcctggccccagaacagcccctccctccccacccacagctgtgcccagctacgaacactgtaggccgggcgcgatggctcacacctgtaatcccagcactttgggaggccagggcgggcagataacttgaggtcaggagttcaagaccaacctggccaacatagtgaaaccccatctctactaaaaacacaaaaaattagccaggcatagtggtgggtgcctgtaatcccagctactggggaggctgaggcgggagaattgcttgagcccaggacgtggaggctgcagtgagccaagattgtgccattgcactccagcctgggcaaccaagagagattctgtctcaaaaaaaaagaacactgtggtgtgagaggcaattgtgggtcagcctgagggcacacccaatataactttcacaggtgttttgtttttctgagaagaaggtgacttttcccggttgctgtccatgcagactgtgagggatgttcacatgtcacatttctcaccggagtcctcgtcccatcgcctcctctctccctgccgcggttcggaagctccacgggggccagtgttgttcaggcctcaccagtccttggtcatgccacccgggctgagttcatttacctgctcattcatgtattcacttttcctccgattcaacaaaaaaaaaaattgattaccccccggcatgtcctaatatactgcagccttcgaaagagatgtagtcctcatctgaaaggtcatcctttcaagtgtccatccatccactgggcagatttttacttagcacattccctgtgctggggacttccccgggcactggggacactgtagtgcacaaaccgaagtccccacgctctgtgaccctgaagataaactgctgagcagacagctctgtaacatgccaagtgttggaaagggctccagaggaaatagggtggagagaggaacaagaagggcaagtggggaggttgctgttttctgtggggtgccagaggagggctcctgggaaaggtgatgttcatggcagtgggaaagacagcaggtgcaacagtggagaaggatgccagcctgacctgtctgactctcagcatgggggctgttgtggctgagcagagagatccgaaggaagagtggggagaaatgagggaggggagacagctgggggcgagactccctggggctgtgtaggcagcagtaagacttggattttccccctagcaagaggggtggctattggacagctcagacagaaacctggctgctctggcctgtgttaagaggattcctcctcgcactgtgtggaggacagccctggatggccgggcaggttacgcactgcagaagccctgggagcacccttcacactgactcctgtgtgaatgaccatcacagcctgggcggggctggctgtaggagcagcagaccagcaggggcaagagcagaagccagagaccaggctggacgttggcacagtgaccgcaggagagaagaatgttgccagaccagagtggagccatgggctgcagaggtggagaagtatttgcattctgtatgccttctgcaagtagagcctgtggggtttgctgatggattgaatatgggatgggagagagagggagatcaaagatggtcccggggttttcccctgcatgaccaaagtggatgttgaggtttgacctgtgccagtgtgggaagctgggtaaatgtcgggttctggggggaaacctggttgcctctgctgggcactcggccctcaggcctccacatcctccttgaaatgcgtatcgggtcactctggggtatgggtttctgattaggggagttcagaggcttattcacag

SEQ ID NO: 316 - DNA, 5258 bp, Homo sapiens
aatgtgagaaagatcaaagaaatgcagagcagactaagaaagatgaaacatctggattgcagagaagggtgacctttccctagaaaatatcaacactaaatctttacaaagccctgtccactgggttctagggagcgctgcaaatggactggtccctaagctctggcctgcttctccactcctgtgagacagttaacttttttcttttccttagctctgttcctcgccgtggggactctggataacaacagacaacaacagagcccgtggtagcagcagcgaaggagttaatatgcaccatgtgtctaagcccttttcattttacttctttgtaaatttttaacatatttatttaaaacataaacatcgatattctgattagttcgcaggaacaattattgtcattagggaagatggaaatttactagctattttcctcctttcatttttaaaaaaaaatatatatgtattacatttttttcttcaacttttattttaagttcaggcatacatatgcaggctgtgcaggtttgttgcacaggtaaatgtgtgccaaggggatttgctgcacagatcatcctatcttccaggtattaagcccagcatccattagctattcttcctgatgctctccctccccaccccaccctccgacaagccccactgtgtgtgagaacatgcggtgtttggttttcctattctgcgttagtttgctgaggataatggaagccctttccttaactcattaaatgggtaaatgtttgcccccacaagcccgcattcgtattttgaagccctaacccccagtgtagctgtatttggagatggggtctctaagaaagtaattaaggttaaatgaggtcataagggtggggccctgatccaatagaattattgcccttgtaagaagagacaccagagagctcactctgcctccgcatgcacacacagtgtgggccgtgtgtgcacacagcgagaaggtggccgtctgcaagccaggaacttgctggcactttgatctggaatgttccagtctccaaagctctgagaagatacatttctgttgtttaagccacccagtctgtggtgttttgttacagcagcctaagcagactgagacaggcagatactatcattcccatatgaaaattgaagagactgaatcatagaaaggggtcgcttgctgtattgctctgttgatttttccttctaatagttttgctttctacatttactgtaatgttcagttcatcaaggctcctgaccatgatggtttgttgtaaacttccccacttaacagtatcctctgcttcctttttcctcatttgacgtttttcactttgaattctcctttctccaatgttagcatctgaaaccctttgtgttgggcaggataggccaagtctgatgctgttacaaacattctgaagacccataggcctacagtgaccacagcttctctcttgggcacactggaggccattggcggtgtgcagggcctctgcttactgtagtctcagtccctgcccaatgggacgtggctctcatggcttctgctgtcagcacagactcattcactggctcttaacacttctgcccagaagtggcacagatggtggaaaggtgccaggtgggctcctctagccaatgtgagggcctttgtacaaaggagaaaaggggaaaaagagcccacccactggtgcagggctaggagagtagagggtgtcccttccctcagatgggtgcccccccaccctgcagcagggttgagggagcagaagcggggtcctgccctgttgcctggtggccgggcactcgctgcatgcagggcggagggataaggagcagagtcctgccctgttgcccagtggccgggcaatcactgcacgcagggtggagggagcaggagcagggtcacgccctgtcaccccgtggccggccactcactgcaggcaggtggagggagcaggagcagggtcacgccctgtcaccccgtggccggccactcactgcaggcaggtggagggagcaggggcagggtcacgccctgtcgccctgtggccggccactcactgcacgcagggttttgctgtctttatgtcttcagggcatttccatgagaagtggaggctgctgccaagacagcatttcaaaccattcttgaagcaggaaccacatctgcgtgtgaatttttccagaatctgggggaagaacttacttgtttcttcgatattctaaataatcagtacagcttccgacagcagtggcctccaaacctgaaatagaggcagtgtatgagtccacgagtctttttgcttggttttgccttgcttgctttacttggattctgacactccactcgcgtgtttccacattcaattccatttgaatgactttggtgcttctcagccagctgtggacccggcagccctgagccctagcccttcccctagcagccaactcagcacccgtgttctaaggacgcaggagtctagaaatagctgcgattcagagcatgttttcccgacaactgctgattctctcctgacaccctaatgctgctctttccctattttagggattgttctttgctgaaattatgtggcacacatcaaaagtgttctacaagtgtccggggtgttcattgtaatctggtataacaagatgcctcacggccaggtgccgttggctcctgcttgtaatcccagtgctttgggaggccaaggtgggaggatcccttgaggccaggagtttgagaccagcctggtcaacgtaatgagacccccatctctacaagaaaaaaaaaaaagataccgcagttcacgcagttcaggtatttgttccgtgaacttgggggagtcatataaactcaacttttctttgtctctcttgcctgtgatgagtaacagaaaccatcttcccagaaactatccccacccacccccagcccagcccgagcagcccagacccaggaaggaggtcagagcctgcgtgactgtgtggcaaggatccccctcaaagcaggcagtgatccccctcaaagcaggcagtgatgaccaggctccccaggggaaggaaaaatggttgattaccccacctcactttctcaagttcctgaaagcctcccatcttttcaggatgttttccttctgcttcctttctggggtgatattgcaatgcatgtgtcagtcccattgttctagctgccttgaaggagttccagaaacaggcatggctggtgtgagaggaggcgtccttgtcaccatcctttgttgcctcccatctgtggtcagcacggaggctgccctgggtcttggccggcccctggagctggaggaggtgctgggccatggtttggaagctcgcatggtcccagcctcagagccccgttctctgtgacctggctgggtcaaagcctggccccagaacagcccctccctccccacccacagctgtgcccagctacgaacactgtaggccgggcgcgatggctcacacctgtaatcccagcactttgggaggccagggcgggcagataacttgaggtcaggagttcaagaccaacctggccaacatagtgaaaccccatctctactaaaaacacaaaaaattagccaggcatagtggtgggtgcctgtaatcccagctactggggaggctgaggcgggagaattgcttgagcccaggacgtggaggctgcagtgagccaagattgtgccattgcactccagcctgggcaaccaagagagattctgtctcaaaaaaaaagaacactgtggtgtgagaggcaattgtgggtcagcctgagggcacacccaatataactttcacaggtgttttgtttttctgagaagaaggtgacttttcccggttgctgtccatgcagactgtgagggatgttcacatgtcacatttctcaccggagtcctcgtcccatcgcctcctctctccctgccgcggttcggaagctccacgggggccagtgttgttcaggcctcaccagtccttggtcatgccacccgggctgagttcatttacctgctcattcatgtattcacttttcctccgattcaacaaaaaaaaaaattgattaccccccggcatgtcctaatatactgcagccttcgaaagagatgtagtcctcatctgaaaggtcatcctttcaagtgtccatccatccactgggcagatttttacttagcacattccctgtgctggggacttccccgggcactggggacactgtagtgcacaaaccgaagtccccacgctctgtgaccctgaagataaactgctgagcagacagctctgtaacatgccaagtgttggaaagggctccagaggaaatagggtggagagaggaacaagaagggcaagtggggaggttgctgttttctgtggggtgccagaggagggctcctgggaaaggtgatgttcatggcagtgggaaagacagcaggtgcaacagtggagaaggatgccagcctgacctgtctgactctcagcatgggggctgttgtggctgagcagagagatccgaaggaagagtggggagaaatgagggaggggagacagctgggggcgagactccctggggctgtgtaggcagcagtaagacttggattttccccctagcaagaggggtggctattggacagctcagacagaaacctggctgctctggcctgtgttaagaggattcctcctcgcactgtgtggaggacagccctggatggccgggcaggttacgcactgcagaagccctgggagcacccttcacactgactcctgtgtgaatgaccatcacagcctgggcggggctggctgtaggagcagcagaccagcaggggcaagagcagaagccagagaccaggctggacgttggcacagtgaccgcaggagagaagaatgttgccagaccagagtggagccatgggctgcagaggtggagaagtatttgcattctgtatgccttctgcaagtagagcctgtggggtttgctgatggattgaatatgggatgggagagagagggagatcaaagatggtcccggggttttcccctgcatgaccaaagtggatgttgaggtttgacctgtgccagtgtgggaagctgggtaaatgtcgggttctggggggaaacctggttgcctctgctgggcactcggccctcaggcctccacatcctccttgaaatgcgtatcgggtcactctggggtatgggtttctgattaggggagttcagaggcttattcacag

SEQ ID NO: 317 - DNA, 2405 bp, Homo sapiens
ggaaactgtgctgttaaattctacactcataaaggaggtatgttttaaaagaggggcaaatatgtgggtgctatttagactctcattgatttgttccatgttttcagataactacacacccctccgcccccgccaaagtaactcaatctccacatatttgcctttatatgtaccttctaactcatgactatggctttgattatctcataaacaatattgttcctgttagccatggagaagctaaggagccaacagcagagcaggctgcatgttcttctgtccctcttataagacaaaaccttagagcaatgtcccactgcagaatttatttgttaattcactcaataaattaaaatatgcatgattctaggcactggggatatattgaggaagaggcaaaaaaaaaaatctctgtcctcatgggactcagattctataggggtggggagagggagggaggggaagggagtgggagagcacaaacaaaaccaagcagtaacacagcttgtggcagatggtgacaagtcctatgctaggcagggggaactggtggggcagaggcaggctgcctgacttacagacatgggtgtgctcggggaaggccacattgggaaggtgacacttgagcagacatgtgtgatacctgggacagagggcagaggagaggtcaaggccttgaggcaggggcatacttggagggtccagggaggagccaggaggccagtgaggccgcagtgcatgagtggtgggagagtggcaagagaggtgatcctgttgggctgtgactctgagcaagcagggacccactggagggttctgaacagaagagcacaatattgcaggactaaacaaagaaccagggggcaagggcagaggcagggaagctggacacctggaccagggtgggggccatggaggcaggggaactcatgagattttgtatccatcttgcaggtggagtaacagtatttgtgaacaaatgaggtaaccagcgccaggtttctggcctgaggagcaggagttggagttgctgtttactggaaaggagaagaccagggaaagagaaggtctagggaggataaggagttcccgtgacccagtcagcctggagacataaatttgggagccatgaggctggacggaatcacttcgggagtgagggtggagaagaaaagcctgaacctgaggccttccaacatcacatgcgaaacagaaaagaccgaggaggacagacattcacacactcacctaggacttcctgaggacccacagacaccaggcactgttctaggagcttgagctacatctgtgaatcaaggagacaatcctgtcctgtggagcttctgctccagcaggggtgacagctaagataagcacagtcagtcatgtattcagctagaaagagacaaaagctgtggtttgcactgagaaggtgcacatcagtgcagagactcaagggagggaaaggattgtctcgtatgggtattggggttaactgacgacgacagctctgggaaaagaagtgacaagcagctcccagatttaacaacatgaaggtcatcactggagacctcatggagcagcttggcagagctgtggcagcaaaggaacaactggagaaggttgaagagggtgtggagacagggactggagtcttgctggtaaaggaaaacagagatgctagacaggtggggggttgggagcagcttttgtcaaggtgggagaagtagcaacaagtttctagggcaggcgagggaggaatctctgatgggggagagtgcagtagaggactggagagatgccttagaacaggagtgagggcctgggacaggcgctccgtgacagcatgagggaggcagagcgaaggagtagacgctggcctgtagacactctcttgagcttgcttctgtgctctctgggaactaagatatcagctgcaaggaggtgtgacagctgatgaggagggtgggaggggctaggagagaccggggaactgcagtatgcaggtgggcttggcggcaagaagtttacctggggtagacatgaacttaaagggggaatcaatgaaggagtcacattcagcttcaggacggagcaggcatggggcagacatgactgaatttcatgaggctggggctttgtcgactgaatataacaaagcaagaaagtgccgaagggctgaggtagtgtgccagggagtaacgacgtctgactggcactgaagctacaaaggagaggaataaggatacgaaggaggtgaagtctgagaaaagatggagccactgatggattctaagtgcctgtgaggtcaaaggagtattggagttgggtattagaggcagtgaaaaggaaaaggatctccttttgcagatcacaaaaaagataaaatgaccagagctaaacaa

SEQ ID NO: 318 - DNA, 229580 bp, Homo sapiens
ttctcagcatgccgatctatttactgctaaattgaataattccgcctaaaggagataacatactcttactgacagcttgtccctaaactcccagatttcacaacatcagtacacaaatatacaatatagaaatggttgcttatgtgcattagatctgatgtaaacaacagctgccaaaaagactgaattagcctgatcttatttcatttctcttcttatttcatttcttttcagtgatatttgcctttttaaaaataatcagttgtggcaatacgtgaagcggagaggcacagataacaggcacctccattacaccaatgacggttctgcagtttttcctaaagtctttctagaatgacgcacaacacattatagcttccgtgtttgctcaagattatttgattaaactattacactgagagtaaagattactctttttaggttgtcactttctcactgatgcttggcaatttacttaagggaataagctaggtgtaggtttgcaccccttgctctatcaagacaatggcaaatattgattggtagtaagtaaggcttagacgtggtttcctttttcttttacatcagccgtgggctgttgagatacaataggtgcagccaaaactgactgataaatatggatttctaccctcccacagggcttggaataatgattgagttgctttgttttttccagaacttatagcatatatatatatacatacacacatacatacacacacacactatatacacatatatttataaaatatataaatatatatgtgcaatatatatacacatatacaaacatatatgcatggtatgtatatagatgtacacacacacacacacacacacacacacacatccttctttgatggctccacttcccatccaattgctcaatcccaaatctggaattgccttgacctatctctcttttcctctgttactcaaagaaatcttaaaacttggctcattctcatctctcctgtcgaccattctagtctcagccactatcatctctcccctggactataccactgcaatctgggaaccagtgggtttcctggcttccattcttcctcctcaagcttttctctgtatagcagctgaagtaatcatttaaaaatactcctcttaaaaaaatcctccccacatggtattacacatggaaactgacagtccaaggctgtgatcaggcgatggtaggctcaactgggccagtccaagtgacatccctttgaaaggagcatagggagtgccctgccccaaaacaccccccaacacaaaacattcagcaacttcttttaaaaattatttgtataaatttagggagtacaagtgcagttttgttacatggatatattgcatagtggtgaagccccggcttttagtagaaccatcactcaaattaggtacattgtactcattaagtaatttctcatccttcactccccttcctgcttcctcccacccttccgagtcttcaatgtctatgaattctatagtcttgtcttcacactgttttgctcctacttacaagtgagaacatgtggcatttgacttcctatttctgagttatttcacttaagacaatggcctccagttccatctgtgctgctgtaaaagacattattttattatatatttttatggaccagtagtattctgttgtatatattatagtataccatattttctttctccagtcattccttgatagatgcttaggttgattacatatctttgctgttgtgaattgtgctgtgataaacatacaagtgcaggtatcgtttttatatagtgatttcttttcctttgggtagatgctcagtattgggattgctggatcaaatggtagttttattttttagtactttgaaaaatctccatactgttttccatagaagtactaatttgcatttccacccacattgtataaacgttcctttttctccacatcctcgccaacatctcttatttttttgactttttataatagccattcagactggtgtaagatgatatcttattgtggttttcatttgcatttatctgataattggtgatgtctagcattttttcacatgcttgttggccatttttatgtcttcttttgaaaaatgtctgtttgtgccctctgcccactttttaatggggttatttgttttctttgtcatcgttgattatttaagttcctcgtagattctagatattagtgctttgtcacatagtttgcaaatactttcttctattcttcaggctgtctgttcactctgttgattatctctttttctatgcagaagtttcttagtttaaatgaatctcatttgtccaaaatagtttttgttacttgtgcttttgaggtctcagtcatgaattctttgcctacggcaatatccagaagagttttccccaggtttacttctagtatttctatagtttcaggtcttacatttaagtctttaatctatcttgaagtgacttttgtatatggtgaaagatagagatccagtttcatcctcttgcatttggcaaccaaattttctagcaccatttattgaatagggtgtcctttctccagtgcataagtttgtcaacttagtctaagatcagttgactgcatgtatgtagctttatttctgggttctctactctgttccattgacctatgtgtctatttttataccagtaccgtgctgttttgattattgtatccttgcagtataatttgaaatcaggtaacagtgatgcctccagctttgttctttttgcttaggattaaatttggctatttgggttcttttttggttccatatgaattttagaattgttttttctaattctgtggaaaataatgttgggattttgataggaattgcattgaatctgtagattgctttgttaagtatggtcatttaaacaatattgattcttccgatctatgagcatgggatagtttttcatttgtttgtgtcatttacttgtgtcaatttctttcatcagtgttttgtaatttccctctcagagatctttcacgtccttcgttacatatattcctatttattttattttgtagttattgtaaatcagattgacttcttcatgggttctcaacttcatcattatttgtgtatacaaatgctactgatttttgcatgttgattttgtgttctgcaactttacttaattcattgatacaatcaaatagtcttttggaggagtctttaggattttataggtataagatcatattgtcagcaagcagagataatttgatttcctcttttccaatttggatgcgttttattttttttctcttgactgactgctctggctaggacttgcagtattgtattgatgaattcttcttacggaaaagtggaagttctgctatatcaaaaagaaaagggggctgggtgcggtagctcacgcctgcaaccccagcactttggaaggctggacagatcatttgaggtcaggagttcgagaccagcctggccaacatggtgaaaccccatctctactaaaaatacaaaaattaactgggcgtgatggtgcacacctgtggtcccacctacccaggaggctgaggcaggagaatctcttgaacccaggaggtggaggttgcagtgagccaagattgccccactgcactccagcctgggtgacagagcgagagtccatctaaaaaaaagctggctgggggagcgggggaggaaagttccataggcaaaaacaataagtctctattatatattcatgatgaaattctcattggtccaaaatgaaatgaaaaatataaaaatgatatattaaaatttttatacaattcattatgagtttttatattttatataaaaatgatattttgaaaatttttatgaggctaaatagggttaatttttaaatatttattttttactgccctttactattcttttttagttttggtgataaaatgtcctttcatttaatatgttatggtgatatcagtttacagttatctttttatgtctttacttggcaaagttaggttaacaactctatgacggtttcctaatatattgtttaaatttatttgttcacaatatccaaacctttgggaatccttaatctagagcacattttaccaaagtgccacctaaattgcagttggaattgcttgcaagaaagaagggtgggagaagtttactgtcgaatatactcaggatgctgagataagaaacttaaaaaaaaaaggaaccttaccacagaacttctcacagccttaaacatgctgatgtagatggtgaatccccaaaatgaagatacagtatacagcatatcccacaattatttgaccaaggaactcttgcacgaagaagcatcttagagacttgtcctggaaagtgttaatctagagactcacaaaatacttcaacaaatattgaatattggctggcaaatagaaatgcataatgacacttctatagaaagaggaatccaagggacataaaagaaattaagatgagaattcagagatttgtgccatgtcatcctcgactacagccttagtattttcaacttactggtttcttagcttggtctgcatatttgtgaaagaataagccccattcatacgcttatattttcccaaatgactttgaaatgtcaagccattgtatgaatttgaaacggcatctttagacctttactgaagttatgttactgttgccggagtaactaacaagtatcacagggcaggggaaggcagaaaaatatcctttcatttatcaagcactgaataaagcaagaggcttagaaatgtgcgatggaacacgatgttacaaagctattgttcctgtacctgtaaataaaaggtaacaaggtccatttgatgacaaagagtcatgagacagctacacagctcctcttcaaaaggaaacaataaaaacttttaaaaataccaaataacattacacttcttgctctaaaagtatgctggttatataacagaatgcaagtagatttataattagcacttgtttatagatgtcttatactgtgtcatgcatggaggggcaaaagaggttctgatggctattcattcagatagaagttatcgaggccataggaagtgagagcgccatcatactaatgttaaatagactgaacaatgggaaatttacaaccagcacaaggatgaatcagttgatgaatatcacattgttgatagaaaacgattttgagagagtggagcaaaacttatttaggaagttagaggcatctctcctattctcttcttccaaccctccacttcttctcgtatttaagattaatagataattagggtagaatggatgctctttaaaagagaaagcactgaacaggagagattgtgaaggttttttcatgctgtggactcaggatgcaagaggggctgtaactctcaggatacaatgagaagaggcatcatcctttctggggtaacatttggcagtatagagctagaatagcaacattaagggtagcaagattaacagcaagaatacagggatcagaaagtctgaagctcgaaaatgctctgaaatcaagtgaagtgatgtaaagggaatatctaagttcatttctataatttctaggccagatagtttgttaaaatatggaagaatgcagggatgcaaaatttctccaggtatataaacagcataaggaagtaaaaaaaaaatatagtactctgagataatttcaaggaaacatctataggaattcggagaagggaacatcatttctggttgggataattatgaaacatttcggaactgggatatagctcaaaatacactcaaaataattatgtggtgggctttctcgatgacatctctcagagtggctgagaattctaaggtgtgtcaaaattctgtactaaaatttatggccaaatcaacttatttgatcaccaatactgccattgccatcagcatcaccattaccaccccaacactgctatcaccatcattactaccaccacttccacccttatcagcaccactatcaccattatctccagcaccaccacctccatcaccatgaccatcattatcatcatcattacagctaacagttatcgaatgcttactgtatgcttaacaccattctaacccctttacatgaataagcaaatgtaagctttcttcaaaattccaggtgaaatgctattttctctggatatgccccacttcgttgaattatcttcccttcaatgaaattttctctttctctgtaaagttctttaatggaaaaatcactttccacattatactatagatgtaagttacttatttcccttctttaaggacagattatgcctgattccacttcaagcctctcaaagtacccagcccactccttactactaattgctcaataaacttatttgtgttaaggaacaaataaaaagataattcctacggatacaatatttttaagattgactctcattttggaatacaaacatgacattgtatacaaagcaagagtttagttaccttcatccatgtcaaactatgtctttaaaattcacagaaaataaaagaaagacaagttacacataaaccttatgtcagttgtgatgcaaaaatatcagatgatcatttacacattgaaagaaacacaagtatagaatagttgcattatcaaatatttctacaaaatattattgatttataacagattttattcataagtcctgccactgctggtataaaggcaaagaaatatcatgtaggaaatatttcggctgcagttgttggttgcttgctgtggtggtggttgttggccttagctacatttattacatccaaaatatagagcagcgccaagatctgtctaagtcccatgcttacacaattagcatgcttctcattctaaaaatacctttgtccagtgctgtttgagaaaccagcagagtttttctaataatcttgttaaattacatgataagtaatccattgcttcaccttacaaagggatagttaggaacaaggattagatggtttgcctaagtatgttgtagtagagactagctgaaactatcttcttggatgcataggctgcatatgcctagcttgccgtgcagttagatggggccacatgactgagtaccagccaatgtaaggtgaacagaaatgtttagtccttctctataaaaaacctccaaggtgtcaacctccagttatttttgcctgttgcactccactaacaagaatggtgattgtgggagctacatacttaagttgaaaggacccacaagatgaaaaaagcttgagcccctgagtcacaacctggaagagaactgactagggacataggtttaagactttatatgagtaagaaatatgcttctgtcataataaatcattatgatttgaggatttatctgttaaagtagctaaggtatattaactaacatggacattattatcttgaagtggaatgttgctctaataaaagccttcaataggcttagtcgttatggagtacacggctaggaaatacgtatcagaagctggtaagatagagatgtgttatttggagacaaaacatttgttaagtctatcatctgcaatacatgttcctacatgtattgaccaactaaatcttcaattagcctctaactctgggagaagtaggtagggaaagttagaatatctgtttgtatgcatatttataacagcataattcacaattgcaaaaatatggaaacaacctaaaatgcccatcaatcaacaaatggaggccgggcccagtggctcatgcctgtaatcccagcactttgggaggccgaggcgggcagatcacaaggtcaggagttcgagagcagcctgaccaacatggtgaaaccccatctctactaaaaatacaaaaaaattagccaggtgtggtggcaggcccttgcaatcccatctaattgggtggctgaggcaggagaatctcctgagcccaggacgtggaggttgcagtgagccgagatcacgccattgcacttcagcctgggcaatagagtgagactccatctcaaaaaaaaaaaaaaaagtggatacagaaaatgtggtatatgtacaccgtggaacactactcagccataaaacagaacgaaataatgacttttgcagcaaattggatggagtcagaggccattattttaagtgaagtaactcaagaatggaaaaccaaatattgtatgttctcacttataagtaagggctaagttatgagcacacaaaagcataagaataatacagtggactttggggacatgggaggaggtgggattgaaggataaaagacagcattttgggtacagtgtatactgctcaggtataatgggtataccaaaatctcagaaatcacaactaaagaacatattaatgtaataaaatgtaataaccacctgcttcccaaaaactattaaaatcttttttaaaaaaatcagtgtgtatttgttacagttggctgctgttggtatgttattgccataaaaatagataaacgaaaaataaagatgttcttaggaaagaattggctacttctctagctgagttagaagtgattggagatcaagccccttgtagggttagaaaatccagactgtttatatatatcaaatagcaaatagtatcttggagtaaaaagatatttcagttgaaagaaatgattcagccctgcaacaaagactcatttaaaaacgttaccttcccactcaagcttgtactttcacaaggccacaacatatccataattatgttgagaaagaagcactgggcaaaagaagcaatgaaagcagatttgacaagtatagttaatagaaagtttgggtataattgctgacatagggagctgactgaaagaacaaacatcagaaattcctaagttcttgagacaattatgctgtcagaaaatccctgagcctggattttgccaaagcagttgacttcttgaactctaagacaacacttaggtctgccaatttgtaccagcctgagaagtgggcaatgaacgtagggtagccagcctgatccactcatgcctgtgatcctagcactttgggaagccaaggtgggaggactgcttaagaccagcctgggcaatacagcgagaacctgtttctacaaaaataaaaaattagtagggcatgcatttgtagtcctagctacccagaaggctgaggcaggagaatcacttgagctcaggagtttaagggtgcagtgagctgtgatcgcaccattgcacttcagcctgggagacagagcaagatcctgttgaaaagaaatagaaagaaaaaaaagaaaaggaaaagaaaaaagaatgaaagtcaggcagctcgtcaaggagagaatgtaccacaatgcccacttccgatgttgtgaccacagagaaggacagacaaaagaatacatctgtgtgtgaagatctaatcaacagatttcccccatttctgaagttgacacattcaggacacctgcccagcaagaatctgtagttgcattggtccagggaatgctgtctgcctcccattcttcacttttcctaattggaatttattagtgtgcttaacctttctctactgtgggatcaaacactgggcatgaggtgtgggttgtgaggagagggtaactaactggtccttctgttcatagataaaccacaaggcgccatatctcgttctgacagatggctgcacatcactggaaggatcttattcgttgaatcagacacagaagcagaatgggatttggggttgtctttggcacatgggtggtttataggtgtgttctatgtgtgagaagaaaaatgaaacagatatatggaaaccagaaggtagatttagaagagattggtcagttgatcactgaactcatttcttttttttttttcccccttggcatgcagcaagacagaatttctcatgctccttcacagttagttgtgatgtacaaccgagtttcaacacttggaagtaagtgaaatgaaatgggctgctttctaggcctggataggaaaatcccctgcccacgattctccatgctctttccccatttagcttgatgcaaacaagccagagaccttgaaggctagctggtgacgatggcagagccataacatggaaggatgtttgatctatgaatcgccacttggagaaccgacttgctgttcaggaacacccgctttggaaattacatgttcaataaataaacctgtgttaagacactaagattcagggactttgctgttagagttgatgggattaccttaaccacacacccacaactggtttaatagaagattgaatgtaaaatgatttcaagtgcccaacggctgaatttcttaatatgctatcctaagtctcatcatgatgatacactaggaatgacagaaatcagtcatatggactctttaagacagtttttccctgcaggaaaactgtgaagagtatcacctgaggtggccacatctcctttagacccctctcagcctttcagcgttttctgtaaataaagtccattcttcagaaaactttcaactaaactttgatgagatagagccaccagaaaagaaaaatcatgtatgctgtaaccactagaccaaggttcttttccaaagaggtttgtcgattttgataaatgtacttctaaatatatttgacatacataggcatcgggtgtttaatgaacagctttttctgctaaacgtcattttttccaaggttctcttacaaggagcttgacatgtgtagatgattatgagaatatatgtagactcactttttacttttctttttatttatttatttatttacttatttatttatttatttaagactgagtttcgctcttgttgcccaggctggagtgcagtggcgcgatctcggctcactgcaacctctgcctcccaggttcaagtgattctcctgcctcagcctcccaagtagctgggattacaccatacccggctaattttgtatttttagtagagacagggttttaccatcttggccgtgctggtcttgaactcccaacctcaggtgatccgcccacctcggcctcccaaggtgctgggattacaggcgggagccactgcacccaggcttctttacttaaaaacaaacaaacaaacaaacgaaaagctttctattctcagaagtgttcttgccctggctattataaattttccctgttctatctaaccaacagaatgtattactcttccctgggaacatgcacgtgcaactccctctcatgtaaaaattgccatattatccaagaagagtgtgtacgggtgcataattcaattaaatatgtagttcagaagcaaaagtaaatataagattgtgctaaggttcatgaattcaaagtttaaatactgagactctcagaaaatgtaaaatgcttttaaatgtatatatttattctgattattaccttttgaaaatgaactgaaaaaagacctacttaggaaacagaaatacttctgagatattgataagcggcttattatttttattgcttcaatttttagttttatgaattactctccaccacaacatattactggaaagttaagttttactgcggtgatctttcactaaagtctaattcattctaatcatttcaaaattcagagtttggtgttccatatttttgtcttccttgtcagttcattttgtatattatttacttgataagctgaggcttgaaaaaaatactcgcaaaagcttgtctgtacttatggccctgggcaggagtacaggcactttctctcatgagtattttacataggaatgatccagagaagagatgtggccctgtctctaccttgacagtaagctccaaatgctgacatttgctgaagtaaaaattctccctgtctagtggcaaaggtgcccccattcctttgaccccaaaactcccacttcccccaatcttcccatgcagatgttgtctgcagaaatgaagccatcaggcatcagaccccaaagcagacttaggtcgcatttacacattttctatcacaagcaggataaagacagactcaagttacccattacatttaggacttggggctcttagcacccaggctcagggttttaactcaggacacttacaatgaactaactcagtactacctttggtagtactacctttgagaactaggttccctgctagactttgaatttcttgaggattgggggcacatcttatttgttgttgtgtccctggaacctaccaagtactagagcatcgtgggctggctgtaaatgtctgtgggatgacttagtaaatgaggaaggcgagacatccttgaccaaccatagtgactaagatactgcagtggaacacctgctgttcctagttaactaagtaaatatggatctcccatagtatatagagaaagaataactctaaggaagaaggggataatggctgcgattccttccaaaagaacgctgtcacatgtgtgggggcgctgtacatatgtatcatctcttaactacaatctatgcatgtagtttgtttacagagatatttcatgcatgctgtagaaaattcaggtcatataaaaagggattataataaagctaaaatcccctaaaagttcaccactcagaagaactctcccatcaacatttgtatggggatcacccaaggtcaatctttctgggtatgtctgtgtttatgcttcctataatttattttgatttatgtttttgctgtatcacttctgcttctcaccctttatgacatgatggagatatgtctcttttttattttactagtagtcacttttataactttaaatagcatattttaacaaagttcttaatatattaagtacagacataaaataatacatacagaaaaaaaggcacataaaagaccaggaatagcttactttctctcatcttcattttattggagcatgcttcaagattatgtcccttggccgggccgggcttggccgggcgtagtggctcacacctgtaatcccagcactttgggaggccagggcaggcagatcacctgtggtcaggagtttgagtctagcttggccaagatggtgaaaccgtgtctctactaaaaatacaaaaattagccgggcatggtagcacatgcctgtaatcccagctacttgggaggctgaggcaggagaatcttttgaacctgggaggcggaggttgcagtgagccgagatcacagtgagccgagattgcaccattgcactccagcctgggtgacaaagcgatactccgtctcaaaaaaaaaaaaaaaaggattatgtccctttatcctagtgtaattattattactttatattgtatggtatacttgctttcttttgtacagccaatatttccaatagatattgtgaataattgtttgctcaaatgactttaatctcattactagtccactcattctacacgagtttttgaaattattatcactttccagttcagtagggtatatctgatctatttcctgagtctttaaaatgttctgaatctttgaatatttattcatatatttctattttctttttatatgagctataacttaactggttatataatacttttgttacactattttgtctcaaattgtgtagctgttgcttcattgtctttgggacacaatgctgctaaggaaaaagtctggatccaggctaatttttttctctatgatattgttgaccctatattgttactttgtatttttgttatttgcatttttcgttgttgtgttcttattttttccccaatattttcaatctatggttggttgaaacccgctaatatggagggtcaactatgatatgatattaatacatatatagatatatcatatataatattatatagttatattttatatattatattagttatattttatatattataatattatatagttatattttatataatacatattataatacatagttatatttatataatattatgttatatctatatatagatatgagaaaaagcaaaaaacaagaacaattaaaaaatataaatacaaaaacccagtagagtataacaactatttatgtagtatttacattgtgttaggcattataagtaatctagagatgttttaatgtataagggaggatgtgtgtaggttatccacatatattatgccattttataaaaaggacttgagcatccacggatattggtatcgaccagggtcctagaaccaatcctgtgcagatactgagggatgatgtatattcttttgcatgtatgcttgtagaaatatttctaaatccttgcatttcaacaacctactacaatctttgtgctacttgctttgtgatacacatgcttagaacatcttgcctcatcttgatctgcagatttgggtttgaattaatttctttctttttgttttttttgttttttttttttttggtttgagatggagtcttactctgttgcccagggtggagtgcagtggcatgatctgggctcactgcaaccccgcctcctgggttcaagcgattcttgtgcctcagcctcccaaatagctgggattacaagtgcacacaaccacgcccgcctaatttttgtatttttagaaacggggtttcaccaaattggccaggctggtctcaaactcccgacctcaagtgatctgcccgccttggcctctcaaagtgttgggaatacaggcatgagctaccgtgccctgccctgaattcattcgtttgtttgtttggtttttaagacaaagtctcattttgtttccctggctggagtgcagtggcacaatcatagctcactgtaacctcaaattcctaggctcaggcaatcctcccatctcatccttttgagtaagtgagactacaggttatgccaccatgctcagctaattttaaaatttatttattttttttgtagagatagagtctcgctatattgctaaggttgatcttgaactactggcctcaagcagtcttcccacctcagccacccaaggttctgggagtacaggtggtaagccaccacacctgacttgtttctgttgttgttttgatattatcttcaggtataacaatgatccataagcttgatatttatttcgtgcctccatatctataatcttctcccttattaaataagttaacacaagaatttagagcaatgctttacacagaatatatgttcaaaatataaattattataactgattaattgttttaactcttttttccctaaactctggctgattttctcagtcttctccttcctatcactgactcagctctgtagtgctgattctgtacttcgagtttctaaagagcttttaatttccatgatggcaattactttctcttcagtttctttccttaatatggctagctgcccttaaagtgaattcacttaaattatcgtctcatctttgatctcttcattcagaacagtagatgatataccttaaattttattaaattcctccatgttggaaaacacttgtctaaaattttcttctaattccttgagtgtgctttcctccaaaatgtgttcctgaattaatcttctgcatgctagactttttttcttttaccctttggctaccttctcttttgcataaatttaacataggcaagatattttatgtctaggtgtctttgtatttacttacttatttatttatttatttttgagacagagtctcactgtgtcgcccaggctggagtgcagtggtgcgatcttggctcactgcaacctccgcctcccagattcaagagattctcctgcctcagcctctcaagtagctgggattacaggtgcccacaaccatgccaggctaatttttgtatttttagtggagacagggttttactatgttggccaggctggtcttgaattcctgatctcatgtgatcctcctgtctcagcctcccaaactgctgggattacaggcatgagccaccgcgcctggcctgtctaggtatcactgaacagtgaacgctattctacgcaggcttgccttttgcccaaacataaaatgggtggattctcattgcaactcctccttgttttcctgtaccttgcttgaaaaatctcatttgaaaaggaccaggaagtctccctgtggtttctattctctttaaagtatttcaagagagaggttttcagggaaggcaaaggggccctggagttctattcaggggattcctctcttctctcccctccatcagttggtctgaatccccagtaatatgggccagcttcacacaattgaaggtgtgccctggtctatggaaagtacctttggcatttagactttttttctctttggagtagggctgttatgcttcctgtgagatccttgtggtttatgagtttagggtttttttgtttgtttgttttgtttttcatatttcctaccaagcattttgttttctgctgagatttggggtagatccatttttcaaaaaatttcaactttatttcaggttcagtagtacatgtgcaggtttgttacgtgggtatattgcataacactgaggtttggggtacaaatgatcccatcaaccagggagtaaacacaatacctaatgggtagtttttcagccctgacccccccccccttttctagtcatccccaatgtctgttgttcccatctttatgtccatgtgtacttaatgtatagctcccacttccagaaaaccaaatactacatgttctcacttataactgagtagagccattgatcctcaaagatttgtctgtttccttagttagccaaaggggaaaagtggccaaacttttgatatcattcaagtgaaggccttgaaaaaccatttgtcttcagtggggaaaaagaactgcaagtgggttattctacatcttttcttcaacggccgacacctccattcttggtcttaacaaattttgaggataccagtcagcgatgatgagtatctgaatatatgtgactctctcatgggcaggaaaacaccctactaatctttgtacacttggtgcccaggtgctatgcatacagataaattctcccttaaagggtaatttgaatgccatatatatcatctgtagacagatgatttttctgcttgtccttagccacttaggttttgtctcttcttcttcaatctggcaatttcctatatatgaaatgtacaccagccagtagtgcaatttcaattcataaatgttacgttctactgcccatagatccccaaatgagctcatgaggaacttagagtgaagcgaaatgccagtggacctcctccaaaggcttgttcctccaacagcagcaaattttgtgagcagtccatgaaccccaagtctgagagatcagtctcagatctatctaattgcagggggctgtagagacttaaagcctgtatttattatcttaattaccttttggccagggcaaaaggagatgttatatagacaaccagttgctttgaggtttgcactgaatccacgtatctccgtagttgctcccaaccaatgatgaagcacagcccagtgactaaaatgggctatttctgggaaacataggatgctcccatggtgattttagcttcatagtttccccacagccttgctgaagttttcctggagctgtgcacaaatctaaaatacttgatccaactccctttcttttcctctttctttgtctttcccggcttcctggtatctttctttccctcccacctttcttctctctctcacttggggttagaactgaaggattacctgttaaacacgtttaaacatgcttttatgataatacagttcaaatgcttcccatatctacattataacctttattatactctctaatgtacttcagcattatgaaatacaacataacatacttcaacagggaacttgactttcaaatgtcactattagtacttactaaattgaaaggaaatgttctcctatcagcaagtaaacacgatacacttgaatattcatgccattgcaaccatgcactattcaaatcttctctgtcaaataattgtttacaatccttttttttttttttttttttttttgagatggactcttgctctgttgcccaggctggagtgcagtggcgtgatctcagctcactgcaacctccgcctcccaggttcaagcaattctcctgtctcagcccccctagtagctgggattacaagcgtgcaccaccacgcctggctaatttttgtatttttagtagagatggggtttcaccatgttagtcaggctgatcttgaactcctgacctcaggcaacccacctgccccagcctcccaaagtgctgggattataggagtgagccactgcacctggcctgtttacaattcttaattgcctgtcagtggtgtagatgtgtatgtatgtatggcggggtcacgggcattattaccaagtttaaaaggaaagagtctaaaaatagttcccatgactcaggaggaaagtgtccctgtgttgtcaccttatttccactttagatccgtctatgttcgtaaccctgggacaggatcaatgatctgtaaaccaggctcagcctccccctggtgagcctaatgaggcacagaaataaaatataaaagtaagttcaataccaaatcttataccctcctaagaaatagtaagagttggaaaaaataaatactcttttataaagagtgaaatgaatctgttttcttcatatctcccccacccctaacctttagtagaagccagcataaatctggggagagaagccctccatgagtgctgggccttccagcctctcacccacaggccatggtgtcactgtgactatagttttactaataatactatatggcggctcatttttctattcaaactctctggaagatattaaataagtctgttttatttaatagataaatcagggctgcgatgttctcaccaaccaattaagaagcccagggaaaatactgacactctccttctgaggttcctctgtgcctcctgaggatggcatatgtaaagttttctgtttccctggtcttttcatcccattcttatgcatcatatgagctttctagggttgtcatgacaatgtgccaccaactgggtggcttaaaacaacagacatttattgtctcatggttctggaagctacaggtctgagactgatgtgttaacgggaccacactgcctctgaaatctgcaagggcgatctccctgcctcttcctagattcattgggtttgctgacaattgttgacactcctcggcttgcagctgcggcacttcagtgtctcccttcattgtcacacagtgttctcccctcttctgtctgtgtcttcatctcctgtttgaataaggacacctagcttattgtattatgatccaccccggtgatctcatcttaacttcgttacatcttcaaagaccctatttccaagcaaggccacactcacaagtactagggggtagatctttaacatatcttttttggggaccagttcaacccataacactaagattgaaaacctggcaacatcgacttaaatatatttgagtgtgttagtgcaaacctggttttggtgccttttacattcaactggacattactggtgttatctcatacccctctttacagagttctgagttgtcttcgtgaattcttatttacaacatagatgcattagacacacacacaaaaactttattttgtttgaaaatccttgacctttggaatacatttaaagatgaaaagaactatgtagtcaactcaaatctctagagaccctgtagtcctcatccttttgttaaactttcctcatgactttgctacagtgggtagtcaggagaaagggctttcccctacctttaatcacaattgtctgtggacaacttttgtaatatatcccaatgttgtaggagtctcagcttgaccataaagaagatgctaatgggtatgttggacgaactgttggtgcagacccaccaggaactaagggatcttcctgtaagaagttcttgcaaggaaagatggaatttggcataatggacttctacagatatcaggctttggtcatgtaaaagctgaggagctgctgaacatctcaataagtttaatgtatctggtttgtctccaggcccttgggacagacgcatgaaatctgtggtagtcaggatgggtcacactgtactaacccaaaaaggttacagctattttataaacaccaagagatgcttgacaagacaataaaacatagaaagtactattatttgagtgccctcggtacttttctcacacctggccaagacctacactttgtagggccttttctagcttcctctagttatagccttctccagaggttaaaagttctacatagctaaggggctgtgtccaccaagcatctttgcccccaattctcgcacacactgttagaatccagaaatttccttccctaaagaacgtgatcccattatcaagaatctccaggtcccttccccaggttttttatcctgaagatagatggcacagccagtatgtgtagatcaggctcaaggggtgcctgaggggtggctattagtggggatggtgtgaatagagcttgggcatgcagactggagcatccatacacttatccaagaggctgctgggcacacaaggaaaatcctcaggtggaaagggaaacaggagtaggctagaggctggggttaggtactggaggctggctctcccaggtcactatgttccatcatgggacactgaggagtccaagaattccaaatatgaatgtggtctttcttgtaattatgaaggtaggcttgtcaaagagggaagatagtacatatattattgaacattttcttagcttgattcataactttgaagtacaagtgacccttgaaccacatgggtttgaactgcacaggtctgcttatccctggattttctcccacctctgccactcctgagacagcaacaccaacgcctcctcctcctctttctcttcctcctcctccacagcctactcaacatgaaaatgaaaaggattaaaactgttatgatgatccacttctacttaatggatagtaagtatatcttctcttccttatgactttcttaattttattttttctagtttactttattgggagaatatagtatatgatacatataacatataaaatacgtgtcaatcaaatgtttatatgattggtaaggcttctggtcaacagtaagttattagcagccaagcttttggggagtcaaaatttatttgcagatttttgatggtgagggagattggcacttctaacccccacattgttcaaaggtcaactgtaaaatcctaggttatgagggtctctacttgtactcttgccctacaaatgttaggggtgggtctgggtgcctgtccatcaaagtatatttccagaggccaggtgggagggaggcagtagctgcagatccaaggaagcacagagaaaaatagtagataagcagccaagatgagacagtggaagctcaatgaagttatgtcacttatctgtctgaaaccttaattctgccttgtcatggaaactggcatattcacaggttctggagataaggaaacagacattttggagggctgttattctctctgctacaggctttaatcacctgcaacttggttataaaaactcgtttagatgctttatcaggtagcagtgattcaaatgaattacactctgtagttaccttgaaaggaacccctgaaaaagggattgcagaagccaaccaatatagcaaagcacagacttcacgtcctagctttttgccttgacttctttatttggtcaaagaatctctctctctttctctctctccccgcaccccccaacccaccccatcactcctcttctcctctgcctttcctctccttctcttgcttaacaactgattcacactgtttaaataacttccgtgggtagagagaacttgaagtacaaaaactaaatagattttctaagtcacacaaaaaatctgagaaccaagatgcatgcatttgcttgcatcaacagataacggctaacttgcattgagtgtttctctgtctgagatactatactaagcacttgacatgtgttatcttattcactccttctaactgccttattcagtaggtgctataattattactatctcatttcacagatgaaaacactgaagcttgaagaggttaaagaacttgtccacaaccgtacacgtatcatgtggcgcagtcagtcctcaaacccagcctctatagttttgcactgagccccttcaccaccatgactgtatctaggaatccttgctaagcttccccagagatgtgaacaccttccataaacatgttatatacagcagacatgaccacagcttgttcaaatcagtagaacattttccaagagcctaacatgtattgggtcccgtgttcaatgctagggatacaaatataagtaacaaaatgcccatgcccttcagaacctcagcttcctggggaaaatggaaataggaaatgtcaacgcagcaagtgaagtgctatggtagaaggcattacagaagcccagcagaaggctgcaagcgatcaaggttgttaaggagaaaagaaacaggctaggaggggaggattaaaacatttgaggtggacgttaacagatgaatacaaataagccagatgaagagggtagggaaggtatttccagtcagggataagagcaacgtgaaggccgagcagtatgggaaggcacggcccatgcacagtgtcatgtacctatttacaccacacactactactctgaactctttgccataatacactctggaatgctgtatgccttagcttgaccttctctatttctataaaaagcgaaatcactcctccctctgatgacccatgtcaaggttgaaaaaccatctactgtatttcaaaattttctgagttgatttggccttaaggattctctaataagcctgatataattcttaacaattcccccccaaagtattgaactaatagctattccctgacgcaaagcaattttctcggaggaaatgatcttagaatttttctgcatagcgtggatgctttttttttttgacagaacactgatttctgaaaatgaatagaaagcagctgtatagctgagcttaaatgtagcccaatcatgtcatccgtgtgccagaacaagataatttttccaccctaattcccatcatcctctgcttgatttgaaagacacctacatatacttgactaagttctgggtgcttcaaaaatgtatactgtttcttcctaaaggaatatgaatttggaaggggaatcccttatcctaaagcaatcacactgaaaatatctcttgacatacatttagactttcaggaataaaatgaagattgatgtcacagtgaagtggttcaccagaatccagtaaaacttggggctaaggaaactttgcaatcaaaaaagcctatccagctcttcttgttcttagatgtccctcctcatttcttggccatgctaaacaaaatctcaactgttatctcaaatatctgaacagaggttattctgaacagacacccatgctgtagggcaagcaggcccttacaggccttgcactctttatcgtggccttgtagatctttgcttaatttgctttagtaaatattctaaatactgaccctcaaagtaggagacttttcctagagtttctcctgtggagggggaaagtcataaagctaattttggcaatttgaaaacaaaattttcatcactatcaacgaagaatatagcaaattttaataatatgacactgtgtcatttgaccacctgttaactctagatggcaaatatatttaaatgattctactttcatagatcttacttagcaataaggtgctcactattatcatcgtaagatttttggtgcaaaaagtatatactagacatctgatatggtttggctgtgtccccacccaaatctcatcttgaattgtagctcccgtaattcccacatgttgtgggagaagcccggtgggagataactgaatcaaggggggcagtttctcccaaactgttctcatggtagtgaataagtctcacaagatctgatgattttaaaaggggttttctttttgcttcgttctcattctttcttgtccgctaccatgtaagacatgtctttcaccttctgccgtgattgtgaggcctcctcagccatgtggaactagagtcccttaaacctctttttctttataaattatccagtctcgggtacgtctttatcagcagtgtaagaatgcactaatataacatctattcttctgtggtcagaagcgctctatgacctatgggtgtcacacccaataaatatgcatgaattaatggcctgacagtaataaaataagtagaatagagtccttgatctcactagatttatgatgaagttaaggaaagaacatataacactgagaattcataaacaaccccagaacagtattaaagacaactacgtgttaaactatgatagttcagcagaggagaagaccagtgtgcaacagaagagtcagagggagctacactgagagatggctttgtccaaaatgcaaatctcataacacagaaggcagccaaactcctgcgtacctccttcctcctcagacagactttaaatactttaaaggctggagtttcccagggtttgattctcatttctcttttcatctccatctccactgtctcctcaggtgatgttatccagctccatggagctcatagaatgaatgattctcagttaatgtcatggatactaatctcccatttgagcacctgatataaagatccaaccacttacttgacaactcaacttccatatgtaataggtaattcaaacgtataacatgtccaaaatagaacttttataccctacttcctgacctgctacttcctcaatcaaccacacatctattaagagtgccaatattcactcaggtgcttggaccaaatcccaagaatcaaccttgactcttctattttctttcttgcccatatctgatttgtcagcaaatccaatcatgtcttatcctttccactgtttccacctttgtataagccaacatcctctttctcctgaccaacaagtagagttatcttcctaaaacttatatcactactctacttaaaacactccagtggtcttccagtggtttttcaatgctaatggaataaaatccaaactttctaactatggtctgaaagaccccagtctagtaaatcaagaactattaatcatgcagtttggtaaatcatgacaacattaaaaaaatagagtggaataaaaatgccacagtgcaccatatgtagtaagggaaagtattttgtgatgctttttaattttaaatattaaggtataaaagataggaaaaaccaacaccactcaacacaggactactgacaccagattctccagcagacatcagttggatgtcctttcaattcggacactatctacccggtggtagcctcagatcccacaggttaacggctcagcccacaagactgcctcccaattctgatggtaatcacaagcatcaggttgtgacttgggcttctgactaatgggctataaattggagttcctacaacattcttcttaggtttgattaacttgctagcacagctcacagaattcagggaaacactttcacttatggtcattcattattataaaggatattacaaaggatacagatgaacagcctgaggtaagagatgcatagggtgacacagaattcagggaaacactttcacttatggtcatttattataaaggatattacaaaggatacagatgaacagcctgaggtaagagatgcatagggtgagacaggcaggaaggggcatggagcttccgtggcctccccaagcatgccaccatccagaaacctctgcatattcagctatccaggagctacccaatcattttggatttttatggaggcatcattacatgggcttgattgattacatcccccataagtggggagtggagatgaaagttctaactctttaattacttcttcagtttccctggaaaccagcccccatcctgaggctacccaggagcccccagccaccagtcatttcctttgcatacaaaaagacacttgtcactttggagattccaagagttttaggagctatgtgctagaaaacaagaggaatgccaaatgtatttatcttattataaatcaccatattaagttaggctatgtgtgtatttgtttgcaacacaaaacatttttcttaatatgagttacattcaaaaaatgtttgcaagcccctgacctgtatgatctggcccatgactacctctctgatcttttctaaaaccacactataccttgttcactgtgctacaacctcactaacattcactctagccctcaggcaggcaagctcacccctgcctcaggacctttgcatacattattctctctacttggaataatttatccttagacattttgtatgtatgcttctttcttaccattcatatctcaattcaagtattacctcctgctaggcatcttatctctaaagtaacaccttccgtactgttcatctcaccacagctatcttatcaccctgtttcagcttcttcttagcactgtacccatctcatctcattcatttacgtttttgtgtgtgcctttattttctacgtatttctcttagaatgtaaacctccacgagttcagggaccacatttctctggtttactactctatctttagtgcaaagaataatgtttatcacacaacaggtgctcagtaagtatttgttgaatgaataaagaaaactgaagacataattcccctctgttaaggtataatgggaaacctttggtctctcctgggcttctcagggccccgtgtagaaaagtcaaggctgtagaattagtattcaaaactcctccctttggctttgtgttcagtccaagagaccattcatttcagcacattaaactgttaattatggagtctggcttctcctttctttatgtggaaagaataaatagttattactaaatagtcatttaataggcagtggtttctttcagggcaaccattattaaaattgcacaaacatgtacataaataaagccatttacttaaaattaggacagactgacttaatggattccacttttcttactgtcctgggtactacctgcttggaatacacagtccttttttgtccttcctctcactttatttcctagctcttgccaatatgtacaccgttgatatatgactatttattcatggtaatttatttccaagactttttttttttctggggttactgatttagttaatagtatttaaaacacaaagtaattttttttggctggggagagatagccaaattgataattttatattatgtatgtcgtatgagtatggctttccctgaattttcactgcagatagacagacagaacattggtaagaaataggaacaccagactagaagtcagttatttaacgttccagtcccacctctcaccttaaccagctgaaatatttggataagtcatttaaattccctgagccttgggtttctcatttgtacaataagagggccagtttaggctttaaaaattcctgttatgtattcagacttattacattcaaagaactattataaattatcagttaatctttgcaaaaaacttacaaagtcggtactattatttctcctattttacatatgaggagaatgaggcagagagaataaataatacacattttaagtggtggagatggtttgaatctaggtagtctaaagccagaattcaaactcttattcttcttactgtaggatctctgttcctatttatctctgagagttaaatttatagctgggcatggtggctcatgtctgtaatcccagcactttgggaggccgaggtgggtggatcccttgaggtcaggagttcgagaccagcctaatatggtgaaaccccgtctctactaaaaatacaaagaaattagctaggcacagtggcatgcgcctgtagtcccagctacagtgagccgggatcacaccgctgcactccagcctgggcgacaaagcgagactctatctcaaaaatagtaataataatttaaaaaagagttaaatttataggttgtgaatccttggatctcatgttgttatagtaggtagatagtcaggcatgagtaggggaggtgaggcttcccctcatcccactaggaatgtcaggcaaccatcaggtgatggtcatgcagttgtcacgctgcctctctaaaataataattggtcgcagccagcaccaggaaaggcaggttccatatagatagaaaaagcacctgaaactggttatcatcagtctcctgatgagatctcaggatttgggcaaatgggctcaaacatgtgcattaagaggcaaaatggcagagtttcactggtatgtccatctgggggcgttccaccagtaaagggaagaatgagtcaggtgagcataagtacaactctagtaaacacactgcccatgctcacctcccaagtgctagcaggccattgtgtatgtgcgcagctcaccccaagggaagaagcaagggaaaagggatgtaagacaccagaaacatgccagcatagaaaaccctaagtccaaggtcaaatagggcacttgtcctctgagatgccctcttggccctcttccaagggtactttgctttctttgaattcatttgctttatttgaattctttcttctgaagagggaagaatcgaggttgctgaaaacccgtaaggattcacagccggtaacttgggtacccgccacagctaacatattttgttgccatgtgactccaataacttcaacctatagcaatgttagcttgtctgtatcttatttcaccagcaggctggaaactacttaagtgtaaagacgatgttcatctttgaataacctgagacaattagctccaggccttgcatgcagtaggcattcaatatttacttttaaaatgatgaggagttgggatggattcatgcaacaattttgacattaaccaggtgaaatctaaggtcctttctgagagtgtgtgattcaggcattgactgaatactcttcttgaaggagttggctgtgtctgcacagattcacctctgatttgctcctcaacttaatgcaatctggttttcagccccactgatgccactgaatctctgcttgccaaagtcaacaacacacttcgaaaggcatttcttgtcctaacctattgcatctcctgagaacatctaatattgttaactatcccctcttccttaaagcgctcatttcccttgaactggataacacagtgctgctgacttctctccatccacctctcagggtgctatgctttgtcttcattttaggatctgctttccttacctagatctacaatgttgggatctcccaagggtctgtcactggtccttctcttctcgctttccacactatactccttgggctttcccacacatatgctaaggatttttgaatctatagctccagcccagatctttctgttgagcttcagacttggtatagtggtaaaaagtgataacttactttaaaatacttccatatgaacagtatatatatgtagagtatattagtcagcatttgaaatatctaaatctggaatccacactctaggaatggataggaatttgcagtacctaatcagggatccatattcagagatggcttcaaaactgcttcatactgtgttaatagtctctcccagaaggccaaattagacagcaattttagacataatttttcgtttgtggatgagtgatacatgaactatatgtttggctataggaagggggtgtaaagacccaggaagcccagcagcctatgcctttgaagcaccactcagcgcctggcttcctgattctgtgtctctctcttcacaaagaactctgctacctgtggttgattggtcccaccacacgcaaagctcaaggctcactgtatcttgaacatctattggatagcaccttacacatcaagttcaacaggtccaaaatggaactgatcctctttgcacaaaattgatcctccttctatgttcttttatacagtaaatggatctacactcactcaatgggccaagccagaaatctggacattagtcttaacttctcccattctcatcatatccacagtcagtcaattaccaaattccatcaacatcatcacctaagtcattctcaaattcacccatttctctcccactccacaggcacctcccaaacctagggcaccagttcctctctcctgtccccagctggaccccttctactctattctttatacatcagccagagtgactcaggaaatggaaatctgtagtttaattaatatattgtagttacttataggaaaaaaaaggctgatagagaaaatatctaacaactattaaatagtataggtagcaacaagtcaaaagaaatgccaaaccacttacagtgaaaaatagttagaaaacaacacgttaaacaagccaggttattgctgcaattatcctaactttgttatgttgtagattgggcatatcactgttaacctttgtttcctctatgccaagtaatgcttgacagacagcaggctcttactgaaaaaaatgaaagaacatgaatgggaaaacattcaatcaatcaaccttttttttctccccccaacttccactcccagttttcctcttaaggaaggagtatgcctcaaaccaagaaactgagaagtttccctaaatcctattgattggtaccctggacttggaagcaactgacttcttgattttctaccagggtttagttaactccacatagtatactctatgagacgtatcattgctataaggttaatgatagttatagggcccagtcaaacatctcacagggcctatattctgtgtcacttagcagtatgatgcatcttggcccagggatttgcaaccttggcctgggaatttccaggagacaagactacctcagcacagatgcagttctcataaaccttaaaacaaagcttagcgttacaagaatagcttaaactccctttgtgaaagaaacaccttgtaactgacccagaaggaatacaggtataaggaaaggggaagaatccccaaaactctaagaatggtctctggatggaaactctcctggtcaatgggtcacctgcccctcaggctgtgccaggcccatgccaccacctgctcccgctacctgtcttttaagggttctgccagaataaactgcgtgagcatcagatgctgcctaagactcagctttgatgggaatcaaaccaatggaaagaagtttcccctagaaaagctggttacctagagtcacccaagacccccaagactgacagtccagctcaacaaatgttcattgacaatctttagcaattataatgatgaatgagtcataccctctttctcttgtaaaggtcactgtattttggtggaaataaacatgcgtttgagtcatttaagtaaataaatgttgaagctgtgttatccaacaggcagagtaaactcatatttaggatatcagcatagcaggacactgaggacatcaagaaaaatttagaagagttcgacagaattgatataaaaaaccaaagcaatcaccaatggacaagttcagagctttacgatctccttacccttatgttataatttaatatgatttttattatgtggggttacacaatagtttggtctccccaataaaagggacctcttaaatcttaatctattcctaataagtgctaaaatagatacataaatagggtgcttgggagcacgcaggaggacaattaaataggctaaggcaggggagagtagggaacaggcgaggagaaggcagcgtcaaaaggagggatgcctgagctaagtctaaaggggcaaattaaccaggtgaaggtttgggaagctaggagaggtatactgttcctctggtgggacccactcacccctctgagctagacctcccaatacttcctgctagcctagaccatcatctgttagctccctattatctattacatctgccccattgaaccttgactctgtgaaattctgagtctgtacctcccaagaggtctacctagctgcaagctccatgcttggtcgtatctcaacactcaagaatcacaacatatttattccattccaataaggctaatttgctcatggtttctatttttgtttttccttcagtgatcacctacacttctgttagtcattaaacaaatggcagctggcatcatcgccaactttcaaaaccttattcaaaagtgatcttctataggaaatctttcgagtggttagatacccacatggaaagggcttccttctcatgaaaagcaaccaatgcactttgtttagcattgtgtattcataaatatttatccattaaaaacaggcatctgtatggcaagtcccacaaggatgatttaaccaagactgcaaactcctcagctgaccacatcccatctctctttgcttcacatcatcctgctagcccctcaaatgcttggccggccaacaaccatactgtacagtcaaaaagattcatcaagtcctcacttagtttttattcaaccttattccatcacaatttctcaccaacatcagattaccggtgaaaatttgatcagagagactgaggtaagagagactcaaattatttaaatctctcaatggaagttaatagttttgaagaattagagcatttcatatgggagcaatgtcaaaataggtgacctagaactgaagtagttttccccagactctgcagttactgaattgactccccaggctgctcatattttccggctatttctgaaaagaaaaatatacaaatgcaatacccctttttttccccaaaggtctttgcttccctataaatactaaagtgtgctccttaacccacttatcctgtgagatgcctaaaaatggcctcttggatgaaataacttcaggaaacaccgtagagtatagccctggtttgaaaattcactatgaacactaacgtgttaaagaccctattacttctgtaaatagcctagttttacttcgttaactcttcctttcacaagtgtatttgggcacagatcaagtttccccttcccgcaatattatcaacaccactccatacaaaggagagttggaaacagccatgttactcctccactgaattcacacacacacggatataagtcttgtgtagtctgaggtgttcatttcaaccctggatagtaattcaaagtagcaaacagctttttgatgtttgctttgtttggttgcagaaaataagctcagggtagacagttcttcaatgacagttctttacttgcataaagctagtatggattatcccaacttttataatgacagtagttaccactgggatgcaaaagaagcaaaaagaaaaataggagttctaaggggcaggagtattagcattgcactataatgctgcagtctaagcaggcattccattactgggtcgatggtgaatacgaagtggaggttcaatcactacacacacttactcaatagtctcctctaaaaaaggcagtaaatgtcttgtttttggctcagatgaaggcctatcaaccgtcagaagtgcaggcttccacacagagattcagagcagcactacagccgctcagcatgtgaatcccaagaggcaggtgatttagtcaataggccccagagcagctattttaaacacagggcctgttctctttaaaggtacaggatttatttatttgtgggccatttaaaatttcctgctttcaccggcttttgatctggactcaggtattatatcttgtcctattttccaacatgtaacaattccttacaattataatattcacccatccatccatttggctaacattattgacaacctattatgtaccaagcactgctctgttttttttttattgcatgtaaaaatgatggtgatattataatgaatgaaataagcatttgtttttgcaatccaagtaaaatttacctgtattgaagaatgtagaggatcttgtcaggaaactaacgacactgccacatgaaggaaatcaaataaagccgggcgcggtggctcacgcctgtaatcccagcactttgggaggccaaggtgggcggatcacctgaggctgggagttcgagaccagtctgaccaacatggagaaaccccctctctactaaaaatacaaaattagccgggcatggtggcacatgcctgtaatcccagctacgagggaggctgaggcaggagaatcgcttgaacctgggaggtggaggttgtggtgagccaagatcatgccattgcactccagcctgggcaacaagagtgaaactcagtttcaaaaaaaaaaaaaaaaaaaaaatcaaataagagaaaggtgctgtgctttttgtaggtcagtgtttttcacaagacaccgatattgaaatccctggaagtacctatttaaaatgcagattctgctgggtgtggcagctcccatcggtaatcccagcactttgggaggccgaggtgggaggattgcttgagcccaggaattggagaacagcctgggcaagatagagagacccagtctctaccaaaaaaaaaaaaaaaaaaatcagccaggcatgctcacacctgcagtcccagctacacaggaggttgaagtgggaggatctgcttgagccagggaggtcaaggctgtagtggttgcaccactgcattcatacctggcaacagagcaagaccctgactcaaaaacaacaacaacaaaaaataccaaacatttggccaggtgaggtggctcatgcctgtaatcccagcactttgggaggccaaggcagtaggatggcttgaacccagaagttccagaccagtcgggcaacataagacctcatttaaaaaaaaaagagacaaagaaagaaaaaaaagtcagaatccaggaatctggatttttagcagtactctggatgttctttgtgcatccgtagtgccatatccatccctgtcatgaaggaggagaaaagaggcacacattctctccaatagaaacacctccacattcatgtcttttatttattgggtttcctgtatgacgtcttcaaaaaaaaaggatgcaagaaaaatatcacttcttttaagtgtagcacattagaaagtcacacctatgagactctttagctgcctcatcattgtattttaaatgtggcctcacagagaaaccatggattttagaatcgggaagatacacctccaccacttattagttatgtaaatttaacaagctaatttgtctgtgtgagtcttgattttctcagctataaaatggggacaatagcaaaaaataatgataagataatcagattaaaagatatatcatagagatatatatatattatcttttaatatatattaaaagatatattaaaagatatatctgtaatagagatattacagatatattatagatatagatataatagatatatgacagatatattatagacaaacacctggcaaatgagtgggcttacactgggtactccccaaaatttacccccaccccttccaaattctgccaaattttatagagtagctatataaaaattatttttatgtgttttcttaaatgctcttcttaagacattggcccttatgttgtaggaaacacctcgatgccaggttgaagttcaatacttacgttaacacattatctttctattttatatcaatgggagttatttaaaccaccatatttcttttcagcttaaattatcagaaaatttagatgtgaaattaatgctcaaaataaaaaagtgtttctcctctctatattacttatggttattcttaaaaacaaatcacccatttacttattcaacaaatcattttggccatccaataaatttattgagagggtatatcctcaagaggaagagctaagtcttatgcctgcatgtaatacactttatttattaactgagtgatgatggacaagctatttcttagcctcaaactcctcaaatgttaaattaggctaataatagtatctcgcaagattgttgcggggattacataaatcatgtacttagaacaatacctggcatttggcatgcactatagcaatgttatttagtattatttaccaaagaatagttactgaagatacacagtaaaaaagcatcttaaaaaggtaaaaagagtatataaacttacctaagtggaagttaagtgtagcataaagtatatcttataaatgaataatggagtaaatgaaattcttattcatctcatctaatgcaagaaaactcaactaccaacattatggaattttgatttgatatcactcctaactctattttcactctccctgaaggtgttcctcattttccctccttgagtctgtctatatgcaagaatggatgagcaatcagaaatgtgtgctcactgatatgtggatatagacctctgaagcatctaccccattctaagatggtccctgctcaaagggatcatgctgaagaaaggtgacccttccagctcaggtttgctctgatctccgtagcataagcaacacaaataaagaaactatagtcataggactttcgttaaatgcttagttgaagatctcaatttctgtttgcttctccttagccatattccaagttcattaccattaaaaataaaacaacatgtaatcttaatatatacaattagcaacactgtgtgctcaacgtgtctttcttaagttcttgcagacttctttcttttctcctaagaaaccccatctctttagatgagcccaactattcacactctttcctctcgctcctcaaattataatcaccgtcacatcaaagacccactaaaaggcactcactgaagcttttaaattaaggtacttgaatgacttagaaataggaatcacaaaacaaatctatttacatgcatttgtgcagaacattcctaaatgttcaggtgacactgacctactaggccctttagctcgctatgtgaggaaataagatagaatcttcaaagaagtttggttgtcaagaagcctctgggaccagtgaaacaaataattaacttatagtggaaagagaggacaagaaatgtttccctctgggcctgaaatacagtgtgctctactttgcataagttaacatcgggaggtttgaattttccaaagggcttagtggctaattagctgtgtgaagttgcccatagtgtgtccttaagactaaacattcccatttctcataaaaagctgtaatagttacatgaagcaaaagaaattatctctactatgtgtttggggtttgtctttcttgtggcctcctttttacttctattacaacacttacgacacagtactatgaagatcaactctctcttccccactacaatggaagctttcgaagtataaggattgtgtctgacttaactctgtattccatgctcctagcttgacatttagtaggctctgtattccatgctcctagcctgacatttagtaggctctgtattccatgatcctagcttgacatgtagtaggcattcaatcaataatcagtgtttttcagataagtgggctagtatgaagaccaccgagagctatccttccagggctttaaacacctctatactcagctagtagaacattcaagtaaaatacagaaacctactgaataatgagatttttttttttttgagatggagtctcaatctgttgcccaggctggaatgcactggcacgatctcggctcactgcaacctctgcctcccgtgttccagtgattctcctgcctcagcctcctgactagctgggactacaggtgtgtgccaccccagctaattttttatttttaatagagatggggtttcaccatgttggccaggctggtctcgaactcctgacctcaggtgatccacctgcctcggcctcccaaagtgctgggattacaggcatgagccactgcacccggcctacaatgagatattttctaagaataatacctgcaagtagattaattattataggcataattttaatcagaacaataaaaatttatgttttctaactagtttcgggcctaatagtttagatgcataaggaattgctcccatctgaatgtagacagagagtatgtgatgggctgagtccaagaaaatgaaaccataaaaccaaagtcctacatttaaaattttaaaaagcagcaagacagaatggaagacagcgactgaaacacatgagttttcctgctgaccacaagcaccctagcagtcagaagtgggatgaaagctaataacacaatactcagctgcattaattcagtgggtcagtatttttatcagagagagtaaactttactttgcttttgggttctatccataaattgtgtgtgtgtgtgtatatatatatatatatataaaatattgtgtatatataatattacgtgtataatcatgttttaaagacctatatttagttgcactaaataatcaaagctaaggaaatctggatcttgtgaatttcctctagcttcttctccttattctgctctatgatagctcacaaccatagctaaaacatcctgagcatcttctatcagcagtcaggtactacagtaatacattacctatattcactcatttaagatttacaacaactattattactctctttactgcagatgaggaaacagaagcaccataaaactggggaaccagtccaaggtcaaaaagtttatgagtggaggagctgagcttgatcaagggagtgtggcatctgagtctgaatcctgatccctgtctcacatcatcttttctcgagacagacttggaaatggaagacagagggaagcagtgtagtttattttagtcttggtgagtgggagaaagatgtttaaaatatggatgcagcttagacgttgatatagtttggatgttgtccctgcccaaatctcatgatgaaatgtgctctccagtgttggaggcggggcctgttgggaggtgaccggatcatgagggtggatttctcgtgagtggcttagtatcatccccttggtactgttgttgcaataggaagggagttctcatgagatttggttgtttgtttaaaagtgtgtagcacctccccctcctcttgctcctgcttttcacctgtgtgtgtctgttccccttttgccttctgccatgactggaagctccctgaagactccccagaagcagatgcctccatgcttcctctacagcctgcagaaccgtgagccaattaaatctcttttctttacaaattactcagtctcaggtatttctttacagcaagaatgtcctatagagatgtggatacttttttcccccaatcttggccactatcatgtcctttaagttatcagagatatataggtgtgttttcaaaccagtagtgtatttttgtataaataagaaattagcaattgattctcacttattccatttctccagagatacaatgctgacacatcccgaatttaaaagcattttaccacctagtggtgggtaccttgagaaactgccagatactccaatagctcagagcaataaagaagaacgggggaaaatttgctaacataaattttaagtggaaccatttacatcttggtaaatcttccctatatgtcaataaaagaaaaataaaagcattatattaataataatcataatgagaagaaattatacagtgatatcaatttccttggggagggtggatagtagtataacacgcttctcatttatttaatttttcatatgtggctttttgtactactgaaatggtaaaccatccatgagggtgtggctgaaagggatgtttagtttatgtacaaaaatgcaggagaagcacacccctagtccttcactgacatatttccgaaacatcagaaaatattctaatcaaaaccgctgttgattggaacaggataatagaaaattcaattgaaacaaaagtaaatgaaagaagaaaaacaatcggagtctctattaaagaagaatttatatgtcatgaattccttctattttactgggtaccttatttgatcatttaatacttgcaacaatgttgtgagaaaggtattggtatcctcattttactgatgagaaaattgggtttcagatactgtaggtgctcaatgtcacacacaagttaggcaggtttcaaagaggttcagatgacaaagcctctgcctaggatgacacctcatctaagaaggacagcagtcacctgctcacagggaggtgatccacacttgtgctctgatgccaagtgtcaggtggacagaggtgaagagacataacatctggaaacatgagtagaagaaagctcaccaggagcagcagagctggttattttcgtgaaagataaattgatgggttgcttgctgatagcttgcagtgctattccagataggctggtaacccaaataacttgtggaattctccacagctgaggagaaatggaaaaaaaaaaaaaaaagcactagccaagaagtcattcgattatgctaaacaaaatcaattcatttatgacttttcactttcgtaaggtggggaatgagtggtttcttaacgttcatccagcaattgttttctagcctcattgcacgactgctttttaagttcaccttgacctaaaggcaaccttacaaaatgctttgcaaagttgtggaaatgttgcattccacatggttgtgaatagaaagagcttcttgaggccttgattagagctgggtggagctaagcctgaaacagatgatggctacactacactgcaggcccagctgccctgcccatgggcacaacagcaaacccagagacagtgcagggaggctgggaatgggtcaagtttaaattaggcacaggatttggcaagccactacataaaaatacaacagcccaacagaaggccacgtttgggtagccagccgtcgtcaagtgcaatgtgggaggcgccctgtctggaagagaaaatgggaaagaatccaccataagaacatgactcaaagaggtcagtgatgggcataaaaatatgtccattgcttctcagaaatcttgccaagaggactggatttctaataccagcaagcaccaagaaacagaataagaagaactagattgtcctcctttttctgatgtttactaaacctctattttctaactatattggtggcaggtagcattttctataaaaacctagctttctctggtacttttactttttttctgcctctatagaaatttcaccttagtttatagctggaggaacatactcttcatttaattttcctatctgccttgctgggcaggtggttttggactgaactgattacattttaggtaacaggatatttctcagagacagcatgtcttgctgggtattttgggattcatggaaaataaaaagaaaaaatgaaaagaaatccattcacctttcatggcagtgatttagtagacattctgtggtctctattaggaactgacccgaatagaaagctagattagcctaaaaaaataaaaaaatgtagaatctggtttacaaaactccttagtttctgtttttatgccttagagaacatgtatgagttcaaatataattacaaataagtaaaaatatgtcaggcctatgtttaagtgttttttttttttttgtatttactagcagtgatgtttttgtcaaaacatttttattctctgatctttagtcactttactgtaaaatgaagatgaagtcagctctgcttatctcacaagtcttttgaaagactccaataaaacactgtgtagaatcttcgttaagccttaggtgttcagttaattttaaggtataattttactatctctacaaaaaaatttaaaaaaaattagctgggcatggtggtatgtgcctgtagacccagctacttgggaggctgagatgggaggatcccttgggcccaggagttcaaggctgtagtgagctatgatcacactattgcactccagcctgacagatgacagagtgagaccctgtcaaaaaaaaaaaaaaaaaaaaacaagaaagaaagaagaggaaagaatatactatgtgatagttgttaattagaattttattttgtcttattgaaaaatttcttctcactttgaaatttactagagtaagttggaattattagtttttcagaaacagagagagctggaaagccatctttatgacatccctcattacagaccaaccaccaagtgatctaactggtacatataccttgaaagacatctgataaacacagagcacacctgatgagttaagccaggtggaggtaaaagctacatttttcattaaaataccacagtgctggaaatttctaaaagaccttgagtggtgatagttgtaggggatgccctggccaaagtggcctgtggcgttgcatgctcccacaaaagccatgtaggcaagactcaatggcgttggaaccgtgtctgggcagaatgctctgttttcctttctggaacatggcatgatgagcaagctatccacggctgtcgcaggccatttcacatccacctccctatcttgcaggaggctctgtgtcctgccgaaggttgtcatgaggctctttcccatcaacctacctggtaccagtgaggcatggaattttccccctcgcccttcttggatacagctgcggaccgtaaaaccattcagctctagtatgaaattgacttctcaactacagagtggctcactccctgtgatgcgtgttttccggtccctccaggttgatggtgtcctgtggggacagggatgagaccctgaagaagtatatgctgggttactgaagctgaatcaatgcttttctccaggtgtgtgtatttatgcacctgtcttttctcgaggggactccctaagctcccagccaggtaatatgcacacgatagcaccagaggcaggatggagaaaggaggtcaagctctccaagttcagtaatataggcatgtatttacatgccttttctatcccaggtcttgccactgtctggtgttctcaagtcaggagcttctcagtattttcaaataataaacctctgtggcctccctgggaggctgcatggagtaggggaagaccctggagatctagcttcctctagatccattcttacaataaatccatctctttccagccctgttcctcaatctcatttctcatggtgctgagttccatggggcaaactggttcattaatcacaggtatctccatgttgagagctgggttgtagctctatcctttctgctaaggcaattactgctcttccatcacttcccttcctttattccaaaaaaaaccccacatctttcattcattatttccttctgtcctgttctccttgtccttgtggattaccacctttcgaacatttctttattgcagcttctattggtttggggaagaacgggagactaactctactggccagttttccatctgtaatgataaattcccagcacaggtgggtggaatatgcatccttcttgtattcttagtgcatttcacagaacctgactacagaaggtgctcaaaaaaaaatcagtattgaagaggtggctacatacaacaaatgtacactttggctacaaagttagataaactagcttgttcagcaaacattttcagagtatagtattctatactaggacccttgacactggatgccagggcagataaaacacaattcttattctttattgtcagtaatgtggtgaaagtcccttggaatcgggtgaatctgcaaaatttcagtgggaacaagagcatgcaccacccaggcttatgtcctagtctttccagggtctgggagtaagaaaaagatacagaaacctgattacagtcatacagttaataagttaacagacaacaccctgtggaattaattcacctttcaatattcattataaatgccgtcttccttctttgaatctctgcaattgtggcaagccaagtttatgccgtaccttagcgataaaagtagagatgattaactgtctttctgtctttgtctcttcgttcctttttttttttttttgatagagtcttgctttgttgcccaggctggagtgcagtggcacgatctcagctcaccgtaacctccgcctcccaggttcaagtgattctcgtgcctcagactctcgagtagctgagattacaggcatgtgccaccaggcctggctaatttttgtatttttagtagagatggggttttgccatgttggccaggctggcaaactcctgacctgaagtgacccacccatctcagcccctcaaagtgctgggattacaggcttgagccatcatgccctcctgtctcttagtttgttttaattttaagaggaacaatggtgctttgttttggtttatgccacccaaagaaatagaagtatgcaactttaaaagaaaattttcagccaagggtaaaaacataaaaataaaaataaccaaattggtgtcagatgcaaagaatcccttgaaaattggtgaggattgaggaatagagaaggatactgaagagggatctattattcaaaactcaattaccagaaacccaagttaaactaaaggaagtgggaatttaatgtctcagtagctgcaaagcttcaggtacagctggagccaggtattcaaacgcaattgttaggttcttccctcttctgtactggcttcacgttcagacagatttcattctcgtgtttacacctaacagcttagcaatcagtgcagaaatattctctttccccaacagttctagcgaaagtactggccacaagtctctgacttgccaaacctgagtcacattcctcctcctcaccctcactccagaggactgggttgccctgctcaaaccatatgaaccgagagtcaggtcaggttgttacacaaaggaaatccaaggaaatgttgccaggaaaaggggagaaggcttttaagccagtatatgcggtagctacaattagtgtaagataatactggccctggagttttggctgcatcaccacttaaaaaaaaatttaagttttgaattaagccaaattgcttagcacagaaggctggtttggagtgtagctatttttgaattatttactgagcttcccactgcatttgccccccacaactcttagcatccatctcttgctaaaaggccacctgaccagaatgttaagagaaatatccaatagcctctacagaaagagtagaatatttatttttagctttatgatatttgttcttaaatgcttttcagcctggaatgacttcaatgagatttgtacatttaaaggctgccaaaaaaagaagggggaaaagtcgaatattaaagaaaatctcactcacatccaaaagtggaagattctttaaacttttaaagaaaatgttagttctatttttaactcacttttgggttgtctaaggcttaagactaacataagaagaaataggtcgagcaacaaaaacttgaaaaccaaaagattttatacttgggaattaaccttttattaaccctaaccctaacccccttttgacgaggagaaaaagagagagaaaggagacccttctatgtgcaattcagggttcagtcatctcagaattttccatatacaggccctagatcaggggtgtccagtattttggcttccctgagccacattggaagaagaagaattgtcttgggccatacataaatcacactaacactaacgatacctgataagaaaaaaaaatgcaaaaacgtctcatcatgttttaagaaagtttacaaatgtgtgttgggccacattcaaagtcattctgggccacatgcagcctgtgggccatgggttggacaagcttgccctagatgatttttctaaaaggaaatttgttctgaaagacagtagtcagtatacctttacacaatttcatgaagatgtctgggttatgagaattgtcctactaggaagagctaccaaaatagctcatcaccttgaggtactgtggagtgaaagtgaccaggtgctttacatcaagtttacaccaagctttactttccaaactttttaaactgtcagtacaactccttttgaacatatcttctaggttggctcttggagtgatacatccatcaccccattctactccaaattcatttgaaattggcaattttcaggttccaacttgcgatggcttaacactccaggcctccctaagatggcactgaacatagggcagccctcctggaggaccccacagagaggccatggagcatgagagtgagctgtacctggcatgatgtatgcaacgtggcttattctctttgattcaggttttacgtttctcgaatggagcctcttctaggttgctatccatttacctccccatctctctctctctttgccttttcctggttgagtccttcccgggttaacccagccctcctgatggcttcccttcactttgaaatccacagacaggaacaactctacatttaatgataaactgtcttacattcctccctaattagttcaaattgaaagtttgctctcacatttggaattttagtatggctatgataaatacttgtgggctcctcactcggagcaatctctgaacagacgatctgaagctagatatacaacattctcatatagtgttcagtgtgaatcaatatcaaagtttaaattcccagtgatattaatgaaagaggtgagaatttgttgctcatatcaataagaattagacctaaaatcacactagtgatctttggacttaatttagtgttcattcatttagatacaaactgagtgtatagtttctgtttaaaggaagagtattttgtccgtgatcaccggtgcacccaatggccaattgatttctgtttacattctgataattctttgcttatcagatcatttcacatgagaatcaagccctctgcaataagcagtgggaaaaattttagtcggtgagaaactccaacgcctcaaaagaaagagtgtaactttcaaaactgtcatttttgttctcatggtaaaaatctgactttgtgtcaatcattccccaaatcttcagttgaggaaagaggtcatgctctacattaattacagatgacaagctagagacaaaactaaaagtccaaccttataacttcgcttttctgcctctccctggtcaaaacaaaccctcttataccaactattcttttttatcacttgagtgctatgtacagggtaaaagtaggattacctcagaataataatttcacacataatttttgtaagaaaagggttcatgataatacttttaaaaataaacagctagcccaaatattcctccataacaaaatgtgacaaaaggaagttagaacaaaatcttaatttacacagaaagtaaaactgtttccctgtaaacaagctgggctgtcatgaaaatggataagggttcacagaaatttgacccaaagaataaagaatgaacggatgacacaaaaatggctaactggataaaaatatgttctgtgtgattaataataagtctccaaatcacagtacttggagagaagggatgggcatactactgtggaattctggatgtgtcaagatctggcctgggttctgggaacactggatctctttgttcctctctctgctgttcagggacagtggaaggggaggaaaaagggatcgtggtccagtgtacgtggctcagggactgggcctctggaagccacagggaccagcgatagtcacacttcttcagccctccagcgattgctctctgtttctgttctgttttcacactgttatccttcagcacagctctgtgcgctgtttgcctctcctccactggtggctgctctctgctaaataagcatgccacttgttcactgggtaaagtgaaaaagacgttgcttgtaaaataattgagtctccaaaaaaagaaaaagaaagcgtctggatcactatccgtgtcacccctaccctgagaagtctcttaccggggtgacttttcttcaaagaaagcattttccaaactaagtgcagaatgaagcaaaaaacaggaaagaactcagattattttatgacgtcacatgatgctgaattacagggtggaaagaaacagaaacacagaccactgacttattggagagagagagatatatataccatgtatacgtaatattatatgtcatataaaatatatttaattacatataatatatatttatagatctccatggcctgtgcttctatggaatcaaattgttgtgtatgcatctatgggcatatacagaaatattatatattaatatataaataatatatatgttgtttagatggagagagatcagaggagcactgaccatggaaatatagataatatacaatatatataaaaacatataacatatttttcctgtgatatgtgcttctggtctctgtgtgtgtgtgtgtgtgtgtgtgtgtgtgtgtgtgtgtgtgtggcataaactgatactacaaaagcacagatcaccaaaatagtatatataaaatatatatacagcatattatgtattatataatatgtggtctgtggtcctagatatctatacacacataatgcacacacacacgtaagttatgtgtgtgtgtgtgtgtatatacacatacatatacatatcctaatctggtagcacttttgttgttgttgtttagattcagggggtacatgtgcaggtgatctgtattatttattcttccttgttccatatatattagattaaccaagatttaaatatcagctctattactaacagtaacacctggaccaagttatttaacttctgtttacttataagaccataaatatataaattaatacatttaaggaatacttactgaatgctggtagagtatgagcacttaataaatgctagtagttgctgacagcacttatgaccaaaacactttcacaatcatatatgcatcagagccagggctgccgtttaaaatataatgttctcatttgcaacgggagaaatggcacgaaaatccaggcccctctaccaccggtatgtactctttccactactcagacagaggaatacttacatttgaatgagaatatccaatcttctaaaaattaactgtaaaccaaacgacaaaatttaaatggagagtgtttggggggctctggaggaatttgaaacttgtatttaatttcctggctcttcatcctgaaatgcgtctaagctagtaacagacagcaaaaccgagttcctatctctctagtgttccctgctgagataaaagcgatgtgcagcaccggatgccaacagagcaaataattacactgagtgctctttccacagccaatgaatcggaaagtgaaatttttgtggatgcacctgagtgctggggacatcagctgtcctatgagaagtcattaacattttctgaatgtctactgtgtgccaaacactgattactaaagaggacgcaaattgaaatgagagattattcttgtactccaggtgcttaaagccgttattaaggatcatatcacatgtccatcgagaataaaatgtcaggtaagaaaaattccatgaagaagaacagagtgctaggaaaatgcaagaaaaggaatgattaatgccagctagcttggggagggggctatgatgagagaaaggctaaggacagggacagtgagacagggacagttctctctcctagaattattaggaggtaaaaatttggagctcttctacttatgattaaacagaaagaggcatgaggagaaaaccaaatgatgtcatcagaataaaaaggcactgcaaaacagtagattatacatgcaccttgaatgtgctgtctgataaatcagcattttacaaaaacacatccggactagcaattcagaagaaagcaatgttaatgcattaattcaaagagagcaagccatccccaccctcaccccataggcttttatttatttatttatttatttattttagcagcctataatctctaggatttaaaaaaataactcaccaatgaacagaattaaacttctcaggtctgttgctttaaagaatagccaatatttgtgagaaacaatttcaagagaagattactacaaaatgaaaatgtaatatgtctgcatcagttaaatctcccaaaacaaatttgcaatattgcctctgactttgacgattttattctttcagtaacagtccagatggcatccaatgagtattgacatcatcatcataaaaaaaggctaagaaagtcaaaatgggatttatttaggacaaaaattaatatcaatagataatgatcttaaatttaaaggatgaggcatgaaaaaaacaattaataaaccttttatcttcctggaagatttccatttgatatgtatagtcatttgttgtgaggaatagaaaaaaaaaaagacacattaaagagtgtaaaaggctataaggtaccttgagaatgtagaaaataattattatttaatgaaagtgatagctaagaattcaaaaaataccctttggctatctgataagaaaacctatgccgatactatagcaaatctaacataagtaattttttggccttgcaatagattaactacctaggacgtaagaaaatgtctaaatctgggcttaatccaagcctctggaggtggtaataaagtcattaataataatggtaaaaactataataatcttttcagtttttgctcaccttctatgtgttccatacaccagttagaaatactgaattgtccagtgacatcaccataaaaaataaggataaagtccaaatataccatttttttcttgttcatctgttgtgtatgcgttatccagagtcactcttttagaaccatatatatttttaacacatgactggtaacaagttctaccttttaattacataggctaagtaaattactaacatctcttttatgtctgaaagcttccttttcaaggaatgccttcttatggaacctctcaagctctgtgaagtctgcctgaagactggatttaaaaatagcataaaatggtcctaatttaatttatggcctgaggagcccatattcacgtggtttcgaatatgggtaggattgttttctttttctgtccaatatcctcccacctcactcaagaccttacgtggtcttattgatcacgggagcacactggagcggtgactttatgaactaggctatccgtgacccttgggtccctttaatgggccttaactgttagtgctgaacctgccctcccaaaagtcacctttgcattatttttcataaatgtattattttctatgtgggtcaactggatctctcttgataactttctgttcttcacatatctcaatgttctcatctttttttctttcttggcttagatgcccactttttagtacagtctgacataatctgcaagtttgaaaattccagatgcctataaagataacatttaaatgctagctaagataaaactcaacaccagctgggatcccccaaacttccagaaagttgtttgtttatgcctgcactatgtttgctgccttttatgccactccttaacctgccaaaacagtcccaaacactgccatggagaggcctatttggggtagaaatgtattagaggtttggggaaacactaaataaagtacatcgatttcccctttcctcaaagtcaagaaacaaagttacaatcttagtgaagttcaatatttcttcatagactcttggccttgtgcctgcacaatgaatggatcacgtcaggttcccatgtagggatgagagaacaggaagttcattcctatgattcttggagtctttttcagagagtacttaaggataggcaaacagtattctgtaggcacagtgatatatgttgcagaaaaatgtgcattttggtccatcattaatgatttactgttgagtacagtttacaatcttaagtaaaataattcatctccagagatttatttactgcttttggccacacagcaataaaatgatttggttgtactgagaagaatttccctttaccaaggccatcacagggagaaggtatggtgttccaggtaaaggatagcataatagaaccatttcagtcaatcaacacagttggtagtcagagagaaggcttctttgtagatgttgatagacatatttatgtatttggaaagaattttccctttatggaatagagttattcagaagacaaagggtccagctaagtttgggaataagtcgatacacctgagttacttgcacagaaatatctcaaaggaattattgtaattatgtaattattgtaattcccttgagatattgtaagtcaatggaagctgtgaaggttttattttcccaatccaaaatcacctccagtcccaataatattcactccaaatataaaatggcaaattcacatgttcagaaggcactacacagaagcagcaccacaagcgacagctatctaggaaaagaaaacagtccctgagactagaatatatggctacaaagaaaaccaaagctaaaatcaaagcatttagatattgccaattttgtactgttccttcgaacattctggtgaaaataagtcagagcttgtctttcatcttggtcgtatcagatggatccaaccacatttaaaaacaaatcatttctctaattactgtgatggttactagaggctgggaagggtgaggggtgataaagcgaagttggttaacaggtacaaaaatacagtctgatagaaggagtaagttctagtattcaatagtacattatcgaaattacagttaacaataattgttgtgtatttcaaaatagttagaagagaagaattgtaatgttcctgacacaaagaaaagataaatatttaaagtgatggatatcccaattaccctgacttgatcattacccactttatatatgtatcaatatatcacatgtactgccaaaatatgtacaactatgatataagataagataaattatttctctacaaatacaatgagaactttgtcattgcccagcaggatttagctattagaaaaagaattatattaggctgggtgcagtggctcatgcctgtaatcccagcactttgggaggccaaggcacacgggtcacttgaggtcaggagttcaagaccagcctggccaacatggtgaaaccctgtctctactaaaaatacaaaaattagtcaggtgtggtggtacctgcttgtaatcccagctatttgggaggctgaggcagaaggcttgcttgaatctgggaggcaagaggttgtagtgagccaagatcatgacactgcactccagcctgggcgacagagcgagactctgtctcaaaaaaaaaaaaaaaagaaaaagaaaaagaaacaaaacaaaacaaaacaaaacaaaacaagacaaaaaaaaagaaaagaaaagaaagttttatgtcagagcccaagtggttgagattaacattctttactatttctaaccacttcaaggtgctaatttacaataaggaaagagtaacaaccattaggggaatatagactctttcatagcaaggttaattgaagtgtccatttgactatgtgacatctcactttcccctcttgttccgcagctcgattggctatgtagttattatgtgcaagttgcatagttactcagttctgtcagagaggatgtgtgaagaagatgaaaaagaaaggactagctttttgcaaattggtcatgtctcttgcggatctagttaacatttcctgttttctgcaagaattaatttttttcctaatgaactttaagaactaccaatatttttagtatactctttctttcttatttatttgtacattatctgtttgtatccttgaattttctctgggatgttataaaagaaaaatattacaagcataatttctgacacaatgttttataactgttttcaaaagcaatctatttctctcttaatttctatagaacccattttagtcattcctatgatgaatgaaaaaaaactcacaattagttgtcagtttcagaaaggagtctcagaagcatcttagaaccacctaggcggtcttataggcgtcacagaaaaatattccaccttacttattcttatcttcttcaaactgactccaaatataataagcaggcttaagttatataaggttccttaaaagttgttctcaaaaacaattaaatgcagactgtcctcagtaaaacttgcattggcccagtccattttaccaagtttgctccttcttacatgtacgactgcccctgtgacaagtttaagcctacgttaattaatcatctttccataacactgagacatattcatccaaccctgagagggataaggggtaacaggcaagatatattcaaattgtgacatttaaggtcaacttgactttaaaactcatatactgctcagttttcatatacgtggctgaaaacaagtcatcacagagaactggtcacactgttagaggaccaaaatagtaaaatatgaacaattcttccatatttaatgatattaaatataacaggtcctatgtctatgcaattgaagtcaacatgtcactaattagggcttcctttgttatcaaacttgctgagaagatagaacagtgaggaaaaaatagcaggaattgagctgtacagaattaaagacattcttatgaaccttaagacttaaggtcagtcacactcatatgacatttggactattagacaactcttctgacctcaaattttgctcttaccagttggtgataatcctttggtaagagagcatgttaaaagtaaccaaatcagataaggactagaagtcaaatttcaacagaagagggcaatgagactccgtgccttaattatcaacatttttatgatgaagaaccttcctaaactaatgaaaaatacaagacagaaacagatgaaacacagaaatggctgaaaagaactccctattaatttctgaccattttcttccctattaacagtgcttgatgatctggagtgaatacctgcctttttggctcctgccaattagttcaggaagttccatcttcaaacacattcagtgacctgatttaataggggcctttttatttgatcgccgccaacaggcagtcctacagacttttataatcacagtgggctgctttacaggcaagtcaaattccagtttaatgaaaacctacatcattacaaggaattgagaagggaattctggtttcttttctgctatggcttacactggaagcatagtaactttccaatgaatccatgcaggagaatggaattcatccaatagggaaagcctcatttttctctatggtagaatggtagaattaatgaatatcaagaacacgagaacattttgtaacatcctgctggttaagtatgtttcattcctagctaggttaatatggataggctgggggcagtggtggtggatatttccagagatattacctgaagtttaacaaaacattggttttaagcttgtacatcatgaactcggggacagcttctctctcacactctatttatttatttatttttgagacagagtctctctgtcatccagactggactgcagtggcgtgatcttggctcactgcaacctccgcctcccagggtcaagcaattctcctgactcagcctcccgggtagctgggattataggcccgcaccatcatgcccggctaattttttatattttttttagtagatatggggttttgccatgttggccaggctaggctggtctcgaactcctgacctcaggtgatctgcccacctcggcctcccaaagtgctgggattacaggcgtgagccaccacacctggcctccctcatactttcttatgcaccaatcatgacccattttgaaagaggcagagtggtggaaggtttggacttcatgtgctgactggttctctttgttaagactcaaataaaaccactggagtcctatccactgaatgctagatctcaagacatagcacaatgggattcctggttacttacaagcggtctttatggttccccagaacatcttcccttgagcctgcttcccttgctgctccaagtgaactaaggccagaaactaacagcaagcacacaggaactgtgggctctgtgctcccctcggtgtttctgttccatagaggcccatcatctttagcgacttgattttctcattccacacacaactccaacaggtatctcatgtattcattggtttcaaatatgtgtgtgaataaatccctctaaatttcagacctgtatatccaacagtttccagggcatctcatctggttgttctacatacgttgcctgaaagtgaatatagccaaaacatatcatgccttcgtcattctctccatgaagaaagaaaggaagagagaatctcttgtgtttcccaatgtgaaaggcatagtggtgcattcattgtcaaagtcatacatatgggtgacatcactgttggtagggccttctcccttaactcacctgcccccctcacttcccgcaccaccacccctaatcctcccattgagttagtaatgaagtccttcctatgtcctgaaagtctcccgtgcatcctattttttcttaaatctcactggcctgccttgggtcaagccttcatcatctctgctctagactacagccacagtacccagccttgtctcccttttctaccatctgatgtttattctctacatttccccccacccagaggaatatgtttggaaaaaaaaaaagaaaaacaaatactgctatttccctgctcaaaattttcaatggctctttactcttttcaggatgaaatttgaactcctccagattctaactgttgtcttctgccttcctctctggagtcatccctctgcactttccaaacacctcatcctgtgcaaaggtcacgcgacaatatttggagttcccagagctcgccagaccctttcacaccttcgagctgttgcacaggcgctcctcttttccctggctaagtctgactcaggctttacaatgaagctctgacatcaccatctccaagaaaagcctctgaccccaggaacctgagtgaaattccacacactcctgcagccctctgggtttacctctattgtggaaattatctcactttcttgatttgtccttctcctccctagactgtgatcccctcgaggacagacagcatggcttaattctctgtatcgctaggcctgacaaaacgctcacacacagtaggctcctgaacgatgtttaatttattgttaacacataggattccacagatcctgaggtacagcagacttcagatacccacttcaaagaaaacaagggagtaatgcctaggttcttgttcctatgatttatactgtgaataaaataatttcagagaagttcctttattcacttgaacaatatttaaagggcaaaaaaaattaacaaaaggtctttttaaaaatgcaaataatttacatttgttgataaagccatacaatcacaaaagtgaccatatgaatgcaaatattccttctaaaaagtataattattattcacccatctaacaaatattaatgaacccctctgatgttagatgctctttatggtacaggggttagcagagtgggtacatggaagcttcctgtagtttacactatcatctggaaggcgattaatcaaatactacttactgttcatgagtttataattataaaatggagggaaatactctgaaagagaagagtgtggttttataaaaccatataagaggctgggtgcggtggctcaggcctgtaaccccagcactttgggaggccgaggtgggcagatcacttgaggtcagcagtttgagatcagcccaggcaacatggcaaaagcccgtctctactaaaactacaaaaattagctgggcgtggcagtgcatgcctgtaatcccagctactcgggaggctgaggcaggagaatcgcttgaacccagaaggcagaagttgcagtgagctgagatcatgcaactgcactccagcctgagccacagagcaagactccatctctctctctctctctctctctctctctctctatatatatatatatatatacacacacacacatatatatatacacacacacatatatatatacacacatatatatatatacacacacacacatatatatatatacatatatatatagaaactggcttagacctaaggtgagtgggtctcaactgggcataggggaaaaggagggaaagcattttagatggaggaaaaaacagggcagggataaatcttcaagaccagagtggccatggaaaagtcacctctataactagaatcaagagagtgagagaggaagtgataccagatgaggtctgagaggcagggagggactgatccaggatgctgcttaagggtgaagaggatcagaacacgccaccaaaaaacataccattttggcatactgattattctgaggtaaaggcaattgagaaacagaaaatgcatgaagggctctccacctttcccttttctgcctaaaagcaggacataggtaaacgtacccttgccaaaccccaaaaaccagagactaaaatgaaacacagtcagagcccagaaatcatattttaaccatgaacaccccaacaattaccccctgattgacgtaattttcctaaaaatcttaagcccctccaactaaattaatcctccattttgtataacaaatataaaaactaaacttccaccgtaatactaataccttcagcatatccctctgaaaatgtgtatgtttctcctgttaatctgtcttttgttatcttaattagtaagaaccataaacagaccataagagagaacaggagcactttgggaggaagaggtgggcagatcacgaggtcaggagatcgagaccatcctggctaacacagtgaaaccccgtctctactaaaaatacaaaaaattagccgggcgtggtggcaggtgcctgtagtcccagctactcgggaggctgaggcaggagaatcgcttgaacctggcaggcggaagttgcagtgagttgagatggcgcgagttgagactgcgcgactgcactccagcctgggccacagagcaagactccatctctctctctctctctctctctctctctctctctctctctctatatatatatatatatatatatatatatatatactggcttagacctaaggtgagtgggtctcaactgggcataggggaaaaggagggaaagcattttagatggaggaaaaagcagagcagggataagtctccatgaccagagttgccatggaaaagtgacctctatagctagaatcaagagagcaagagaggaagtgataccagatgaggtctgagaggcagggagggactgatccaggatgctgcttaagggtgaagaggatcagcacaccaccaaaaaacataccattttggcatattgattattctgaggtaaaggcaattgagaaacagaaagtgcatgaagggctctccacctttcccttttctgcctaaaagcaggacataggtaaacgtacccttgccaaaccccaaaaaccagagactaaaatgaaatacagtcagagcccagaaatcatattttaaccatgaacaccccaacagttacccctcgattgatgtaattttcctaaaaatctaagaccctccaactaatcctccatttttgtataacaaatataataactaaacttccaccctaatactaataccttcagcatatccctctgaaaatgtgtatgtttctcctgttaatctgtcttttgttatcgtaattagtaagaaccataaacagaccataagagagaacaggagcactttgggaggaagaggtgggcagatcacgaggtcaggagatcgagaccatcccggctaacacggtgaaaccccgtctctactaaaaatacaaaaaaattagccgggcgcctgtagtcccagctactcgggaggctgaggcaggagaatggcgtgaacctgggaggtggagcttgaagtgagccgagatcgcgccactgcactccagcctgggcggcagagtgagactccatctcaaaaaaaaaaaaaaaaaaagagagagagaacaggaaaactttttttcttccatagggatcttgtttggaatttcggtcttaatcctaaaatcaaagatggattttaattggacaggtttgcaatttgaaaatagtagtgtggctgccctttggagaaaggcaggatgaggtgcaggtgcatgtggagactagttaggaatcaatgagatagttcaggtaagcggagataagattttgcagtagagaaatacaagcatacatggtccaagctaagctgacagcacttgtggatgcaacagatatgagaagagggggataagaagagtcaaggcgaccccggcatttctggcatgtgcaatttttactgaggcagaaaccagggaaggggctgagggtaagacaatgactctcatcttggacatgtgcagtttgagacttctttgacatacccaagcgaaaatactgtatacacagttgaatttactggagttcagagaaaaggtctgaattagaaacatacatttagaaatatttaatttaagccatgagacggatggcattgccttgagaaaaaaaaagtagagtgagatttccattgatgtgttgctatttcaattaccttgtaaatagtctagtttattattatcttatcctattaattgttcttccactctttctccttcactgggttctctgaattatagaatttatgcagaaaacaaacttggagatcatcagatataatctccaaattttacaggtgaaaaaactatagtgggttactcaggatcacactgctccttagaggtaaaaatgaagacaaaagctcaggtgtttttgatgagtactccacaggactacatctggaacaggagcatgttgggagatgaatgtaagagtcccaggtacccagaatcctaccaattctgacatgcgtgtgcttgtcataatgaaacaacacaggacatcatgtgaaggacaactaacgtggggttacccatgaggtggtgagaaacagaatgggattttgcctcaaacccactgtggtttacacattagtaaactgttcaaaatggggccaaaagcttgaactctctgaccctctatttccttctctaggaaatggagaaaagcaatcattaccttgaagtgttgaaaggaataaaacgaatgtatttaaagccactaaccacatagaaggtttccaaattactaactaatattttcctccaaagtaaagaaaaaaaacagatgtcatcaaaataataaagctggccgggcactgtggctcacgcctgtaatcttaacactttgggaggccgaggcaggtggatcacgaggtagggagatcgagaccatcttggctaacacggtgaaaccccgtctctattaaaaatacaaaaaattagccaaatgtggtggcaggcacctgtagtcccagctactcgggaggctgaggcaggagaatggcgtgaacccaggaggcggagcttgcagtgagctgagatcacgccactgcactccagcctgggcgacagagcgagactctgtctcaataaataaataaataaataaataaataaataaataaataaataaataaaaaagctggccggatgcaatggctcgcatctgtaatcttaacactttgggaggaagagacatgaggatctcttgagtccaggagtttgagactagcctgggtaatgcagtgagaccctatcactacaaaaagtttaaaaaattagccagatgtgttggtgcatgcctgtagtcccagctacttgggaggctaaggcaggaagattgcttgagcccaggaatttgaggctggagtgagccatgactgtgccactgtgctccagcctgaatgacagaatgagactctgcctcaaacaaacaaaccaaaaaaccaactttattatttaaaaaaatctcaagggctcattgaaattatttggaaacattaaaatattttttaaaatattaaaaaagcaattattccggtcatcagggtttaaagcctatttattatataatgcacctaaaatttataaagcacccatgattatgaatcaaaacatctatatccaaatagtatttgatattattatactgtaatgtattttctagaatacagcacacaagaaaccacgtgctatttcaatatcttgttaagcaagtgaaaacctatgttgtcagttttaattcactcaaatatgcctgtagccaaggtaaatggtatagtttaaaatagtaccacaaatgaagcaactatcttacaaatttaaaattaatcatttcctcttttattcataaacttttatgcttcatctggatttggatctctattcttctaaaatttagagttttaagtacaaaggattttttagctggtatgagtgttatagtttgctttaccaaagattttcagatgagagaatgaataaacattgtaagttacaggatatgaattccagggaaagagctatcatgcaagaataagacttatggatttcatttacagaaaatcttcagcaaaatctacaaatatatttttagctatatagttattttttcaatttgaagacataatggtgttaacagtgactgagcacttttatgaaactctcatggaataatatttgaacttcatctttttctattgtggtagagcacttgttcaaagccaagatgtatatccccacttgtatggggcagattccgggcaaaaccactccttaccacaaagcagacacttctcagatgcctcttcaggatttattccttacctgccttcaaaatatgatttgaagcaatttacaatatagcccccaacaaacttaaaagaacaacaataaaagatagaaaaaaaaaacaattagaagacaaagaaaggcagatatgtcagggatgaatcacatgagaaaaagaaagaatggaacattaaatttagcagtgaacttcttggcaactacagaaaaaaggaaaaggaaaatacaaattatacattattgtttttaaaaaggaaaaagtaaagtttatcttcaaagacacaattttttagtagtttattataaaatacatttattttattgtttttttcattagaaacttagagaacatgaaggaaatgtcttttagtacaatttcgcagaaatcacaaaataagatacaaataatcatctatctgcctgctctaaaggctttgatactattatactcaaacttcttaaaggtttttttttgtagttaaggacagacaattcaagttctttgttgaagatgagattacaaagttatagcctttaaacagttctgttcctacacctgactttttaaacctctgctaaaggaacttaccttggttcctcgtacaagttagttacacgtttattgctaatgtatatgtaatctatttccccagcaacggtaaaatactagcccacaaaacccagtatagttactggaacatagtgagtatttgatcaatgttcattgcattgaattaaaaatataaagaaaaacgtagttagcatgcatctaagaccagcagacaccaatcccatatttttaaaatcagcttaaaaatacatatttctataacctgagcttaatatttaatctaggggaaaaaataaataaaataaagtaaaataaaaacaaaaattatagattccctggttccatctcagcactaatgaattagaatatctgtggtttgcatttgaaatctgcattcctaagaccttctccagagaatttattgcagccatactccagagtggcatttcatcaatcccaaatattctccttttataacatttttcatgtacactccttttttttttgcaaccataaatactttgtgtccaatacatgtgctatgggggatgactcctaggtataattagaagaaatattgagatgggaaaagtttaagctagaaaagggaagtcgaagtcgaaaacatagtgaaacaaaaggtagatgttttactgtggaggattgaaggagatgaagaaaccagaaggaagtttgtgcagactgctggactgtgcctgaggactggggcaagagctgcaaagctaccagtaacccagtactctctgccttatcttctctgcttctccttccttacatgcttcactgttctcaactgcagacaggcttcctttgctgctctctgcacaggggcattacccagcccctaggttacattgcctcagtgccagacatacataaacacacacacacacacacacacacacacacacacacacagagtcacacacacacttcaccaaagttctgggaatctcaacagaagcccaggggagagagctgttagtcaaattctataatgtacatacaccactgatctcattccctggccctgagacaccaggtcacatacaacctgtgcagctgcctgagctatctctgcagctgagaaggcacttctggagaagaaggtaatgctgtgactggatgcactcaaggacatttctcatctcagagttcaaggaaatggcatagaggaattatccaaagatactgtcctatggtcttgggactatggaaaccaggaggttgaaatcaacaactctaaaaccaaaacaaaaacaaaaacaaaaacaaagaaaagtcttagatgtttcactggacaaaatgcatttagcaggaaaaacaaaaacaaaacacaaaccctattattaggtagattatatttgtcattgcattctttgacatgatctgggtctggattgcagatgttgcagggggaattggattatagcatcactttctcaacacagctgttttcacttgaggtggatatgggcattacttggccaccatgacctatgttttcctttgaagcatgggagttgtctggtggagttgggtagtgttcattctcccacaaagctgttgacagctatcaatcttaggggcaacagagactctcagcttgggagtaaaggaaggagaaagaactagattattcttcctaactgctttttccttccccaagtaaaattttttttaaaaagtcattagataggctggggtggccttgattgaggccagactgcagagatgattagagcccttcaaagaaaaagattggcacaagcaaggtggccactgatcccagagctctcaataaaacaagcatgctccccggagctgcccagcttctctgggtgcattttaaggcaatatgtcttaaactttagtgcacaaattgaggttctaatttagtacatctgggggtgggtccagatactatattttcttttaaaattaacaaataataattgtacatattcatgggatacatagtgatgttttgatacaaataatatatgatggctgggctcattcctataatcccagcactttgggaggccaaggcaggaagatcactggagcccaggaatttgagactagcctaggcaacatggtgagatcttgtctctaccaaaacaaacaaacaaaaaattaaaaatcaaccaggcatggtggcaggtgcctgtggtcccagctacttgggatgctgaggcaggaggattgcttgagctcaggagggtgaggctgccatgtttgcaccactgcactccagcctgggtgacagagcaagactgtatcaaaaaacaaaacaaaacaagaaacaaataatgtatggtgataaataatgaaaagtgagaaatgataaacatttatcctttttgagtaattaacatatccattatcttaaatatttatcatttctttctgtcaggacggctcaatgtcctcctagctatttgaagctacacaacatattattgttaactatagtcattctacggtggcatagaacactggaactatgtggctgtaatttcgcattctttaacacatctctccctgtaagtttccaagtgattctgatactaatggtccatggaagtaatgaggctttaaggagcacaaattggtaacttgagaaagttagatttacaacatttgcgatccttccttccgtgtggaacagtccatagcaaagattgactccagtctgcaacaactgcactaccctcctttcacatatggcaggacttcatcacaatggtttctggttctactaagggcaataaagtcagcggattccttgtttcattagaagctctgcagtagaccatgaaacatgctcagggagagaagggggaagctgaaagagctgggaaagccagcagtccgttgcgagttgggccacaaaagaatagaggaattaacaatccccacagattataagaaaaatctggggagggatactaactagaaaagactgaaaacttctagtaaagtgaatggagcttgagaacattataatttgggaatattaatataaagaagctgataagtgctagacataatactagatataccaactaaatccacgacaaagcatctaattgaacctacgaggcagagcacgcctgcaaagtttccagggaatataaaatgattacttggacctaattacattaacgtgaaaaatgtcattgatattctctttattgaatagctaccactgttattttacagcagtgaacattaaaacaattattagagattcccaggttaattctcaatctatatgtccaatcttatttttcaattaaaatcttaatgttgtcaaccaagaattcttccaacagcttgctgttgagatatttgctatctgaagaactcaatcaaaaattttagactccactagagtgggtatcacaaaattgcagccaaacttaatcagatgagcaaagttttttgtttagcctatgtattttcataattcctgaattagaatgcctctaagcaggccatacacagtggaactgaccagttcccagtgcaggatggcaacgtagtgcatttatctgcctgaattctaaaggagataagttcacccctttcattagctcatcaatatatatatgagtaacatttttatatgcgtgtttagatgtggagttaactctgaatccttgaccaaatggagcttaaggtttagctagggacatgtgcaaaataactctaagacaaagtggagcgtacaagagatgcaaaaaccaaggcctttgagagcacagaggcaaaagcttcaggagagttttcaccaatgagctctctgaactgactactgaagaatggatggaatttaacaagcagaatggcctgtaagtgggacggtgaggagaggagaaatggagtgaagccacagatgtaaaaagtgcaaggcatcattgagaaaaagcaagaaactagaacgaagtgggcataagagggagtaacagggaaaaaagaagacacattttgttagagcaaaatgtcattccacagtagctctcctcagctccaagctccctctcttctctctgacagcaacacaggtatcaaaccccgacacggaggccgcttccctattattcctgtcctgatctctaccctcttcctaggcttgacagcttcctgatcatgaatattctcttgatcctggtcatgaggaagcagcctgcaacccctgtacaggaatcccatgaagcacccttcccagccacactcagcatcagccgccttcttctccctcctcgctgctgaggcttcgggctgtctgatctcacctctttcctaagctgtgccaggccatgccccagcacatcccaggccccaaaactggcactttcactgccccctggagtcagagcacagaggcttatcttattactcttccttgtgtcttgggtttctccagtcattgccaatcaaacccgcgggggttcctcattttggataatgattctttcctctctcagtctcctcattttaaaataaaacaccaacaacaaaaaaatgaaatccattgggctatgtcttttattctgcatgcctagttattcactaaaccctcacgctctttcctctctattccttcagcccttggatatcaggacctgggcacccaaacctgttcctgcaacagccttacccttgtcacagtgctattgcccttactgaatgccaatttatcccgagcactttcatcacaatatcctctgccaaacattttaaatgtctccatatttccccttttatcagaattagattctttggctagctttcacagaccctcataacctgacccaagttctctacagtttggtcactgtcgagttcggtgagcacagttggtggtgacagcggtcttgagcgagtatggctcttcctcatctttcaaacagctcaccactgctctgcagaaaccctttccttactccccatcagtcaggaaaaagaaatcactgatttttttcaccctcctaatttccatatacaaccttcataacattgttttttatacgtctttatttattttaatattgttttacttcgcatttgttcattcggtctttacaaactaacctagagcagggtcatgatttttggcgttttgttttactatcatttcaagtgtttcacatgataaatataccacaggcattttataagtagttactgaataatggattagagacagagtttcaatagtgaacagctggaatcagttttaaagagttatctaagaggtacaggagaaaacagaactgtgctccatgcagacttaccagagaagacgctaggtatcttggaaagaaagcttttgaccgtacgaataggaattccatttttttcatcttgcatccgtgctatgacgtcttccatctaaacaataataacataattaaaacctttataaagttgaacttttttgaaaaaaaatcagctctcataacaattttgtattcctgttttgcccaactaagaacaatgccgtattcttgcctttctagtttttgccacattaatagtttaaatactgttaaaaagagatggaggaaacagcaagaaaaacagccatgttagggcccattaagctaccaataggaattttgtgctttgaatattgcctttctcctgatttcatgtaccttggttataaaggttaagatcaaagagtgtttatttcacaaggttttagaaaccattgtcatagcacattcatgcttcattaatgttacctctactgaaatcagtgcaaaagcaagtagagccttaaaagcatctgcttgaattgcttcttcaagcaagagaatttccgtgattttgttttacaataaagttctaaaacctgcctagaaatccaggactgattgccaactactattacatctcttgcccgggtacttactgaagtgtgttatgaaacaaatacacacacatacacactctcatgcacatacactcatgcatgtgcacatacactccacacatgcacatgtacacacacacatatatgcacacaagtacacatacacgtgcatgtacacacacatgcacacacacacatatgtatacaataaaatgaatgtaacaccacagccttctgtccgtttactagattcccctttatctttgtttcaatctcattagtacactctcttttacttttacaaattgctggtaattctaaagggctgtgcttcacaaagtcaatgtggaatttagttttgaagaacattcattcattcaaatcatagccacagacattactcatgtgcttctaaacctgggagatgcagagacacacaaacatacccaagtggtagtatgggacttaaaatccattcatccatttactcattccacaaccacttatcactaactctacaccagacatatgactgggcaccgtggatatgaaaatgcatacaatacagttcctaccctcaaaaaattcagtcaatagtgacaaccaaggtgaaatctgagtaaagtatgtagtttagctaatagtgttgtactaatgttaatttcttgttttgataattatgccatggttatgtaagatattaacattaagggaagctgagtaaagagtgtatgggaattctgttatcttttctttttatctataagcctaaaattatttcaaagtaaacagttaaaaaaaacacagtctaaactttatattaatgaattatcaaatttccattggccgggcgcggtggctcacacctgtaatcccagcactttgggaggccgaggcgggcggatcatgaggtcaggagatcgagaccatcctggctaacacggtgaaaccccatctctactaaaaatacaaaaaattagccgggcgcggtggcaggcgcctgtagtcccaggtactcgggaggctgaggcaggagaatggagtgaacccaggaggcagagcttgcagtgagccgagatggcgccactgcactccagcctgggcaaaagagcaagactccatttcaaaaaaaaaaaaaaaaaaaaaaatttccatcaacatagctttagaatggttttcagctaagaaatctaatgttcttggtatcaacggatgtattactatgttgtaatcacactatgaacagatgtattactatgacaaataactggagatgtggaaagaatgggttttaatgaaacacaggtttgtatttgactcttagctcttgtaattattatctatgttctttgagtaagttaaataacctctctaagactcagttttctgatccataaaatggtgataataatacttgtaataatttcttcatagcgttcttcatgggattgcattgggcctagggtggggtaaagtattttaagggcaaatgatacaacatatataaagcctggtacatatatagaacaacaaatattagaccaaatgtccatgcacacccacgatatctggggatgcttattctccaccttcatgtttctttccatgtggaaggagcgccattaccctaatccccttgccttgtctctgccccctaatttactccaggggagctgagctgacttatcagacagaagagctgggaatgagaaactggcctgcagggcccactctttttctcttggctagaagcccacatctaactctgctgatgtagagatgcctgccctagtgggtaagcaagtctattcaggattgtgtttcaggattaacagtgacttgtgcacaaacattcttccataatacctttatcagcaatcagggtgatgttgtgacccctacgtgcctgtctttatggttatagttctcagttggctcagaaatcaagtataaaaagaacatgatgctgggcacggtggctcacgcctgtaatcccagcactttgggagaccaaggcaggcagatcacctgaggtcaagagttccagaccagcctggccaacatggcgcaaccctgtctctactaaaaatacaaaaattagctgggcatggtgacaggcgcctgtaatcccagctactcgggaggctgaggcaggagaatcacctgaaccccagaggcagagcttgcagtgagccgagatcataccactgccctccagcctgggagacagagtgagacttcacctcaaaaacaaaaaataaataaataaataaaaaagaaagaaaaaaaatgattttatcaggcctgtaaaagaccccaacaataaccaaataccaaataccccacttcttttgtaataaagatctgtaataaagatctctaagtatagaaacatgaaaatagacatactctgatgactttttattttgttactatttgttcatgactgacctgccacaatgttcagaaatgcagaataagctgctttgtcctgcctcatatcagcctctaaacccttgtattatctgcttaacggtttaaagcaggctggattagagggacatggaaacctctctgactcacactttcatctcagcacctagagatgtggcagcagtcacctctgcttcgggctgaatttaggtgcgtagctatgagtggcagtgttttctttgtatagtctcatcccctctcagttcatgggatcccaaaggagtgagaataggaggctggaaagtaaaagtgacttctgtggttgtattccaaaatattccatttttctgagtcatcatttccacaagagaaaaaaattttaactccaagtaaaaataggattggtgttctagactgaaaacgtgatcatgtacatgcattcagctgtttttatctttatccagacataatttatccgtgaaccttctcatggcctagaatgagacaaaaacaaacaaaagaaaacaacaacaacaaaatgaagaacaaagacacataaaaaaaacccctgctttctaaaaactaaaatcaattaaaaagaaaaagaaaattctagccctcaaatgactgaagggaccccctcttggctaacgggaccccagggaaaccctggaagctaagttcatggccatgatgggatggggggtgggacacacctcgttgtaccccttcctcactaaccactatcagcctttcttccctaaggggcaaacagaaactgacccttttgaaagactccacattgataatgttgattaatgacttatcttcccaggacagaacaaagctaaaatgagatcagtcattccttcactcctctctgggatgtctgctccctccattcccttttttttcaaatgttcaccttatcttatgtaaaaagtaaacttacagggcactaattaaagtctcgcaagtatgtaatcattcctctcactgttgcctcctcttttttaaggaaaatgtataaatactaaacctcctaagaacctctgggaaaaacagccaaacaggcatccataacttgtcctcaagctggctcaacaagcttcagtgattgagatttatgtctcaatcactcattttggttgtcacagtcaccaagtccacataaaaaaacacatgcatcttatctgttgatgttccctcgagcattcactcagagtctattaatttttatattaagcatgacttgaacatgcttgatggtctgttttcccactattagcaacagcaattggatgagaagaaaaatgctacaagcaagcaaaaaaaaaaaaacagagcaagttagttagacagtaagaggtatgagggatagtaaaaagcaactccaataaatatgaaaatatttggggcaatttagtctaaggccaaaagactcaggtacctcaagtatcccatatatatatgtatgtgtgtgtatatatatgtgtgtatatatatatacttacacacacgcatatatatgcatgtatacatgtgtatgcacacacatatatgcacatgcatatattcattaaaatgccattgagttgtgtgttttcacttccataagcctgtttctgagggtgaggaaactgggcatgggagaagagaacactagacgatgggcatgggcaggagagctggcatgccttgggtcaccgaggatttttctgaaggctattttctttactcttaagaagttcaaagtagatgatctgtaagacttctcctagctacaaaatgattgaagtctggaaataatcatcagcattcagaaggaggtaagtttccacactaggtcaaagagccaattccctgttacagacaaatagatgaagctattaaattaaataaaaccaggccaggctcggtggctcacgccagtaatctcagcactttgggaggccaacacaggaggatgacttgagctcaggagtttgagaccagcttgggcaacatggcaaaactctatctcttaaaaaaaaatatgaaaatgaactgggcatggtggcaagcacctgtgatcccagctacccaggaggctgaagtgagaggatctcttgagcctggaaggtcaaggctgcagtgagctgtggtcctgccactgcactccagcttgcgctacagaatgagactctgtctcaaaaataaataaaataaaataatcaaacaagaccttatacaaatgtatttgcttccaattgtcagcacattttagtttcaatgcaagacgtagttattaaaagcatgcatttaggccggttagacctgagtttgaatcctgactgtactacttacaagccatctgaacaggtgagttaatttaacactcaaagattcggttatctcatctgtaaaatggagataatcataaattgtatacatcttatcaagggtgagaattagtgaaacaatgctaattaaatgcttactatgatgccaccaccaacaccatcatcatcatcatcatcaacataattttcttccttcatcgttgtactaggaagatacggatcctttttcttttataattcagccggcaaagatgctgtagttaagtgcaaatatttgttagacgcaataaattgtcaagcaataagtagtcagagatgcctatacataagctctgtctttgatttcctgtaaaaaactgagttcatgttggcccctgcaagacaggagatttgatttgaagaaatgtcaggggaaatatttgtgcatataagcaaaggctatgtaagctatgaaaaaaatcatatttagaaagggaaatgagatggcattcacttttaacaaaatgaaaacgtctttgctgtcatcttttcttgacaaatttgcctcttgaagttatttagattaaaaattaaattaaattgagtgctgtttgcaagacttaattttttaatgcaaactgattcactatgcgtgataaaagtaaaagttaaacaagtgtattttacaaagtaattttgagaatatgtattgctgaactcattcaaaactttttatgcttctgttacagaaccctccatatttcattaactagtaaaactatctgttttcccttagatgtaaacttctggaggaaaaaattcttaccttactcatctttgcattgttaatatataaagtgtctggtccataatggaggctcactttaaaaagagaagaggggattgatgtatttttgtttaaggcatatgtttgcattttctgagagcctcaaaacaaaagtggaagttaatttaagatttggtcttgagatgtttgatatgtttttttctttgtatgtaacttttgtgaaaaatacattatcagcatcagaaatagtgacacagagtagctcagcgtagggcaggttaaaacactcttatccctcttattttttctgctctatctaatgcagatactccagcttacttgttagaggaatttcttcctttatgctctatctaatgcagagatacttcagcttacttgttagaggaatttcttcctttaatgcaagagagtaaatcagtggctgttgatgaggctgtcttcttgcttgtagatgtgacactcaagttcattgccatgtgtaagccctcaagatgaaaggcactattgaacttcaacaccctgctcttttctcaggaattcataattagcatttcctttggaatagtttagatgtcacttcaagcttgtgatgtatttcaaaaaggctcaggttaaacagttcccgcccgaacacttggcggaatgaaagaaggagcatattacacaggtccatcttctttgaagagagttactaattattcaagaggggctgccagacagggctcccacatattgatgaaaacaaaatcactgccttgaaacctttccagttctctaatgttctaaacaattatgggagtttaattaaattaacttgtagctatatttgccggaactttaccacaatatcattattattgatttcattaagccaatcgctttacagagacaccatgactgtaggcaaaacatttgttatgaagtaaagctaaaacgttttgtactctgtaattctgaaaaagaaatgaatcaatcaaaatttcagaagaagttttccaactctgccttacaaccaccattaagcacaggcatttggagatataaatgggagactaagtgggcagattgaatggcttttttctatgtgcacatactttcaaattatggtgtgtactgtcattttaagtgctagctatgaaaatgggagaaatgatcactgaagcgcttcttggatttcttgggcagttaggtggtggcaggttttcataatttaaattcgcctataactctttttacttcagaaagcctttcgaatgcagaaaatcatttacacttctgaattcatcagtgaaaacagagaaagtagagtcagtctctaatgaaagttaaattaagaataatgagattaaaatttgcaagacaaactgttttctgctgtaataattcaattaaagctgcttctaattgatatgatttttccccatgttatagtttattgcagtcagtatcttaactcagaattaattactcttttcatattaaaaaactgccattttcatgaataatcgactaaaaatagaaactagtaaaatcttattgcatgtaaatctgtcctagtttaacttaaatatagatttatttatttaaaaaacagtaactcagtgaggcatggtggctcatgcctataatcccagcacttgggaagccgaggccaacggatcacctgaggtccggagtttgagaccagcctggccaacatggcgaaattctgtctctactaaaaatacaaaaaaattagtcatgtgtggtggcaggtgcctgtagtcccagctaatcaggagtctgaggcaggagaatcccttgaacctgggaggcggaggttgcagtgagccgagatcgcgcaactgaactccagcctgggtgacagagcgagactccgtctccaaaaaaaaaaaaaaaaaaaaaaaccaacaccaccaccacacacacacacacacacacacacacacacgataacataactcatttgaaagcttagaagcttagaaacttagaaattttatccttttgtgattttgcagaaataaagtagaggttttttttctaatttatagacgtttctgcttttttttttttaaataaatcatttctctcattcatctcaaggaatataacctccactgaaaataaataaacagataaataaacaattatgctcactgtgtttgttgggattacttgggttgacagaatcccaaattcaattgtcatgaacaaagaaatgtgttgtaagtactgtgggatgtcttctggaactcgaagacgggcacataagtgggtctcataagcagcccgcctttagggcatgcttactgccccctccactctgctccttgtggtgagcccactttttcttctcggcctagagtcctctcttagttcttcaatgcacagaacagcaaaaatggctgcccttactgcttgagttttacagtttgtgaaattaaataattccaatttaaagctgttggaactttaaattatttgagctttgagaaaaatgtgactatatggcctgagcacatagcatgcagctgcaattcctgcttctccgattacagattacagtatgttactcttgtgctgtggatgattaggaaaggctgaaaggtgccataaataagagtctattactcctccttataaaatgtcgaatcagtcttccttggaatgtagtaaactataactaatcaaactcctgtaacataatctaagaattggtcttgcatgaaaaatgttgcaactctgttaacatttctgtctctacctatataagtgaaaccttacctccacacttggatgcactaaccccattcttttggagtctgtgttacccaggtggtgacagcctcaaacgttgtgctcaaataaattctacacttaatcatattttctgaatctcattatttaatgctgacaagtttatatgaacccaaggagaaattccttctctaatttccatacctgaattttggggcaaaaactttgatttataacactggaggtggagttggaaggggtgctgggcagagaaactaaaggcattcgttatcaccttattcaatataaaaacccattgaacgatacatggataaagttatatagcagaaaaaagtgtaagaaaagcagtctcaaaaaaataagagtgggtggttgctgaataatgagaaagagcccaagggccaggtgcggtggctcacacctgtaatcccagcactttgggatgccgaggcgggtggatcacaaggtcaggagtttgagaccaacatggtgaaagcttggccaacatggtgaaagccggtctctactaaaaatacaaaaagtagctgggcgtagtgacgcgcgcctgtaatcccagctatcgggaggctgaggcagaagaatcgcttgaacccgggaggcagaggctgcagtgagccgagaacacaccactgcactccagccagggcgacagagcgagactccgtctcaaaaaaaaaaaaaaaaaaaagcgccaaagaaagacaaaaattgatgcagaaaagaacgttggacagacaagtcaaacaactgaatgagatttcacagctatgaaagacagaaagacggaagtagcatgaccaaataggccaagtggttaattacattgcactcttcggcatggtaagtatttgccccgaggtagaaaataccaacgatgctaaatgtatgtgaaagagtaacttaggtttccagatttcttttttgttcctaggaggtatcacttctttaactctcaaaaggagcctcgtggctaatttttattgcagtcaaagttcaaataggagagttgtcaatgtcccctgaactatttgggaaagacttcatgggaaaagtaagattaagctgatcctagagggtaggcaggatagagagctataaaggaaaggaggaggcagagcacacgaatactttaatcaattgcttcatcttcggcgtcaagatgggaatgagtaagactcctgcacagaataatgaattctgtcagaatccttctccttctgcctctccaacttgacaattttaacctttctggaaggtgtctctgtagtcattttcaaacacaattccacctttgctatcaacttagttcacatactgcctgcttgaaattctctcttatacgaactccttacctcctgatcccacttgagctcacatcagttcgctcaagtagcaaaccccagaattaacctgggaacaagtttaaatatttcatctcttgtttaaaacttccattggcctgacaaccccatgaattttctgtaagcgaaatgaccacccaaatttatccacgatatgacgcccaactgtcattctagcgttataacttgcttcccacatgctcagcaattgctcctgcctgcctcaccttctcacatacacttcctcatgccagctgcgcccttcccttttccatctgtgcctgtggaaattcagctatacttctaggatcattccaaattgtaatttcctactgacgtccgtctttatccctccccctacctctctcatcccaacagaatatgatcatattctctgttaaactacttgagatctttatttttagtttaaattttttttaccctaccttactttacatgacttacatgtaagttatttattaacataaatatcattctctttagattataaaagctttggtaatttgcattagttttgctatctgtggcatggtccatgaggaattatcaccccccattttttactttacatacttctttgctgtgtttgtatgttcaccaacaggacgtattacttttataattaatattattttctatttgaaataattaagaattctggccgggcgcagtggctcacacctgtaattccagcactttgggaggctgaggcaggtggatcgccttagttcaggaatttgagaccagcctgacgaacatggtgaaaccgtctctctactaaaaatacaaaaattagccgggcttagtgttgggtgcctgtaatcccagctactcaggaggctgaggcaggagaatcgcttgaacccaggaggcagaggttgcagtgagccgagattatgccactgcactccagtctgggcaacaagagctaaactccatctcaaaaaaataataataataataattaagaattcccactttaatagtattaaaatattaaacgttaagttctttattcaaatgtctgttgtaacacatttgagggttaaatatcgccaactgctctttacaatatactctctgtaaacattctgtataattgctattgactttcaacaactaaactagtctacctccaaattatctctttttacaaccttttaaattcagagttaatgaacgaaattgtttacattcccttttttcttagtcacatctccaataaccctggaagtccgaatcaatagtcttatcatcggccccctttcagatggagagaccacagttcctgacagatgaaaggcttctcttgggactttttttaattgacgcaggtgcttgatttcagacaagcccttctattctagcttctggaatcaacttgaaattcagcaacctctatgtgtaacaaaaatggacgaatcattcctctaaaaaataaatgaacaatgatatttagcaaacaaaatacctaaagacaaccattgatttggatgagtgaaaaaggcagagaatgcagaagatgcctgggatttagctaatctctgagattccggcaggaaggacataaaaaaagtcaaagggctcttggctgagtttgccattttattttattatttcatttttattttattttattttattttattttattattgagacagggtctcactcactctttttttttttttgagacagagtctcactctattgcccaggctggagtatgatggtgcgatcttggctcactgcagcctccacctcccaggttcaagtgattctcctgtctcagcctctcaaatagcttacaagtgcccgccatcatgcccagctaatttttgtatttttagtagagatggggtttcaccatgttatccaggctggtctcaaattcctgacctcaagtgatccacccgccccagcctcccaaagctctgggattatgggagtgagccaccgtgcttggccaagcttgccattttaaaacattcttactaaaggaaaggggtctcacaatacctccacggagtataatagatttaaaatagctttggaacataagaattactctaatgtttcaattctttgatttaaatcccagcttctctttgtagccatttatgtctttgttgtttataaattcatacaaatatttcggaagccacttaagtttcccacctccttgggtaataaattctgtatgtaaattatctgctagttgaattcatatctagttcctattatttaattcttgcctcattcaagctcaaaagaagccccaccattttacagtatgagaatttagtgactaacaccttgtttatcctattcatggtattcgtacatccataaatgttgatccacactatctcctcctccttttcgtgagcaacagacccagtcattctcatagttctgtatggagcacatccttctacaattgtctgccccgcttgatatttgtgagggaaacctggccgaggccagataccatggttcatgtaatctcagtgctttggaaagctgagggagaaggattgcttgaggccaggagtttgagaccagcctggacaacatagcaagaccccccctctctacaagtaaaaaaaaaaatgaaaagacaagtgtaaaaacaatccagtctattgatggccactgggcatcacagactcgtttccagatattctccctccaacaccttcacacaactccaggactgatggtgggaagaacagccttatgcatgcttacttccatcctaatcctacactgcaaaccaggaaataagactgaatgtgcactgtggactaaaagcatctctgttattcccataaactgactgaaaacaataaatgtacccattgttgaaaataaggctctgtcatcatgtgttcagtgacgcagagcctagaacatttcagagtatcatgtaggtgattcttctctcaattctttcaaggctggtacaggactagtggcattccaaacacataggagagaagtttatttattacacacaatagatgcctcaggtcattcgagcttaatattcttatgaaacctgggcaggacctgtcagagtatgaaatgctccatctgaagccacaagagaaagcactactctgcttccactgagatgaaacatgaggactttggattaagtgtaggcagaagggctaaaaatatatatttttaatgatgtgatatcaagaaatgttacttaagtaatttatttttatggtaacatacttataaaatgcagcccagagatgtctctgggatggtcttagtagagttcttccaagagtaattaaagggatgacctcacagccatcaccaccgtatatatgatagtgctttgcctgggtccatccagctggcttagtccatgaaacaataccatgtttctaactaccattttcaaaatgaaattaaaaagggattataacctgaaggtagggcaaaagcactttaaaaggacaaaagcatcctcatgccaatgaagaagatttatttcaggtgtacacactaaaactaaatataagtatggtgatttatttgtcttaggtgtttcatggttttcaaagttttaaagtggtttctgcagctgctgaatctgacctttttctctgtgtaacactcttggtttacttattttgtacaacgatttttaaatttccagttcctagaattcttttaagatcaatgagtaaactgtagaagggcaaaaggaaaagatttctactttaattgtacccttgctagtgttgccgattcaaggcactacaacgttaagatggattttatttttcagaagtatttgaacagtgatgtcgatctttctaacccaccgaacaattagttttaaagcagagaaaattcaatgtgacttttctgacttgccttttatatggggatttggaaaaaacacctccttctggctagtccatctatgaaagaaggttctgcacaggacctagtttcaactactccttcattccacactgttctcaagagagaaattaggatgaatggtggacgaattcatacaaaatcccaaggcaaagtaggtccaagccttggcacacaaacatataacttctagtccaataactggctcttttatatccaccacaattttgttttccccacgagtgccaagaaaatcagaatgtctagttgccttcttcctgacaacgattctcaatgatcctatgaagaaatgaataaaaaataaaaaggtacctcacttattactagatatctgtgactattatcttatggctagaacacgaacatcagaaggtcatggcagtgatgttgaattatttaaaactatttccccatttggtaattgttaaagtcatagagacacctaggtagtttgaaatgccctccattgaaagccagcaatttctatgtgtctccaccagccaagaggaccctgtagagctttactttctatagctggaataatgaaaaacaataggttttttattgttttaaagaaaaaattaaaatactgactatatttttaaaactgcacctgctcccttaacgttttgatactcgcatggataaacaactttgataacctctggtgtaaagaacgtggcctttgttgcttagcagagccatgtgcaaatctcaggtccgtcatttgatgaatgatgttaggaaaataatttagcctctctgggctaggtctttgtactccttccctataaaatgagaatgctacttccttgataaaacatgtactttacagcataagttccccttccttctttctgtgcaaactctgagatgacgctatttctaagagtgcaacacttggaaatgaggtgtcttcttttctctggagctattaagactttctttattccctacttatgacacactctgtattacattatagtcatatgtgtacatgtcttatttcttttgttctcttttactgaaagtttcttcaggataaatattagtttaattacactggtttaatcactgtatcctgaatagtatcttttgggaaactgagtatacagagacaatggctagaccacatatgagcacagaattctgacccacagcccctgcaaccagcctgggaagccaaaccacaagctcagcagtagtaagtccaaaatggtcaagactcaggcaatgacaaccagcttccctaatttttgcctctgcctataactctggacaaaccagagaaagctagacactcctcaatctagttatattagatacccactttcagcttccccatgcaacaacctccagtcagagctcgctctttctctctctctctctttctctctctttttattataaagctttcccactcctctgcctgcctttgagtctttgccagacacaagtggtggtggacgattaccttgctacagcaagtgctgaatacatagcctttctttgttttcattttggtgaccttcatttacttccacattaaaaaaaaaattcatgtacatctcactgcattcccaagaagaatctggggtaaatccttgtccagaattatgtcttttatagaagcaaagtctccttccagttctaatattctgtgactaatagatgttgaggtcgaataaaatgctgatttgttgaacaacttttcagaaatagattattcctgtgtataagaattgtcaaaataagtaattcaaaatctaaactgttgaaactttcccttattttgagccctaaaagaatatgattatggggcctgagtcatgtgacaggcagctgtaacctaggcagctgtaacctttgtttttgtgattatagattagccttcttcctatattgttttgtaaaatgttgcaaatgactgaagggcaccagggaagaccctttccctctacgctgctgatcttcattacagattgactttcttctttcctttctcacacaaggactttacttgactatcacattgtctaagatggaatgccaaacatacttttaaattggaaaggaaatgaaaacaagctttacagaaaagaaaacaaactgtaaccaatcattacattgctgtaacccataaaccagccttgtatagaaaatgctgtaatcctgttaaatttgttttctgcttacataagcaagaccttaactttttacttctgagcactgaccccatttctctggagtctattttctgatggccattcccacctttgcactggaataaactctttaaaactagatctgatccttgcagttatttcaggttgacagaatggttcatgctgaacctccgaattaagttgttggtttaaatttttatgcaagttctaaaagaccaaattaacctcccaccacatcatacccagcaatattatactgcccagttaagagccatgggtataaaattacatgatttctttcaggaggcatttatccttctactaaatatcagttcattttttcaaaaatccactcgtccagctttgtgggaactgaacactaagaattctcaataggggaagaaacaattgtctcccccattgtatgtgtattgatttgtaacataacgtggggcgaatggtttgagcctggcttctccttctcttcttgccaaccctggtcccttgttttgggatccgtttcccttggagaatataaacattctttatcccacttcttgaaaggccatccttgtctttctagttgatgttaggaatgaactgacatggacgacaatgactatgacctatgtaggaaatctgtgaactgagtaagtagtcatatgaaaccaaatcttatgtgacctattgatatggtttagatttgtgtccccactcaaatctcatgtcgaactggaggaggggcctggtgggaggtgattggatcatgggaagggatttcccccttgctgttcttatgttaatgagtgagttgtcgcaatatctcatggattaaaagtgtgtggcacttcctccaacactctcgctctctcttgccaccacgtgtgcttcctctttgccttctgccatgactgtaactttcctgaggcctcccagtcatacttcctgttaagcctgtggaactgtgagtcaactaaatctcttttcttcataaattacccagtcgcaggtagttctttatagcagtatgagaatggactaatacacctatatttacactactctaaaacttgcattatacatgtaattttagaaatttttattgtggaaaatcttaaacagatacaaaaataaatagaatacagtgagccacaggtactcatcacccacctgtaaaaatcttcagtttattatgccaatttatgttttaaaaggaataccaactctctctatgaaaagtatgacttaggaaaaggtaccgtatataggtttttctattagtgtgaatttcccatgcataaagtggttgctctctcctagcaggctctggctgctggcttcccggcctcccttaatgctgtggatacctgtgacacaagacctggctttccttaatgcctatctaacttctttatttcctataagactccaaacttatgaaaaaaagagggtgacagacaacagttcatatactaataaagtaaaatttgacctctatttttatatacattctgtaaattttttttagttgacatataataattgtacatagtcatggggtacatagtgatgtttcaatacatgtaatgtatagtgatcagggtaattagcatatccatcatctaaaacatttgtcagtttttttgtgttggaaatgttcagtatcctccttccagctatttgaaattatatgatatatgttattgttaactatagtcatctgacagtggtatagaacactgtaacttatttcttctaatacacattatttaatttactcctaaccaccatgtaatatagataatgcaatcatgttaatcattcctttttagagataagagagctagggttctgagaattaaaccgatagatgtaaggttacacagttggtaagaagggggccctctacgaggtagtatatgggggcacatttgcaaagcattacaatggaagattatatttcaaaaaaaacacggcaaaaatgcatgtcagctttcttttcaaataaaatataaatgtccttgaacacagtccactctcaggggaaatttgaggaaaagacatatcatactgactatattccatttgattgcacacagtgatacaatcctttacatttcaaccaagacattgaaatgctcctacttcaagttctgattgttcacatgcattctctgggaactgctgcctggatgtacaggattttttaaactatgcagaacctacatcattcattctatatggcagttgttgaaataaacgtttagtgattctaaatacctcactaaagtagctagtacttattgtgaatctaccatgtagaagtgctgaatgcctgttgtggattgtggatggtgacaggaaaggaggtaagaaatgacttcctctgggagggatctttgatttgtgctttgaacactgagtgcaaatcagataaactgagtggagggacttaagcagaactgcagcaatgagaaaactcctggttaatttgacaggaaaagattgtttgcagagcggtatctgtgggataaagtggaagagtgtaatgtacaggcttgagtggaaatagaacatggataacaaagaagaaacaaccctaggaaaaagtaaagctgcaatatatttcttatcggattaatctaagatcagtgtggagaagccaacagagacataaaggacctcgtgtaagaaatcagacaatggcactggggacaatagccggtaatgcagagaatcaagcaagataagcatgaagtcagaatccaggcataggctggactaacacaatccttacctgcaaaatctgtaaaacttttgatagcaatctgcactaaaataaacatttttcatcatgacccagcacatacatgtgtattccaacatacatagatttaattgaaacaaaagttttacaaaacaatagctattctttctatggtagtgaagcctactatttttattctattccactgaataaaaattaaaatagattttacaaccttcttaaatgtttttacaacccacaactggaacatgattcaaccagcagttcataagagactattgggtacattccatgaggaaataaacatacgcaagaagtttccatccttaaacaagtttccacccaattaaacaattaaacaaaccaaccaatcacagtcctcctctggcaaccatcttatctcattttatttaatgccaaacctcttgccttccgcaaagagctgtctaacctcatagttttaaaactttttcgtctcaggacaactttacacttttaaaaattattgagaatcccaaagagattttttttaaaaaatcaaataggctgtacctattaatatttaccaattttgactaaaaacaaaactatcatttgaccctgcaatcctactactgggtatttacccaaggaaatcattttataatataaaaaagacacttgcactcataggttcatcacagcactatttacaatagcaaagtcatggaactaacttaaatgttcatcaacagttgacagaataaagaaaacatggtatataaacaccatggaatactacacagtcttaaaaaagaatgaaattatgtccttcccagcaacatggaggagagggggccattatcctaagtgaactaacttagaaacagaaaaccaaataccttttgttctcacttataagtgagagcacaacaatgggtacacatagacataaagatgaaaatataatagatactgaggactccaaaaggaggcaaggaggctgagggttgaaaaattaccagttgaatacaataatcactctttgagccacgggtatactagaagcctactttcatcagtatgcaatatacccatttaacaaacatgcacatgctcccctgctcacccaaaatgtaaaataaaataaaacaaaacaattaaaaattaaaaatttaccagctatgaaataaaaaattaaaataatcagtaaaaatatatattaattacttcattaaaatgataataataagtacattacatggtaacatgaatatctatcacaactaactatatttctcaaaacatatttggtaagaggaatgacgttattttacagttttgcaagtctcttccatgtttggcttggaagacagctggattttcacatctatttctgcattcaatcagttgcaatatgttgttttagttgaagaaaatccatccttgcacagaaaatgctttgaataggaagggatttttagtagccttatcaaacaatgaatgatactcttctctgctactataccaaaactccacaggtagtagtcagtgattacctgagatgtagaatctgaaacttttaacaatgaacttttcatactcctactgtactaaaattcattctcctattttggactttgaatggatctttttacccaggaatggcatgtactgatgacttggaaaatactgatgcactgagttatgcagatctcttaaatgctgacacaattcatcatacaatatccaaaatgacatttgttaatatcaccactgatacaatgagaaaagccttttactattggaaagctcccaggctcatcgtgacaatcacaagttttccaaaattataactttcactcacaagtttgttattggcaactaatactgtcagttgttttccttgaaatgacggtcttatttttttccattaaaaaaaggtgtgccaaatattcatgtctgaaacagcagagcttgtctttcagttattctttcaagtaacaatgactagctcagtttgcaactcaaataatagcacatcacacttttgtatgcagcgccttgatctcttcaaagccatcttccacactgtggtccgagtggcgtgttgtaagtaaatctcctcatttttctctcttattgaaaatacattggttttctcttttgactttaggataaagctcaaagtacttggcatattatgaggccctgcccatcctcaatgcaatccccatccttcccacactggagtttttaatcattttcccaggtgagccatcctcaggcctctaaggcattgcctgcctacctggttaaaatgggcttaccttccaagattctgctcaagttcaggggctttgagaagccttttctcatacaccttgctctctacataccactatcatcataggtctacttatcaattaatgttgtatttgtaattttttttgttttgttttagagacagggtcttgctctgttgcccaggctggagtgcagtggcactatcacagttcactaccgcctggaactccagggttcaagcaatcttcacgcctcagcctctcaagtagctgggactacagatctgcaccaccacgcctggctaatttttatctgttgtagagatggagtcttgctatgttgcccaagctggtctcgaactcctggactcaggtggtccacctgtctcatcttcccaaagtgtgggaattacaggcatgagccaccgcgcctggcctaaactgtgaaattcttacagggggaaattttgtactgtacagagatctttttaccagtacacatatgtgtccaaaatgatctcaggcctagaaaagccacggcctctagatagagaggaaaatagggaaactagctgacaagtaaagggtcactcctgatagcacagcagcaggctatggagtttggtgtccacagtttaagaaatggaggatagagggtttagagtggaggtgcacgagtgaggtgcattttaaataggttaagtaagcctgcttcacactacaatttgaactttggagaaagactcaaggcgaggacaccgtacctatatttagaccccagaagaaagctttgctccaggtctaacaggttatctctccatgagatagcctccacttctctctggattatgatctcacttactccttactccattactccccttgcctgggctcctgactctgaagattgcttcacagatttcaacagtaaatagatgatatcaggaaaaagaattcagaggccaaattgtaaaatattgggtgaaaaaaagtactggacagatgtcaaaaacctttcagagattttacttttctaacttgctccaaatatctctaaaaaggaattatggtttgcagtgcttccaaaagagcatagctgcagaaccttgttttgcaggagaatttcaagggctaaggtttagtgcaatacacctgggagagaccttgaggtatgtatgcatctaggttgagcgatgaaaggacaacaaaaggaaaagaaacaaaaacaaagtctctaaagagcagcaacaataaaatcatcacttgaaaacttgtttgaatatgtatgttataattgatgcagcctcacataaaaggtgacaagctatggttccaggataatatgtctgggagtgagggtggatgacagagagggttgtttggaagcttataggagaatatactgctctaaatttcttatcatgataaacttggaactttgaagtttagagaagaaagagtttatatatatgctagtctatccacctgtgttgcaattgttctttttttttttttttttttttttttgagacagggtttcactctggtacccagtctagagtacagtggcaagaccatggcttactgcagcctcaacctcctagctcaagcagattctcctccctagtagctgggacctcaggtgcgtgataccacacctggctaacttttaaattttttgtagagatgaggtctttgctgtgcaggctggtttcaaattcccgagcttacgcatttctcccgtcttagcctcccaaaatgctgggattacaggcatgagccactgtgcccaggcttaattctttttctgaaggtaattattaagttcttttccaagactgctttattacttttttgaaaaatcacttatacattgcttttgttatgcaaatgcagctgctatcttcagtgacattgttcagtaagttcacgcaaaagtaattcaacccttggcacttcattcatcctgttggcaagctgaaggagtagagagtgaaaaattaaatgaatatgtgatctgtagttagtacctataccttctatttagcattctcgttactctccccaatctggatgcctagtgtgtaccacagataccacagggttatgtcctgataaactcatcataagttgaaaatattgtaagtaaaaatgcatttaatacacctaactgtctgggcatggtgtctgatgcctgtaatcccagaactttgggatgctcaagctggtggatcacctgagatcaggggtttgagaccagcttgactaacatggtgaaaccccatctctactaaatataaaaaattagccaggcacggtggtgcatgcctgtaaccctagctacttgggaggctgacgcaggagaatcacttgaaccccgagaggcagagattgcagtgagctgagatcgcgccattgcactccagcctggccagcaagagagaaactccatcacaaaaagaaaaaaaaaaaaaaaacacctaacctaccgaacatcatagcttagtctagtcttaccttaactgtgctcagagcacttacattggcctacagtttgacaaaagaatctaagacaaagcctattttataataaagtgttgaatgtcccacttgatttgttgactcctatgctgaaagtgaaaaacacagtgatcatatgggtagtcaaaatacggtttctactgaatgtgtatctctttcacaccacggtatagttgaaaaatcctaagtcgaaccacattaagttggggaccatctgtaaacataggtgcttgataagtgattgtcagacacatgaataaatgagggaaatttcctgctcttgtgcaatcacagagacctctggaattcaacatagctactctcacaagtgctcaggaaccctagaggacatcaacaggggtggtgtcaatcagggctttttgatgacttgccccagagcctgccctgctgcagaccccaggtccttagcctcagcaacacccttggctctgaggacttcagtgtggctggaccagcagctccctctttttcatcactcattcattatttaatcagcctatctacctcaccaaggcctccccaacccagctgctcctttctgtccataaaataactgccttagttcaggcagttatggctgggtgaagcagagacaatgccactattcccaccattctaattatgacccacatcctggcaagtggattctccctaagatacaatcactcaaaggctcaggggcaagaaaagagaacatgggccggacacggtggctcacgcctgtaatcccagcactttgggatgccaaggcgggtggatcacctgaggtcgggagtttgagaccagcctgaccaacatggagaaaccccgtctctactaaaaatacaaaaattagccagctgtggtggcacatgcctgtaatcacagctactcgggaggctgaaggaggagaatcacttgaacccgggaggcggaggtggtggtgagctgagattgcaccattgcactccagcctgagcaacgagagtgaaactccatttcaaaaaaagaaaagaaaagagaacatggctttaggttttggtatcaaataagcccagaataatgctcaacccagaatgatgcagacctatgtcctagtcatggtagcatgggactgggtatccccgccatgctgtccaccctcaccttagaagagggcctgcccctggagaagcaggagaatgtgttccctttggcgaaagtttgaccaaaagaggaagaaaaatgaaccaaacatactcagatatttttctgaaagttactgatgaaatgaatcactccaatttcttaggtcaagcattaataaaggggtggggaaaagccagggatgtgcttagagagtatccctcttaagaagaaccaggatgggcatggtagctcaagcctctaattccagctctttgggaggccgaggcgggaggactgcttgagaccaggagttcaagatcagcctgggcaacattagtgagacctcgtctctagaaaaaaaaaaaaaattagccagacatagtgctgcacgcctatagtcccagctacctgggaggctaaagtgggaggatcgcttgagcccaggaggttgaggctgcagtgaactccattgcaccactgcactccagcctgggtgacagagagagaccctgtctctttgaaaaaaataaaaaagaaagaaaacaagaaccagaaaatgcatttttgttttcttctatcaagctttataaaagcattggtcaacagatggaagagtggttttgaggatagccctattccctcttaaggctgggatagagggttagggatggcattcaaaggaaaacgtctacctttagtacaaggcggttctattaaaactgtggaggcattagatggaagccagcagtaatgctttagaaccattctgggcttcctgcagagtggtgtctgctgggacctgaatcgtggcaggagatgcccagtgcacggggcccatttggtcaccagcagaaacaggaagggccccctgggagctgagccaattgtgtggacatgtgagacatatctcgggacctcccaggagagctatggaagtagtgataggacactgtaggcgctgcaggtaggcagaggcaaaagccagcgaacttgttactcatcaatggattctctctgtactaactgctgaggcctgaagaaacttggttatatacagaagtgtgaggcctcccttggagactaaagcatttgctccctcccaagacattaggcagaaaatactacttgggatggcaggttgttttgcacggtcatgcccttttacttcatgagctataatctagatgtcagctggggactctgtgtcctcatggtatatgtaggattgctttgaccctcccattggacagtgtgaagaagtcttaagccaactggagatttgtggtcattcttttcatggcttagctctatccacacaggcggtcattttctgggcctgcaccatgcagagtccaaactcagttcttccaccagtctccataacaatgctactcgctctaagcattttatgaggtttcctagaattcatgtaatatttaaggggataacaatgagagggctatatctcactgcacagtattccaatttctctaggtctttgaccctttttcctccaatcatctagatacccgacatgcacaaagacatggacacacacacacacacacacacacacacgctgaattcatcctccctttgatccacagaaaaccaagggttcctcctctgctctcccacagaacagcatccctcccactcagctttcagcttctatcctaaatatgctctgcaaggaatttgcccaacaaaggcacttctctagttagaaaaaaattatcatgccagttgctaaaacaaaaaaaacactctctttttctaaactaatttagatgcatagtaggtgcttagaaaataataagtgtgtaaatatttattactctaagtaaggtcctcttcagggtgaccctgtacagaagcagcctggggctgagatactccctatctaatttataaaggatcagggcaggcatacattaaatccttttttctacctcgatcttatttcctcttaggaactgaaagtgctttcagacattatttcagtaatccttgcagcttcccccaatgagaggaaaaaatgcccttatctccagtgcgcagatggagcccagagagatggaagttaagtgactcccaaggttgcccacagggagcacagagaagaagctaagctgcgacctggagtcttggtgaccccgttctagagttagaagataacgttgccttacaaagagttttcaaatgtggcagcttttgctctttgaaatgggaataattgaggtttcccatttatatttatttatttatttattattattattattattttgaggcagagtttcgctcttgttgccaggctggagtgcagtggtgcaatctcggctcaatgcaacctccgcctcccgggttcaaggaattctcctgcctcagcctcctgagtagctgggattacaggcatgcgcaaccacacccggctaattttgtatttttagtagagatggggtttctccatgttggttaggctggtctcgaactcccgacctcaggtgatccgcccgccttggcctcccaaagtgctgggattacaggtacaagccacagtgcctggccccatttatattttttgctctgtaatggggcatgggagttcatgcaacgggctctagatcaagcctgcttgggtcaaatgcgcagctctgctactctctagttactgaccttgggaaagttactcagcattttgttgcctcagcttcagcatctgaaaaacagatgtgctaaatacaacaatatccttctcacggagttattatgaggatcaaatgagtttacccctcctacctccagccccccatacacccactagagaggttaggaaagtgcccggtacagagaaatgctacataaatgttagctataattatttctccttttcgaattgtgcattctttatttagcaaccttaagttgattttttttttttttggtctaggtgacagcattgcctaactatagaaaccaaccttgtagagtcctaggcatataattaaacctaatatatcaccatactattgttcacttctttctttccttccttccttcattccagaaacactttccaagtgcccactatgtgaaaggtacggtattagattaggtacagtagtaaaggtaatttagaagataaatttggccttagcatcttatggtctaaggagaatatgcacataaacatttaaatttcaactcaatgtcaaggtaatatcatagagagaatccagaagaagcaacatctaattctgcttgatactatcaggaaagccttacctgaggaggtaactgagtcttgaagtagaaataggagttattctgacaaataaaaaatccttgaaatgtttgggcaatttgttcagaatacatattttttaagctcacatacaacaatataaaaagtaaccatatattagtgataaagcacgtctcaacacattttaaggattgaagtcatacagaaagcacaattctatgaagctaagaataaattactaaatccgtcaataatccctactcgacagccatcattctcagcaaactatcgcaaggacaaaaaaccaaacaccgcatgttctcactcataggtgggaatcgaacaatgagaacacatggacacaggaaggggaacatcacacaccggggactgttgtggcgtggggggagcggggagggatagcgttaggagatatacctaatgctaaatgacgagttaatgggtgcagcacaccaacatggcacatgtatacatatgtaacaaacctgcacgttgtgcacatgtaccctaaaacttaaagtataataataataaaatttaaaaaaagaataactttccattttatcaattgaaattaatagaagtaaaagtttaaatagtgttgactacaaatattagtatatagatgtatgtatttgatgtaaaaacatagttttggagattattctcttcaaatgatttagtatatttcagaaagataagaggatgataaatttcaaccaaaaataataacactgagcttttaaaagtatacttgaaaaaaaagtacagttgcatagatttgaagaggaaatatagagcagtatgttatctaaaaagttcagaaaatgggtcgggtgtggtggctcacgcctgtaattccagcactttgggaggctgaggtgggtggatcacgaggtcaggagaccgagaccatcctgactaacatggtgaaaccccgtctccattaaaaatacaaaaaattagccgggcgtgtggcgggcgcctttagtcccagctactagggaggctgaggcaggagaatgacgtgaaccgggaaagtggaggttgcagtgagccgagattgcgccactgcactccagcctgggccacagagcaagactccgtctcaaaaaaaaaaaaaagttcaaaaaatggccaggtgcggtggctcacgcttgtaatcccagcactttgggaggccaaggcaggcagatcacttgacatcaggagtttgcgaccagcctggccaacatggtaaaaccctgtctctactaaaaatacaaaaatttacctggcatggtggcggtgcaagcatgtagtcctagctaccagggaggctgaggctcgagaaacgcttgaacccggggcggaggttacagtgagccgagattgtgccactgcactccagcctgggtaaaagaacgagactccgtctcaaaataaataaataaatttaaaaagttcagaaaatattttataatgtcaaaaatataaattacacagtatatgtatatatgtaaatatatacaaataatttacatctctataaaatatttcaaaattattttataaagcaacttcccagaaattgagtatttaaatgctatttggacatgcagaataataggcaaaaaaaaaaaaaaaaaaaaaactcttcagaggaataagtagggaatttcatacaaaggggtgataactcttaagatattttagctttggattaatttacatttccctaccccgtaatgatatgctcccttggggctagaaagaaagcaaattaaataccagttgaacaactaaattgattattatattgatatcccttcttcaaaatgttaacggaaggacaactactatttatacacaattagcatggaggagagacgtaattaaacataactttagataatttctccaaattatactcctctaacattttgaaaaagtttttaaaacagaagtgatataaaaacaggtgagcttcttaccctcagcctccatgctataagtaacactgaaattcaccataagattttcttgcaaaatgccataaatgaccttgcgtgtttaagtgtaccactgaggggatattggctactagaaacaaacaaacaaacaaaaaaaaaacggaactcaaaacacttcaagcagtaaaaggttttttgtttgtttttaaatttcacaaaatgaagtaaagtcccgaggcaggatgatttcagatttggttaagtcagattctttccgtattctgactctacattcatcagcatgggaccttcccagccacgacattatcacatttttacatgcctgtgcccaaaggcaaaaatagcgtcaacctcttacttttccttcctctaactagcaaaaaagcatcgccagcaccctcacagaagaaatctctttaggtcacaacagctagaattgcattaagtatattttataagccaataatcaccggcagagagaataaaacagacataatcaaccccctaaagagcagcagttctcaaacttgagtgagcaccacagttacttggagagtttattaaacgagatttctgggtggagcccagaaatcagtaggtatagggtggggcccacgagtctgtatttccaaaaaacttccaggtgttactgatgctgctggtccttctacaaaccccctgcactgccctaaagcacgtgggagcatcttagcaaaggggtgggggaggtggctcaggtaatcaaccaaagtgcatctgagatctaatattattttaaaattgcttttcaagaattcctattacttcaaattaaagatgtaactgagtgtcttctgagtattttagaattgcaaattttgatattctaccatcactatgctccacctctctgaagccattactagggcaaggatatagtgagaaagtttctgtcactgctaagcaagtgcatccttcagattgccaatgtgtcattgtagttggagctattaaacttctatgtggcatgaaaattgtttggctaactttaaaaaggagaaaaaaatggaagtggaggttagaatttttctagcccagcaagaacccacttggtaaccacttttagataaaaagcccaaaaataatatacttcaccagatgttcctttaattttccagggattaatttgagagtcaattacctattttaagtgattaacataaattaaaaaaaaaaaacactaggctctgaaccaatgcttttaactgtatgatggaccattgttcatttccgatacttttaagaactaggatgattttgacacattaaaaaatgtcctggaatgaatttgctattctgcttggcaacatttgaggaagtaaatactgctacaaatcctttaggtagctttcaattgtccatgtctgttagtgagaagagggacagtaagaaaaatgctaaggtcaaattcactcatgacttcatgccaaaaaaaaggtatttctgagttgataactctaaaatctttttctaagtagggacaagaattactaataacaaacagtggaaaacatactgaactaaaacacaaaatatctgaattttacaggtcatttaacttccctgagcattgctttcttatctgaacctctaaggattggatttggtgtttggtttcttttttatttttataacatccctttcagatataatccaaaggtgacatctcctttctctgtcctatccatctttgatgatatgtgttaataacagttaaatgcaaaataataggataaaaggcttaattacaaaaaaaaaaaaaaaaaaccaagaggccagataattctactctggaagaactggctgtaacatcatgatgatggcagcaatttagaaagccacattaactttgttacagagatttatttaacgccagtttgaagaatgacgtctttatgccgatgacatgattcatttttttttaatgagtaaaatgtgtttttctccattagactttactctctgtaccttgaaaataaaaatacctttccagtgtcatgcatgagtcatattgattctcaaattaaactaaacacccatagcacataggaaaaaaaagccaaatgacaatttagaaatgtaagggaatttgaatgtctactcatttacttgaatctaatcattaagatgaggatgttatttcactctttctagaacaatagttttccaacttgagtttgcatcagaatcaccaacaggaccagtaaaaacagacagctggacccaacttccagagttgccaagtcagtgggactatgtagggcctgaaaatttgcatttttaacaatttctcaggctacactggctgatgttgctggttgggaaccacactttgagaactactgtttgtagaagactggtaaaaattggtaggtgtaagaaagatattctttttagatatatgtctgggagctgggggcaaagtagaaaagcatttaaaaagcaaaaatgagagacacctgaactgtcatgcatttaccagaattttctctcataacgtggcagccttcactgtcctctttcctttttactattctaaatcaaaacattacaaatgtacaagctggaactgattatgcataatagctgatgttacttcactgattaaaaacaaaaaagcaataaactttggctccctctgcaagctgcccataataaaatgcagaggaaatatttattaatcaagcaaagactgaaagacatttcgttaatggtctgcctcatcacatcagtttgaatcacattacacatcccgttaagaagagatgatgcttaaaaatacagaaaactaaatgtggcattatcatccatcccaactggaaaatgtgatggattgtccttaatagaaagagtggtagtctattcatgtggtatgtctcgcaaaggaccgccaggctccaagagccaagtattctgatcactttttccttaatgagaggctcccataaacacaatttaatcctctttgaaaacctgagggctattttgtgtttaagtggcatacacagagatcattaaaatgtaaaagaactgtgcagggaggcccaatttttttccaggtggccatgcatcagaattttgttagaatgtaacatggatttgattgaatgattctcccatttccacatggagagtggagcccagagaattgtttaatcatgtatccatgattcaatattcatttatggagcacctatgctgggccagaggtactatgagtggggatgacaggatggatgtgacagacaggacccctgtccccatgcagtttacaggctatatcagtaattaacaagaactaaaatacttggcaaagaggaatgcttccatcaatgtttgtttaaattaaaggaaaaaaacaaaccccacaacgaaataatcaatacagttgtcacaagtgcacaggacagcatgaaagcccatgacacatattttggagaagaggtacttccattttttttggtgggggaggtacattagcctcaaatttcacagaatacatgcaatctcaaagttaaaaaatgggttttactgttaaggtctgtcaataattcaacttattatttgtttgtttgtttgtttgtttgtttgtttgtttgttttagacggagtctagctctgtcgcccaggctggagtgcagtggcacaatctcggctcactgcaagctctgcctcctgggttcacgccattctcctgcctcagcctcccaagtagctgggattacaggtgcccaccaccaagcccggctaattttttgtatttttagtagagatggggtttcaccgtgttagccaggatggtctcgatctcctgacctcgtaatccgcctgcctcagcctcccaaagtgctgggattacgggcctgagccactgcgcccggcaattcaacttattaatactagaatacattttctacagaaaaagttgtgaaaaattgtgatataattgtattgtagtacattgtaaaaattacaatacaagtgaaatgctttttatttacatttataaagaatagaaaatgtaatcataagaaataagagaaaaaccatttttacataaaattgaatataaacagcaataaatgaaatcgactatatatcaatttgataaaccacagagaaaaaaataattatttcaaataatttttgaaaatagttctttgacccattttaatgggatgtataagtctaagggcaaaaaaaaaagaaaaggtctgaaagcataccttaaatttattaatgggtttgttagtagtgatattctaattttgagacaatattgtagaaaactaaagagataggttgataatattagccaccataattttttttctaagggaaaggagatacaaatataaaaaaaaagaaaccaagaaaaagaacactcataatattaattttctcccacttaatttttctgtaatactaaatttgaattgaaaaatatagtgtgaaccaaagattataaacgtaatttcccttagggtttctactgaaagggtttagaaacattgacacagtagcaacaagcaaatttagttccctgatcctggtttctaaataccattccttacagaaacaacaaacaaacaaaaaacaaaccagttaataccaagtttaggtttggtcaaggtgaactggtgacaatttgttgtgccaaacactaatttaaatcaaactatgtgaaagaattcaaaaactagcttcaaaaagcattcatgagttcacaataagaaacagggagagagagaggcagagggagagaaagagagagagaaagggagacagagaatgaatgagatgccctccagcaaaggaaagcagtaagtccacgacatcatctatccttgccaaaatgtctatcctggatctaataaagcatcccatcctgcactgcccaatatggtagccattagccacatgtgactgtttagatttaaatttagaataatttaagttaaacaagttagaatttcttttcctctatcatcctagccctctcacatatggctggtggctactgtattgggtagcaccaacgaagaacagccatcctcacagcaagatctgtcgggcagtgctgctccagacctatcttccaaattatatggaaaccaagaaaccaagttaaatgacactacggggaaaccatatgacaaatccagactgacagaatgccgtgggacttctactagactattagcctgaactcttccaaaagtaaattgtgtttgtgtgtgtgtggtgtttgaacacctacatatgtatataaaatgcaattattattgtatactacaaagatgtaagagaggtaacaaccaaatgtaatgcgtgaatctggactgaatactgaattagaaggaaatctggagaaatctgagaatagaatggatattagatgactatccccacacctacgccatagaagcggaagtcactcttgttgtttataaaaggcccacgagggaaagtgccctactttttcccagagaggggaggggcttgcgggaaatgaatgggagagagttgaagcagagtgctgagaagagggaaagatttaccataactggaaaggaaaaggagttttactagttcctcactgaaagattgtccccggggcctgaaagcttgaagagatgagaaactcctcccctttcaggcccagtcccaaggcgcaaggccacttacagtaatcagcagcgtgggtcagcaagacagcggaagcaggacgacagccggccggaagacacctaccccggccggaagacacctaccctggccggaagacacctacctctgaagatggagaaggaggccgtccgggtactacgtagcagtcaggtcagtctgggacatttcctgtttacagaggactataaaacccctgtcctgtcctcatttggggctgacgccattttaggcatcagaccgcctgtgcccaggcgctcattaaaacagcatgttgcggccgggcgcggtggctcatgcctgtaatcccagcactttgggaagccaagacgggcagatcacgaggtcaggagatggagaccatcctggctaacacggtgaaaccctgtctctactaaaaatataaaataattagccggatgtagtggcgggcacctgtagtcccagctactcgggaggctgaggcaggagaatggcgtgaacccgggaggcggagcttgcagtgagccgagatcgcgcccctgcactccagcctgggcgacagagcgagactccgtctgaacaacaacaacaaaaaacaaaaaaagcagcatgttgctccacacggcctcgtgttgtctgttggcgtgctcttgggttcgagctgagaaccttacactcaccacttccgggatgcctcccctatctttttgcaactcttttttgagggaataatggcactgggtttacctagggagaaaggatactaaactctggggctcccaggtttggcaggctcttgtggaaaaaaacctgcccttgaaaaacccctaaccaaagagctttgaacaagatgatctgagtgggaactccttctcccacgtggtgtggccggcctcgtgtctattaaactctctactacaatgtcagtggcctttttttattatttttttttgagacagagttgcccaggctagagtgcaatggcgggatctcagctcaccacaacctccgcctcccgggttcaagcaattgtcctgcctcagccacctgaccagtagcctttctttatgcagtgacaggacgaatcccttgggtggttacatgataatgacaaaaaaaaaaaaaaaactagtttgttattctaagaaagacatatttgaaaaatgagaaaatttgttgactgtggacaataaaagacagtgttacaaacaatatatgagtctttttaagaggaaataaaatgtatcaaatcagatctatcgtccaccacatccctccttcactagccggtaggtgaagctctttcaagtgggtgagggtagatggtggaggaaagataagttttgttcaattaaaaaacatgtatagacagtctgcagtgtcagacactgtgctaagctcctcattacttcaggagcttgataaaaatactgatttcaaggcccagctcccagagattctgactgagtctttttctaaggtggggtccaggaatcctcatctttgaacattggtcttcaccctttccacaaggaatcacagtggagactttcattggatggcaccttgtgaaaacctgccctagtgttttggagataaggggggggatgttcatggggtagaggggagtgtcactctggagcactctcctgccttgtgtggccacagcacagtcccacagtgaggggccacgtggcactgcgcaccgatcttgagctatagtcacaaagctcctaggcaccacccacgaaaggccgggtgatggcagaacaaaaccatctggaaacctgaagatggctatcttctcttttgcagagaacaaagaagattacgtgttttgttcctaccttgatttcattttcagttcttttggacactgccttagttcagctcaagtgcatttgtgatttcacatgtaaaaaaaattacaaatgagcatcatattattcttgcttagtgttcacaatgctttggcgtccaggctatgttccccttcctttgcattaaaaaatgtgtaattttcatatgttagagctagaagggcaccaaagaagccatgaagatgagctttctgttaatctgttggtggcttgcatcatcattggatgatgcctactgaagcaaacgcaaaattctattataaagctaattcttaaacaatgtgcattacattcagctgctgtggccaccttagctgaggaagacatttctaagggatgtatggtccctgagggctctgtttaggcatcatatcatcaggaagtttatccttattcattcctactccttcctctctcccctcaactctgggatctatgttgttcaatgttgtactatcaaagaccgtattttattggcatttttttttccttttctttctctcctgctgtgagctccttgagggaaatttatgtttcccaggtctttgcatttctaaggctacaatcagaaagtgacacaaagtctacattaaaaaactttaatgaattataattatgaattataaccaaattaacaacactgaacctattattaatgatttaagatatgtagaatgttattgatatctttattcattgtgttccttttattgttgttttagggaatataaatatgtaagcgcttacttgtggtgttttatgactttgagcccccaaattttatattcattatcagatcctgaatgttcaactgccacaacttccatcacaggccaactcaggctgtcctagcaggctgctggatgccagtcacattaggctcaattcaggatgcagtatgtgctggagctggcacacacctgctcaaaggagctgatccttaaattttcaggaattatgtgagaagctgttaaacaatggatagcttgaaattggcaatggcaggagtatctataccaaagcaactggcaaatactacaaatcatatcactgcttctaatgagttacaaaggtgtgtgcttacatgctacccaaaaggaacttgaaggccttcatgtgaaaagatcatatgaataaacacaaagaaattagggaataatggccgggcaccgtggctcacgcctgtaatcccagcactttggaaggctgaggcgggcagatcacctgaggtcgggagttcaaggttagcctggccaacatggtgaaaccccatctctacaaaaaatacaaaaattagccgggtgtggtggcaggtgcctgtaatcccagcctacttgggaggctgagacaggagaatcacttgaacccgggaggtggaggttgcggtaagttgagatcatgccactgcactccagcctgggtaacagagcaagactccatctcaaaaacaaaaaaaaaaaaaaaaagaggaaattagggaataacaaactaaaccataatcaagccctaaatttaatataatcaagaaccaaaagttataacacaggtaagtgatacaggtatcagaaatgggagatgtcacagtcaaccaaaattgtggggggatcttcagtgaggagttggaaaggatgcaggaaagagaggagaggaatatcttcaggatcaggaaccagctgaacacagctgaacacatggagccaagcacctcacatgtgtataggggagagtaaagagggcaacacgaatgccacacagcatgcagccctcagggggagtccactgcacacacgcctggcttctgtggaacttggttactggaagtaccacatctgttgtcttggtccagctgtagcagagccatggatacttaagagtttgagaattaaggtgattgcgtagccggtgcctcctctatttcacctgtcttgcttattgtctatatcctctgtttaatcctcatctcgaccctttccatttatgattagaagttctcttcaaaaatatttctttaaaagctttgagggctatttccattttttgctatcttcatttttgttaacagctttccatggttttcctcataatatatgctttttttaaaaaatataacaaatccccataatccagattaaagctaaacaaacgcaccaggcattaagcaaatcacaaactccaggcttttttctgtaatacatgatacaaaacaatcagtaacactcaattccaggaccaacgagaagggagacattataaaaaatttaaaatgtctcaaaattctgtcactacagattggccttttctgaacatttcatataaatggaaccacacaatatgtgtctggtttcttttacttggcagattttttttttaggttcatctatgttgtagcatgcgtcagtagattgttcccttcctcattcacacccatcttcctcccttccttcctctctccctcccttcttctctctttccttcctttcttcctcccttccttcctctctccctcccttctctttccttcttttcttcctcccactctcctttcctccccatctttccttccttctttccttccttccttccttccttctattcttcctctatttctttcccagatagcattccattgtactaatgtactacattttgtttatccatttaccagttgtgacacaagttagggttgtttccactttagaaataactgtgaatcatgcttcagccaacattaatgtgctattctttggatagaaatatgtttttatttcctttgggtaaatagtggatatttgaaagtggaatcattggatcaaatggtcaacttaggttgacatttttaagaaactgccaaaccattctccaaaatggctgcaccaccttatattcccatcagcaagtgtgagggggtcttattcacatcctggccaacattccttgttgtctgtcttttttattataaccattgttctgagtgtttagtggtatctcactgttttgatttgcatttccctaacaacgactgatgttcatcgtcttttcatgcatttatgccatgctttctaataaagcattcatttcaaaatacattcatttgactattcgcaactgatcttttcttgtcactataaatccccaacttagaaaaaaactcttctgatcttaagagtattgtcttggtgtttataaccatcacctaggtgtcagcctgcatggattcttttagagaatggcacccaataattgtcctgtttctgtgtgctacccctttatgtgaacagccctgcagaggaagagcctgctggatgttcctgatggccctccagacctgctcttctctcttgtctcccctcatctgtgctctggaggctgactttgtaccaggatcccttgtgtctggcttcggatggagacacaggcaggtagagagcaacattgaagagcatttttcctctgctccctcactgtgggctgcagtttggaagtagccactgcctttccctgcctagtttttaattctggccaagcagaccctttccaggggctgaatacacttgaaagctcctaccaggagctccctcctctcataccttcagggttagagatggtaagggctgttttgggtgactggtcccttattcttctccacccactgatgggtcccttaaccttgtcaacccttctggagagagcttctttttaactatttatttatttaaatagaatagagatagcatctcactttgttgcccaggctgatctcgaactcctggactcaagtgatgcttccgccttggcctgctgagtagctaggactacgggcaagtgccaccatgcttggctaatttttaaattttttgtggagacagggtcttcctacttcctatgtgacctaggctggtcttgaactcttgggctcaagcaatcctcctgccttggcctctcaaaatgctgagaatacaggtatgagccactatgcccaatctggacagagcatctttaactctcatttttcaagtgtgtcttctcctttttgctgggactctgatacaggagataagcaaaactcctttgtgaaacctaagaccagcacttttatgcataaaacaaatggttagtgctaatgattaacttaaagtagtttcttcagacatatttgacacaacattacccactagtgcctgttcacctctgatcttgtagcactttgggcttttcacaaggacttgtcaccctctaccttgctttgtactcacttgcagtaggagacaattcccaccaccttcaccccaaacagcataaaaatgtaaaagttttttccagtttccctaaagtcatctgagcagctctccctaacccagaggagtgcaattactctaagaacctgtccatacaggcgttttttagtagatgttctttactcagattggagttatgaattgctaaccgtctaaattctctactgattgggagaatgagatgaggagtgaggggaagaaaggaataaagactcatctgaagcttcctaagagggccagcccaggagaaaacagccatgaggcagttcaaatctgcctagccaagccagggacaaggagctgggaatccccacgtgctgtaactgtcacaaatgccacactcaaatgcagatccctgggccactacagattcactgtattaatccattctcacactgctatgaagaaaccctgagactgggtaacttataaaggaaagaggtttaattgattcatggttctgcattgcttgggaggcctcaggaaacttacagtcatggtggaagacaaaggagaagaaggcatcttcctcatagggtggcaggacggagtgagtgtcaagcaaaggcggaaaagtcccttacagaccatcaaatctcttgagaactcagtatcacaagaacagcatgggggtaaccacccctatgattcaattacctcccatagggtccctcacaccacgtgggaattatgggaactacaattcaagatgagatttgggtggggatacagacaaaccatatcattatgcccctggcccctggaaaatctcatgtacccacatttcaaaaccaatcatgccttcagcattaactcagaagtccacagtccaaagtctcatctgagataaggcaggtctcttccacctatgagcctgtaaaatcaaaagcaggttagttacttcctagacaccgtgatggtacacgcattgagtaaagacagctgttccaagtgggagaaattggccaaaacaaaggggctgcaggccccatgctagtccaaaatccagcagggcagtcaaatcttaaagctccaaaatgatctcctttgactccatgtctcacatctaggtcatgctgatgcaagacgtgggtccccatggtcttgggcagctccacccctgtggctctgcagggtacaacctccctcctggctgctttcgtgggctggcactgagtgcctacaggttttccaggtgcacagtgcaagctgtcagtggatctaccattctgaggtctgaaggatggtggccttctcaaagctccactaggcaaggccccagtagggactctgtgtgggggctctgaacctacgtttcccttttgcgctaccctagcagggcttctccatgaaagccctgcccctgtagcagacttctgcctggacatccaggcatttccatacatcttctgaaatccacgcagagtttcccaaacctcaattcttgacttctgtgcactctcaggctgaacaccatgtggaagctgccaaaggttgaggctttaaccctgtaaagcaatggactgagctctacgttgacccctttcagccatggctggagtggctgggatgaaggacaagtccctaggctgcagacagcatgggaatcctgggcctggccaatgaaaccacttttcctcctaggcctccaggcctgtgatgggaagggctgccgtgaagacctcagacatgccctggaggcattttacccattgtcttggtaattaacattcagctcctccttacatatgcaaatttatgcagccagcttgattttctcctcagaaaacgggattttcttttctatcatgttgtcaagctgcgaattttccaaacttttatgctctacttccatcataaaacccaatgcttttaacagcacctgagtcatctcttgaatggtttgctacttagaaatttcttccgccagataccctaaatcatctctctcaagttcaaagttccacaaatatctcaggcaggagcaaaatgctgccagtctctttgctaaaacataacaagggtcatctttgctccagttcccaacaagttcctcatctccatctgagaccacctcagcctggatcttattgttcctatcactatcagcgtttttgtcagagccattcaacaagtctctagggagttccaaattttctcacattttactgtcttcttctgagccctccaaactattccaacctctgcctgttacccagttccaaagtcatttccacatgtttgggtatcttttcagcaataccccactctactggtcaatttactgtattagtccattttcatgctgccgataatgacatacctgagacttgccaatttacaaaagaaagaggtttaattggacttgcagttccatgtggctagggaagcctcacaatcatggcagaaggcaaggaggagcaagtcatgtcttacatggatggtggcaggcaaaaagagagcttgtggaggggaactcctctttttaaaaccatcagatctcatgagactcatccactatcacaagaacagcatgggaaagacctgcccccatgattcaatcacttcccaccaggtccctctcacaacatgtgggaattcaagatgagatctgggtgaagacacagccaaaccatatctgcaagcaaggagggatgtacctttagtagaattaaaccacttatttatgtgaaatactaccactgctatggtctgaatgtttgtgtcccccctagaaattcatatgttgaaatgaaatcaccactgtatttagaggtgggggcttcaagagttgattagatcatgagggcaaagcctcatgaatgagattagtgcccttataaaggaggcctgagggagattgcttgtcctttctgccatgtgaaaatacagcgagaaggaaccatctgtgaaccagagaatgaaacctcactggtgactaaatctgccagtgccttgatcttagtacttgccagcctccagaactctgagaaatacatttctattgtgtataagccactcagcccatgatattttcttatagccgcctgagtggactaaggcagtaatgtaaagattttactagcttttatagtaaaaatctagcttttctagtttgttcttcatatatatatatatatgagcattttcaaacagagtacttctggaagctgaacaacagtgtctcctgttaaaaaattcaaatcctcatccaaattgacatacatgtgctggcgcatatgttgtttatttctctgctgtttataccaaacttttcctgcaaacgcatccatcacacacacatgtggatacgcacaggcacacacatccaaatacactgcaggtaagacccactactactagtctcacagtttcacagtgatgttgggccaaaaacctgatccattattacttactgcggttcacggaagcagctttgtaaacctacataaagattcccccttccttgggaagccataaatgcaacgtttcactgagcagcatggaggcagggtgttaacctgctgtgtgactgctttcaaagagccagcactcctcagcagaagcctaatcatctctgtggatgtgctgtcctgggcctgcttcgataagtgctgtttatgtggctgtattttcaagatagcatggagggatgctaaacttggtatttgaaatctgtttttcctcacggcagcaacaagcctgcagcacagcgctaccagccagctagccaaccccacagccgcctgttgggcaaaggaaccctggaactcgttgaggttgcaggaacatacagaagatcatttctcctctttcattttcttgctgccttttctttcttaaaatcttaacgtcccaaaggaacaactgatgtgagtcagtatgtgttggcagggcaggatggtgtgtgtgtgtgtgtgtgtgtgtgtgtgtgtgtgtgttcgtgttcattcttcctgttcctgttttcccacctcagccttgggtgtcgatgaaactttttttttttttgagatggagtctcgcactgtcgcccaggctggaatgcagtggcacgatctcggctcacttccacttccgcctcctcagttcaagcgattctcctgcctcagcctcccgagtggctgggattacaggtgcctgccaccatgcccagctaattttttgtatttttagtagagacggggtttcaccatgttggccaggctggtctcgacctcctgcccctgtgattctcccgcttcagccacccaaagtgctgagattacagaaatgttttatatacctatttgctccaggcagagtttgaaggcagagacttatatcaattagagatccataaaagccagtgaggtgacatgaacaaaagcattcccaccaacactggaagtattcaagccagattttaaacatgagatttccactttaggataaaggttggatccgataactttgaagatcctctgccatttaaaaattctatgggccagacgtgatggttcacgtctgtaatcccagcactttgggagacagaggcaggaagatcacctgaggtcaggatttcaaagccagtttggccaaggttgtggcacatgcctgcaatcccagctactttgaggctgaggcacaagaatcacttgaacctgggaggtggaggttgcagtgagccgagatcatgctcctgcattctagcctgggcgacagagtgagactctgtccaaaataaacaaacaaataaataaattaaataataaatacaaaaataaatattctgtgatgccatgatcttactcccagtttaatgaacagttctgatggtgatgtttagagtgaaactcatagtttccttgaatattttcctactttgcatatttcccaagatgctttttccattttgaggaagatacaagataagatacttctcactgaaagttctcctttaaggggagaagcaatggcatctgaatctcaaagtttggaaaaaataaaccgttttttatctcttggctgaaggcaaagtgaagaagtaaccacagctcagctctgtggagagtgggggtggcagatgggaaggtgaaggaaggaaaagcaaacacagtcagccctccctccacactggcatccatgcatccacggattcaactaaccaaggaccaaaatatcccaaaaataagaagaaaaattaaaatgacagtacaatgaaaaaaaaatacaatctaataagacaatagagcacaacaactatttcaataacatttacattgtatgaggtattataagtaatctagagatgatttaaagtatatgggagtatgtgcccatatacacaatggcaaatcctatgccgttttatataagagacttgagcatctccagattttggtatctgaggggaatcctggaaccaattccctgcagatactgagaaacaacgctatgctctgggcagaagtacttccagaagagccacacgattgttcccctatccttgctcaacaaaatgccagcatcagaagaaacaatggaaaaacctgattctttcacaagagctgacctctgactataaaggatttagggacaagattcccaacctactctatatggcaaaggaagaaaataaaatgttatcttctttctccccagaggtcactcattgcttttcctctccaaaatatgcttgtcttagttcattcagcggctataacaaaataccatagactgagtgtcttatacacaacaggaatgtattgctcacagttctggaggctgggaagtccaagatcaaggtgacagtggatttagtgtctgctgaggacccactttctgattcatagatgatgctttcttgctgtgtgggcactaatctcattcataaaggctctaccttcagggcctaatcacctccccaagccccagcctcctaataccatcgtattgggggtgaggatttcaacatgtgaattttggggacgtagaaacactcggcttatagcagtgctctttttattttgccttactgatagctaaggtcactctgtgtgcacatttatttcacacttgaagcatccctggtgtttttaataatcacctccagcctgtcacgtgaaattaataacacacacacacgactccatttttcatcaaggccaccttccagaaagaaattactctttgactactcagagaaaggtgcagagattattataaaaatcaggagaggcaatgaataatatgaagaaattcagtgtcccaagttcttttcctcccacacttatttgtagccagtgtgatcattccttatgcacctaaactgcataatctaaattaattccaatgtgttgtagagtttcaccaccattacagtttgctgtgattagcaaaccttaacctagtgccttcatgtagaagtatgactattttcacagttttgtatgaatgtacttgctatatgaccttgggtaactcactttaccttctttgtcttggtcttttaccatctgtaaaatatagtatagtttttccttctccatattttatgattaagaaaaaatagaagatggttagaaaataataggaacacatgattcatgcaatcatgccaaaagtaccaggaaatcacatttcaacatataatttctatgcaggttatcagtaaagcacatctttaaatcactttcaatcaattcacaaggtaacagaattttgatttttttcccctttttaggtgcggattaaatatcccatctagattaagttttatatatatatatatatatatatatatatatatatatatgtaagaatcaatgcaatatcatataggtctcaaaatacgttattttcttactccttctttacattcttctcattaagtcatttttttcacttaacaaatattaattgagtggctactatattccaagaagtatgttaggcatcacaggctctcattttatctatatgcctggtgacaggatagctttgccttgactatatggtgttttcaaattttctttcttttctttttcttttttttttttttttttgagacggagtctcaccctgttgcccaggctggagtatagtgtgctatcttggctcattgcagtatctgcctcccggatacaagtcattctcctgcctcagcctcccaagtagctgagattacaggtgtgtgctacaatgcccagctaatttttataattttagaaaagacaaaattttgtcatgttggccaggccagtcttgaactactgacctcaagtgatccacccacctcggccttccaaagtgctgggattacaggcatgagccaccatgactggcctcagattttctattgacttcatttctatatagccagacagtaatgaattggttctgctgaaaactgtggtcaggataagttagaaacccttttgtttccttatgtatgtctttctaaatttctgctgagctacatcttaataccttattcccagacctcagctcagtgccccagtgcctgacacaaaataggctcaaataataattagttgaaatataaataatgatcataatgctaaatgacaaacagcccttctactactgggtgacctcgggcaagtcactgcatctgatgctctcttcattcataaaataatagacaaggctggtggttgctaaccagctgggtcaagactggtgttattgtaaagatgtgaaaatgcatatacattctataataagtcctacataaaaacagaatatactatttgtcatatatatatgtatgtgcgtatgcacaccacacataaaacaaataacagttttacatgcatgtagattactgtgtctaagaaaaccagtatcatttaaaagcactgtagagtttataacatcttttggctactatgtatttcgttaatgagcacatacaaaaatgtaaaattacaaccattttgacattctaaaacaccttcacactccaacagggcatcactggattaaatgatcttcaatgtcctatctagcacaaatatctgtggttccaattcaacagaaagcagaaaatatttctcaagtgttagctatatacacagcaaacaaccaagtggaaagcagaaaatacagccaatgaactctacaagtagaaaatgtgagcattttctctttttttttgagatgaagtcttgctcttgttgcccaggctggagtgcagtggcgcaatctcggctcactgcaacctccacctctcaggttcaggtgattctcctgccccagtatcccgaatagttgagattacaggcatgtgccaccacgcccagataatgtttttgcatttttgtattttttgtagagacgggctggtctcaaactcctgagctcaggtgatctacccaccttgacctcccaaagtgctgggattacaggcatgagccactgcacccagcctcattttcttttttactaaagctgctgccatgactggctttatcatgccactccccctcccctgtccccaaggtacactggcatggtcctgctctccagagtaagttctacacataaatgacccttttccctttgtccagtaaatggctgggccatgtcctttaaaccagcagtagctgttaactcttggttaaccacaccccatacccacaatgtcaagcaataaatgtttttgggagataactaaagaggctgctggaaacatttgctgcatgttcaatagtgactgacagtggagaggagggagtggtgggcatttcttttatttttatattttgagatggaatcttgctctgtcgcccaggctggagtgtagtggtgggatctcagctcactgcaacctccacctccagggttcacatgattctcctgcctcagcctcccgagtagctgggattacgggtgtgtgccaccatgcccggctaattttttgtattagtagagacagggtttcaccatgttggctaggctggtcttgaactcctgacctcaagtgaactgcctgcctcggcttcccaagataggcatttcataagaatcatacaacctgtcctccctgtacctggggcatacacagaccaagggtacaatgcgtatgagctaaagagatcctggctgcaacgtatttgagcaaaaaaataataatcatttgtattatacaatgaagagagatgatgaaatggttgtgacttatttgagaatataaactatagtgatcaataaaatcacatttggtgcggtatttaacccatttatagagatgtatattttcactctatgttaatttgcagggacatttgagaggaaatgtctgtataataaaaacattaaaatagaaatatttcaatctcagttttgcctaaggccccaagtccttgtttatcaggatttgaaaacaagataaccagaaaaaaaaactttatgactctgagtccctcagtcatcttgaggatataaatctgatatgtatattaagggttcaaaatggtaggattagaaattaaaataaggcttatttggataaattgttctataaaccccctcccatagggagtgtgggggagtttgcctctcacctcaatccaagagaaaggttttagacatcttgatatgtagcccctggggtttggaaactgtattagtcagtgttctccaaagagactgaatcaatagaatacagatatagatgtagatacagatagatgtgagggaatttattaggggaatggagtcacacaattatggaggctgagacatcccacataggccttctgcaaactggagaaccagagaagccaggagagtggctcagtccaagtccgaaggcctgagaatcaaggaagttaatggtgtagctctgtctgaggccaaaggcacaagaacccagagggccactgttgcaagccctggagtccaaaggcgggaaaacctggaatccggatgtccaaggccaggagaagaagggcatcccagctccaaaagagaaggtgagcaagagtctgccccctccttccaccattctttttctatctgggcccctagctgtttgcacggtgtctgtcaacatcagggtggatcttccccactcagtccactggcgcacatgctagtctcctgcatacacaccctaacagtcgtgcccagaaacaatgtttcaccagccatctaggcatccctcaatctagtcaagttgacacctaaaattagctatcacgcagactgatgtctgatttgtgctataacatctatggaaagagagacggtagcggatacgcagttctgattgtggcctgaagagagggcaacaacctgtccccacagagagtcagagcaaagaaagcccaagttccttagactctgctcaggaagcctgtccagccatgcaagaagactccagcagaaggaaaatgaaggggtgccacctgcatgcagcgggtgaagggctgaagaagggatcctaaacaaccaggagaggagaaacactcaactctgtcaaagacactgcagataggagatgtcaagtgaactgacaggatggattaggaactcttttttttttttttttttttttactttaagttctgggttacatgtgcagaacgtgcagttttgttacataggtatacacatgccatgggtttgctgcacccatcaacccatcacctgcaacaccaggctgccacaacacttgggttacacctaatgaggtgactccatttccattgtattgctattctggttagtgagaagacacactataggataaagtttgcattagaagagccaggaaaatatgaagtagaattcctctttaattaatgttaaagaacttaatcacagagggagaaataaatgttcacattggcacccatcgatatcatgaatggaatacaagctccatggtaccatgtgcttcctctcttgtaggatatggactgagccaccttggcaaactatgcccatggtatattcacttcatcaacaaagctagtccagaacattctatgcatttgcttcttataacctgattcttggccacttaagcagcattctcaatgcttccaatgagtgaaaatgaaaaaaagaggacaaaataagccaataattccagctcattagcagccaaaaaaaaaaaaaaagatctttgggcaagccaaagttctaaggggaaagggggaataacgacctaaagaccagtgccacgtatgtttgatactcttaactgtaactctggaacaacaacaacaaaaaccccatccaggtttaaaaatatgtgtaaaacaccatattataatataatctcatgtttattattttaaagtaggaaaatgcagatagtgtgtcttttgcatcactgttgaaaatacgatcattcattgaagacagagcagtggtatcctagttaaaactctttcaagttattcaacaataattgggagcttcatcaatagcaattgctattttccatcactgaatgcaactcattcctgaagcccattgaacactccagaatattgtgcaggcgtaggtcttgctgactcagttgtagccagcaatatttagtcatgctcctcgtcaggtacttctggctctctatgatgtggagaaatggtaggaggatgtcatttggacccctgtgttcaatggagcaatgtggttggttctggccaatgagctgtgagtggaagagacctgccgcttctgccgagcatttcgtatatgtgtgggtgtgagtatactctccttctcctcccatggtggccagcaacgttccaggggctgagccccctgagaagcaatgcccccatttgccagagtcagccatgtagtatgagtgaggaagaaaactttgtcttaagcccatgagattcaggggttatttgttactacctgttaacctcccctgactgatacaaaggtcttattgtctacctccttactgatattgactgatcaggtcacttactgaatatgcctggactgcaactcagtgcccatttttattttaaagatcgatgagttgttttatgattggaacttggggtaatacaaataatacatttcccatacgagcatcactaagagtaaacattgactgacaatgaatagtcattgttgatttgcacataaacccacaggtagattttgttcattttgtaagatagaaattagatgcatttgtcaggctgatgactgagggtgggagcatcatggagagtcacattagaagtggtgacacctgccatgagggcacagcatttgtgcaggtactgtgagaccaaatgcactgccttcaagctggatgcaatgtaatcaatccactttaacatgagtaatcattgctgagcatttaacatgagaatcatattataacacatattatgaggcgctgaacaatttggtgaagaagagagttatacaagttatatcgatgagttcagatgatttgaaaaaaaaaaagtggttagatttacaaaaggcaaggaaggaaaatgtgtaaagggaaatactctgtgctgctcctccagaaagacattccccaacagaggggggcttgccccagtgcggtaccacctgtgttggggcaggtaagcccacctctttgggtgttcagcattggataacacatttacctgcagatctaaaccacatcccgcagtgtagactttttcagtaataatggtggaaacctgatctccttggccttactactttgttctatgtttcaatttgtccagaatagggacagagaagcaagtgctgttgattggtctcttcaaatacagcaagggaaagtcctaatggagaagccagtcttaggctgagatgggaaggaaggaagaaatggggtttgaacgtgaggaggatgggaagtattccaggatacagtactatggcacaaaatcaaggactaaatgcttatctgtctattttttgagttctgtaaagtgctttcacatacatgataaaaatgtgtaatggcactgatggtcagtgtaaatcctgtgctctcttctgtatccaaacactggcagccctggactcctagtgaaggagacagacatgtgtcctgtttttgtggcgagattctagtggtgaagttagacaggaagcaagtagtacgtatataaagtattttcagatactgattagtgccatgaatgaaaataagggagggtaaggagacaggatagtggaggctcgctcttctgggcagttggttaggtctggtctgtgaagatgggtctttgatcagagtcctaactgcaaggagacaaagagccccaaggagaaacaggaagggaagaatctcaggcagcaagaaaggcaatagtacagaccctgaggggaaacgtgtttggctgtggaggaggccagtgtggccctaggggatcaggaggggtgagtccaggggaagaaagccataacatgcaagtagcagctggaggaggaccccaatgtccaaggtcaggggccctgaaatgaaagaaaaggccagtgaaagccaggactgtgcccagagaaggcgaagtgattagaacactcttgaaaatgaatctgctactgggttagggtgtctccccgaatgtcgggaaaactggccagaggtcattaaaatattgcaggtgcgagataattagaacctagccttgggcagttattacaggtgctaaaatctgaaaactcaaactgaggaaaattggcagagctgggagacttattggatgacaagggcaaagaggagagagaaatggcagacaattcagggtcactggctgactttcactgtcagtgatggcagacgtgggaggggaggccatctaacaaatgctcacgtctagggcttatgtagtcaacggtgagagcaacctgcaaaaaaataaaaaataaaaatactgttccaagagccattttttaaaaaaagaatgtcacgcagactgaaaaagaaaatcaaaataaaatcaagaaaagggattgtattacaaactcactattctcaagataaactgaaaaaggcaaatttcatacttagtaatgagaacaaaataaacactttcaattgattaatattgcaatacaatcattttgattatgtgtctttattttatttgttattttttcagtcagggtctcactgtcttgcctatgctggagtgcagtggcaacctctgcctcccagtccaagcaattctcccacctcagcttcccaagtagctgggattacaggtgcataccccgaggcccagctaatttttgtattttttggtagatatgggtttcaccatgttggccaggctggtgaactcctgacctcaagtgatctcccctcctctgcctcccaaagtgttgggattacaggcgtgagccacctcacctggccagattatgtgtctttaaaaaataaaaatgaagacatgcataaattagtatagtagaaggaaaaaagagatacgacaccttttatcttttttagggatcaatgaaaggccaagagatttgagaactgtaagaaagccctgagaagcacattgttcaaaatttatgctcacttgaaaaaaagaaaaaaaaaaaaaaaaaggaaatgacctaggctgttacaaaagttaaacccaaattgagcaccttttaaataaggttgtcaaaggttaagtatgtttgaggtaaaattatttccccagtctcaaaatgaaatttccagtagactttagaaaaaaaaaatatggaaaacaaacatacatggagaaactgcattttacaactgaacactgggtttcaagtagagtgatttttaaaaatctcatatttagatactgtctggttttaaaaataggccaaatggatcataggctgagaatcagaaatccttcttttgggttgtctcttctccgtaagcctcaagtacttcttagtcctttcttcatgactagataaaattatagtaactaccacagggattatgattcctagtcaaacatcaatcatagtcctacacacaaatgatgtcaagtgctaggcactgtctaggttctataatattagagttcctaaatttacacacgcacgcacacacacacacacacacacacctgagatagaggatagaaagataaatgatgatagatagatagatagatagatagatagatagatagatacatatacatagacagacagacagaaagatagatgctaggctgggagtggtggctcacacttgtaatttcagtcctttaggagcctgaagctggaggattgcttgagcccaggagttcaggagttcaagaccacctgggcaacaaagcaaggctctgtctctatgaaacacaaacaaacaaaaaattagctggacatggtaacgcacacttgtgctcccagatactaggaaggctgaggcaagaggatcacaggagcccaggaggtcaaggctgcagtgagccatgattgtgccactgcactccagcctgggcaacagagagagactctgtctcaaaaaaaagaaaaaaaagaaagatagatgctagatagatgatagatggaaaggggaaggaaagggaaaggggagaggaggggaggggagacgaggggaggggaggggaggggaaatcccttcaccgaagacttgtaggtcaggtctcaaagagcagccagcagacagccttcagctgtcaactacatcagggattgacccagctgcagagaactgcctcacacaaggtcacaccccttcctgggtgactcacaatcaactgacacaatcaataaaacctgtctgtcttgagccaagttggcacaactctgaagatccattctgattgtggagttccctgtgaggtctgtgtggctgggcctgcattgtagctcaatttctccccctcctcactactgtctcctctcttcccttccagatgtcattaccaaggatcctttttaattagcatcctatattccaaactctaaccacagtctgcttcctgtacttgcatatattcattacatacatatgtgtgagtgtacatatatgttttaaaaatccctagcaagagtaagtacgttatttggtcagtcagctgttaaaacttccactttctccagttgtctggtggaattaaaaaaaaaaaaagactttcacttttattagtgcaattcatatcagtgtgccactggtagctcttggaagagaaggaagagagagctaatatggaacctggagacaagttccactctgctcctgctgaatgcccttctcctttgcttctacctacctccagaagtgctggccattgtcagctcctgaaaaggctgatgctctgacctgtttcagtgaacggggagaggacttgaggctgggaaacctttggaataggcaaggggtccccctacataggcttccctccatgactcatagtgtgttccttggttcgctccctgtggtcaaccacctgctgcaaaaagtcgttcactgctggtgtgagaatcattgtcacctacactcaagtaaaaatgtgtatcaaaggaacagatgcttctcttccatgcaacctgaatatagatctatcaggcaaattcagacagctgttctagatgcagagaccatcatatctgctaggggtcagcaaacactgaccatggctcaaatctggcctgccatcagattttgttgggcccgggagtgaagaatgttttcaggcttttcagtggttgaaaaaaataaaataaaaagcataatatttcataatatgtgaaaattatataaaatctaatttgtagtgtccataaataaacttttttcttttcttttcttttctttttttttttttttgatactgagtctcgctctgttgcccaggctggagtgcagtggtgcgatctgggctcactgcaagctccacctcccggtcacgccattctcctgcctcagcctcccgagtaggtgtgactacaggcgcccgccaccacgcctggctaatttttttttttaatttttagtagagacagggtttcaccgtgttagccaggatggtctcatctcctgaccttatgatccgcccgcctcagtctcccaaagtgctggaattacaggtgtgagccaccacgcctgtccccataaataaacttttattaggacacagccatgctaattcatttacatattgtctatagctgcttttgatccacaatagcatagttgggaagttgtgacagatacctgaaagccaaatatgtttactatctggccctttgcagaaaaactttgccaaccacagagctatgcgatttaggattatacaacacaatatcacacatttgcttattggtgaacatccaatgggtggatattcacacagatatagacttgttacctgtacatgtctgtaagtatctggcctctcataaaacactaaacaccttccacagaagtgcacaatgatgtagagaccccacgttatgctcaaacccaagcgctatctttcttcacatctttttagttcaaaatatctgccttaaaacagaactggaaaaacaacatttgtcaagtaagtgcagccgtgttaatgttaaatagatgaatgcatggatggatcttttaacatacaagcaatggagaagatatgccagcaatgataatacttgtgttagtgtgaagggtattttagatctgccccaaactcaggtagaaaaagtttccctgaccttttccctaccagtttagaattttaattcatcccagagagtcagtggctttgacacaatagcacttactcttcagatgcctaaaattttatggtcaaaaatatcaaaagattagaaatgtgattttcaatcccaaaagccacattgaagttcaattaaacaaaaatgcctggggttttcatatgcactgaaaatcataaaaatcaattttattacaaatctacccatgaaaccgtctatctgtctctccatccatcaatttatttctgcaatatgtctcaaaatagcacccaagagtttgtgccaattcttatttttcaagatatatgagctttttcaagttcacaagctccataaacttcacaaactccatatggtgttcacaaaggaataataaatgttttttatcttttacattgtttatgaacacataattcatttttactatatcaattgcttgcctaagaagttacaatgcttccttttctgcttattctggcttacaagcctttcagaattgaatcttacctgatctgttcaatattacattctacattacacacccaatttcactgtatctcacccacctgtcttcctacacactaaagcccttactcctcctaatcgccatgttttcattatctccatgtcccttttatgtgttgttctttctacaaagaaaccccttttctcctctttttgaaaaacacctacttatccttctagaacaacctaaatgtaggaactttccaaattctccagggaaatatagcccttccttccttccatccatccatccacccacccactcacctactcactaatttatcccttactgaacaaacatactgagcatctattagatgctcaaaaatgtataacaaataagctatttctgcttggtttataaggacactgagatatcagcaaagtgttatgggaccgaagaagaagaaaatagaagaaagacatcaaagtcaaactggaagtaggacagtttggaaagcatttcccagaagaggtgatactgagttaagtatacacaggacaagaattatgcagccaggtggatgagggatgggaagaggagaaagggagagggtgttctaagccaaaaacacagcaggtaagaaactgagtcaccactaggaaagttaaatcaatatggcagaaagaaaacctgctccttgggtcatttcatcatgcgtttggtagagcacttacaactttatattaagtaatatgggcttgaggttctgctttagataatatggacttgaggttcttctaccttttattacctgtcagaaatagggttttaatccctgggaggtgaagcttgcagtgagccaagatagcaccacggcactatagcctgggtgacagagcgagactccatctcaaaaaaaaaaaaaaaaaaaagaaaaagaaaaagaaaaagaaatagggttttcatctggaaatatttggggctaagtgttgtcctgaaaggaactttggaaaagaaatattccattacacttgctttgtcatcttgtgatacagactcagcccatggatcaacaaaatgccttcattctcaacagtccaaagagctctgggtaggatctcaccttccttacaaaattcatgtcagatgttgaataatagacattattctgttcctcttccaagtgagagacaatgagtggctcatcccctgaacggtgtgtggaataaggtgaaacatgtagcaatcaagaaactggactcatcccctgaacggtgtgtggaataaggtgaaacacgtagcaatcaagaactggactcatcccctgaacggtgtgtggaataaggtgaaacacgtagcagtctagaactggctgcagaatatatgtttggattttgtaactttcatgctcccaaaactcagagtcatttttctacattggctctttccctgtattatcaattgtacccttcacataacaactgtttcctaatggcaaccaatcaattcagaattcaaatggcgattcgccagtttgatatctacgttgccctggggttatggaagaagctgcaaattttggggtactgttccagcttattaaatctttttattgaaatttgattcatcttttcctgaccttatcaaaccatcccggccttgtcatctacagcaggactttgcaaagtggactcctgtcgcttgctgcattttactggtgtgaaatcagaaggagtatggtggataatgcattttgaatccggttagacattaattattaggttggggcaaaagtgatagttttttttgccattaaaaaaccatgatcacttttgccccaacctaataacacccaaaccacctgtagaaatgatttaagaaatcttcaactcaaatgccttctttcaggaggagttttaaaatagaaattacatcattccaaggttgtgtctgcatatgcagttgtatcaaaaaacttaaatgtaatttttgagggaactaagccaggagaaagggccatagtgatgaatgtatccaaaagtagccatcagagaatccgtgagttcttacactgacacaggaagaccactgtgtttgacagatgcaaaatttccattcagatctggtcagcactcttcacctaactggtgtttttaagagataattaaaactgtttgcacaatggcacagtccatgacacattaataataataactaataacacattaataataataactaataataactaatggcacagtccatgacacattaataataactaatatataataattatattattataactaataactaataataactaatataacgaattatattaatgatagtaactaataatgtgaccatgacacattaataataactaatattaataataataactaatattcaatttaattctcatttctataagtgccaggaaatttgctaacattgtatgtatacatgtaatacatgtacattacatctcatgtaatcataactgttttattgcttttttttttttttttgagacagagtctcactctgttgctcaggctggagtgcaatggcaccacctcggctcactgcaacctccacctcccaggttcaagcgattctcctgcctcagccacccgagtagctgggattacaggcgcctgctaccacgcctggctaatttttgtatttttagtagagatgagtttcatcaccttggtcaggctggtctcgaactcctgacctcaggtgatccacctgcctcggcctcccaaagtgctgggattacaggcttgagccaccgtgcccggccaactgttctattgttaaagcaggtagctaggcagacgtgagcaggtcaggagaggacccccaacccctccccaggaatgtcagctgaccactaggtaatggtcaggaggttgttaaactatttctctaaaataataattgattgcagctggtaccaaagaaagaccgtctcccaatagatataaaacacctgaaactggtgatcagcttccaaataagatctcagaagttgggcgagcacgctaagcatgtgcactaagaggcaaaatggcggcgtttaactggtatatgagcttcctccaggaacgctctgctggtaagggaaaaacgcctcaagtgagcatgcacacaacttcagtaaacacactgcgcacgcagccccttccaagtgctgacaggccactgtacatgcggacagcccgctccgaaggaagaatcaggggagaagaaatgcaagcccaaaaaccctgccaaggtataaaaccccagtcaaggaccggatggggcactggatctctcaagtcacccacttggtcctctggcaagtgtattttgcttccttttgttcctgccctaaagctttttaaacaactctgactcctgctctaaaacttgcctgtatctctcccgctgccttaaacccacttctaccccttggccaaattctttcctttgaagaggcaaggatcgagtttctgcagacccatacaggttctccactggtcacaccatcaagtaagcattatcattattattcccattttacagaagggaaaactgagtcttaaagttataagctttcttccccgagttcacacagctaataaatacaagaggagaatttgaagtaaggcagtctgactctggttctaaaccaagtttatagtctattgatagctgttgccattgttaaagcccatgtcatatttagaatatagttccagagttggcacattggaaatgacaatattactttaaaaaatgtgttgaagatgggagttaaattgttttggaatttgccactacataaactatataataggggcagatatgagcagtgtcagattaagcagagacaggctccgtggccaggaaggcataaccatttgcggcttaacacagccaaaaggtcagaaagggggttcattcgagggagccaggaaacggggcctgaagcaagacttggcagtgacctcctaactttatcagtgaaaagaaggtgatttcactcagcctgctcagtcctagggctcagtagctttttgtggagatgactgcatagcacccctcttttcaaatacagggtggaggaaatcaaaatatctcaaaacatccttctcggacatattttgagatggatgttcagagggccagcagatagaagtagccatgcaaagctgtcttttgtcggggagatacacatctgcagagaaaatctgcattgatgtagccaggctttctccaagggcctcccctgtcctcttccagatctaggaaagattaaccgactgtcgacacctttgaaggtctgaaagaaacatttaccatctattctctctgagggcggctacctgtgagatttcatctacataacaagtgatctttgctagccagggctcctcttctctccctcccataatcacaacctgttttgccacaatccaagcccccattctttctgcaacctcaagatggtacataagcttctgaaccccactggggagttgggataatcactctgcagttttcccccatgcacatgttatctatgaacagaaggacaagttagttaccctctcctcacaacccacacctcaccaacaagcaagccatcaattttgcagcagactgaagctggaagtcctctaattcagttccactctgacactctcttcctggagatagcgtcagatcccacaggttgagggctcagtccccaagaatgccccttgcttctgacgcgaattacaagtcccagtttatttcacctgtgcttctgacagaccagctggaaattagagatcccatgatcccctgcttgagttcaattaatttgctagagtggctttctgaacctagggaacacttatgcttactggtttattataaaggatattacaaaggatacaggtgaagagatgcatagggtgaggtatggaggaagggttgtggagcttccatgaccttcctgaatggctccaccctccaggaactgccacatgttcagctatccagaagctctcagaaccctatcctcttttttttttttttaagcttcattatgtaagcatgattgactaaacctttggccattggtggtcaacttaaccttcagcccctttcccctccttggaagttgaggggtagggctgaaagtcccagccctccaatcatgcattggtcttttcagcgtccggtccccatcctgaagccacctagggactgccagccatcagccaactcattagcatacaaaaagacatcacttcggagattctaaggattttaggagttgtatgttaggaaatgggatcaaagaccaaatatatattctacaatatcacaggagtccttgaccaaactagataggccaggtctggcagactgttgctagctttacctcatctttcaatttttctagagaagtcagatatctgaacattaatgtgaaattttccatgtttaaaaaatactgcgcaggccaacaaaacacatcccctactcagattctgcgcatgggccaccgatttgcaagtggcatgtgctcatatgtacttcagatcaatacattctaataccgaggcaacttttttctcagtaatctaaatttagggaactattctcagaattgcccataggtcttatataatctgaacatcacaagagaactcaaatgactataaccataatcgtagaactgaactgtgtcattcacatgctgtcatatccatcacatttccaactcattccaagcaaatcctcagctgatcctgtgtaagggctcactccttccctatgtgcgttctcatcatttgatgaacttaactttggcaaggagctagaagacttagctcttgacaccacagcatgagatgggaactaaattggtatatgacttgattcttgggcacagcagtttatgtttttaaccaacactcattccagaagtagactacataagataagtagcatacacacatatgcatttcttaaactaccgatttaataattcattccccaaatacttaatgattgcataccatgttacagaatctatgctaggggtcgagcacacaatatttagacacatgcacacgtatgtttattgcagcactattcacaatagcaaagacttggaaccaacccaaatgtccaacaatgatagactggattaagaaaatgtggcacatatacacatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggcgattgttgtggggtagggggaggggggagggatagcattgggagatatacctaatgctagatgacgagttagtgggtgcagcacatcagcatggcacatgtatacatatgtaactaacctgaacattgtgcacatgtaccctaaaacttaaagtataataataataaaaaaaaaaaaaaaccagccctgaaaaaaaaaaagaaagaaaaagacaacctggtaccaaacctcaaatgcttttacccaacagcagtagttctcaaaatttggcccccagatcagaagcatctgcatcggccactgagaaattgttagcaacacaaattcgtaggccccgcctcagaacctcagatctactgaatctgagagtctgggaaccaggctcagcaatctgcgttgtaataagccctccaggtgattccgatgcaagctcatgtctgagaagctcatgtctggagaacatctgggggtggggaacaggggtagaattcaaataaaaaacacaggagactgatttacacatagtggccagaaaagcatctcttaatagatgacagttgaacctgaaaaatgaaatggagtcagtccttgaaggataggaagaagaaaacaggatgagtggggaaaacattttagggagaagcggcacacagcagtgaccttgtgcagacaaagaagtcagcgtatgcaaagaactgatcaaaagaccctctggctggagcccagcaaatgagaagagaatgtaataagataagattgaatcaatgactccggagtagatctgaggtgcagagatggcaggaagcgaaaggatgaccctgacggacaagagctggggctgagaatggggaaaagtttatgatttcagaagggagggagtcactctgtagctgaccaaggctgagataggcagggccagagattttgggtgtaaaaacttcctagaaagtgcctttagcgataattatttgcagacagaattatcgtgaataagtaatcagaagacttctgagtttttgaaagactgtactatccaataaaccacatttccaagcttcaagcccctgccagtcttcagattgcaagagaaccctgggccccaaagcttatgctgactatgcagtgccaaaagcagcatattctgcaatgtccttttttgggtaaggtcatgaataatgtgctaagaacaatctcttgaagggatgagacagagggcacaaagagagtgaacaatggaattccttccagaaggcagaatcaggccccatggagtaaaccccatattctctactgccagcgatgggaatctgttattcttgaccagtaaaatgtgttaattgctatgaaatactttctggcctgtgtttcccatcctcttcctctccaaatgagagtttttattacagtttcctgtgccactgctccattgaatatggggtaatacagggcatggataacctgtcttttagtttgtcagtcaccaaaataagaaaagcaatacacagacccgggggagaggacgtgaatgacacaggcattctggacttcagttcagatgcagtaactggttagatcttcgggcttgcctccttttgggagcaggtgagtgtgttatgtgtggggtgaagaatacatacaaatacgtgtttggccgggggcagactgaagcagattgttggatttcctccagtattcgttcttctcatctttcaatgtaaataaagtcaccaacttctgactgagcatacgccacctgggataaatgccaaatttcccagcctgccttgagatccggtggggtcatgtgactaagatctggccaatgtggtaaaaacgaatgtgtcatgtggcatcaaccaggagatttccacagggacagctgtactctttggtcctcctctttttttttttttcttgagacgagtctcgccctgtcacccaggctggagggcaatggcgcaatctcggctcactgcaacctccacctccttggttcaagcgattctcatgcctcagcctcatgagtagctgggattacaggtgcacaccaccacgcccggctaattttttgcatttttagtagagacggggtttcatcatgttggccaggcttgtctcaatctcctgacctcatgatcctcccgcctcagcctcccaaagtactgggattacagggatgaaccaccacgcccggcctgatccttcttttatatttccccttcctctttcctgctgtcagttacccaaatattacctcggacaaagagccaggtctgtactcctggggtggtgtggtcatggaagctggaaggggcaactgaaaacatcttggagcaaagccttcagactgcatgtcttcaagactcttgtgaaaaaaatgaaaactgtttatttggaatttctgttatttgcaaatgaacttatcttaaccaatatggactcttggccactaaaagtagcttaaattttactccaaatgcactagcaacccatgagagggtttcaagcattgagcacaataggctctgctgtgttacaatacttttaactctgcaaggaatgatgagaaagaggatgggggtataggccatgtggaaaatggcaccagcaaatatggtggattcaggagggataaaggggggacatttttgataggttttagaggtaacatagtattttttgataaatttgatgagattgaagagaaaaataaaatattatctatatctcatggataatacaagtgatacttatttttatcaagttagttgacaaatagaaatttctctgggaaattggaaatatatgcatggcagatactcactagggtggctcccatgattcccgccccagcatcagtatctttgtgcaatctcctcccctcgagtgtgtgctggacctgtggcctgctttcaacaagagaatatggcaaacttgatggggttatcactcccctgactacgttatgttatatcacaaaggttgggggattttgcagattttgttcgagcccctatagagttaataaaaaggaatatatatactgcatgggtctgacctaatcaggccctttaaaaagcatctttctctctctctctgtctctctctctctctccccccacctccccacctccccaacacacacacatagagagagcgagagagagagaactaggccaagagcccaatgagcagaggtagaagtcagagactgcaggcagcaattactctctctccattgctggtttggaggaagcaggccaccatgacttctacagctgcaaggagatgaactgtgcccataacctgaagaagctaggaagtggatcgttcctctcagagccttcacataagaatgccacctggttgacatcttcatttcagccttgtgagaccctaaacagaggacataaactgtccccagactcctgacctcctgactcacaaaaactgtgaagtaataaatgggtgtttttttaagtcactaaaaagtttgtagtaatttgttctgcagcaataggatactatacatacatacatttatacacacatgtaatatatatgttatatacattaacatgtcaatgtagaaaatgatatacatgtatctatatgtgtatgttccttaagtttatcctccttaagaaaatcaagtccttttttcatccacaaatgcctgtgaatgtgacaatgtatgtctatgtatgtgtgtttctttttttttttttttttttttttttgagacagagtctcactctgtctcccaggctggagtgcagtggcgcgatcttgggtcactgcaaccactccctcctgggtgcaagcaattctctgcctcagcctcccaagtagctgggattacaggcacccaccaccacacccggctaatttttttgtatttttagtagagacggggtttcaccatcttggccaggctggtcttgaactcctgaccttgtgatccacctgcctcggcctcccaaagtgctgggattacaggcgtgaaccacccgcacctggcctgtatatgtgtttctttaggctataattgaaaacagaatattgctactttgactttactgatggctagtataagatgaggtcatttcttagttataaaattaggaatttacctattaaacagaagaaattcaattgtgtttcatatatgtacttgtttctgtgtaagaaatcgattatgtttcttcctatgtatgttcgtatgcgtgtgtgagtgcatttataacaagcatcctcaatgcttaggagggttctcaaccagccaatttctcacattacctcaactgagaacagatagctgcagcaataaaagaatatactcagatctcggtgggtatcttagagacatccctgatgaaatctcacaatgactctgggatagctaccctgggctcccttttcagaagggccaccgtccatcagcatggtgggggatcactatggccattgactaacagagacagcagcaatctcatattctgcttttggaattctcttgacatgctaattccatattatcaaatatatcacgggtatcatttagacttttctgtacaatgtgttccagtcaccactccgacttttgctttcaattatttcccaaagatttgaaataacagataaacttaattttcatttatatgcctttctctactgcctacttccttttatttgtcaaatgtatgataactctttaaaattaaaaaaatacatattttacaagtaaaatctgcatgaatcaaccttgagttttataattaggtgcaatcatgatttaatgtgtttagattctagacaacttctcaatcatcctaaagagatacacattagccttatacggagacagaaacagagaaagaaggcctgcaaatctcttacgcatttatttttataaacatatattataaacttactatgtatctgaggcaccgtggtggggtgtatagtctatgacctcaaggctaccatgttgtcatggaagaggcagactggcagagcaatgatgcaattacaaataagagctgatgtgcaaaaggctgatggagatctggagggagcagtgcggaaagtgacttgctgggcagtaggaaagatttcactctatttttgtagcacaaacacaaaatcaccccaattcctggggtaaaaattatttatgttgcattttaggtaaaccaatagtattcttaacagtctttaatttctgttttcttctttaaactctactgcatccaagcctacagaggactcaatagtagaagcaataatatcatcattttaggatagtgagacgtgattggtgataggagtaatctaattagacaagcaaaacactctggagtcatttaatatttcagtgtaggagctatcagtcctataaactttaatcatcaggaaaaaaattattgctttgctgcacactttgtgataatagccatgagtcattaaagtaaggttcaattatgttcattatgttctatttaaaacggaaagaaacataccatatttagaaatctttctgtccaatgagttatctttaaatactacctaaataggtgaccgtttcaaaatttcattcatcaaatatgtcatttgttcataatgttggaaaaataaaatgccaacatactaaaaaaaaatcacattacatttaaatagttgatagtggtctctaaagttttttcctaatttctcagcataattccataaggcagacattgtttccattgtgccactgaagcaactgacacagtcacttaaccttagtcatgtaagtcacccagttcttttaactcctataaatgctctttcatttatccatctattaattcaatagactcatttattgagcattcatatgacccacgtttcataaaataaaatggcagacagtttaggtaatcctgtaaatctacaattataacatgattcaaaatttttctggaggtggattttctagtaacaagtgattcctagaggactttaactcactttacaatgaaatactacctgccatttaattacaccagggaatacttcgggtattttgagagatagatggattaagtcggtaccctatccgtgagtgacacaggtccacgaatgggaagaactccagctttctctgtatgttcctcacataaccagatactttaaatgactttgtaattttttgttcatctctcagttcagcaggtgaaaaaacaaaacaaaacaaaaaaatcaaatcagtcagagctaacgcatcctgtggagaaacaaaaggactgactctgtttctttcttcaatgggctgtttgatattgtgtagatttagtgtctgtgctcttcttaaaaaattccacttaacgacccaaaaagaagagcattactttcacaatttaataaatggaaaactgtggaatagaaaggttaagtgagctgattatgctcagacaagtccttagcaacatagcatttctctgccagagattacatgagaagctgcctttccatgattcccattgtttatgcagtcattctgtgttgtcaaggcactttttgatttttgtcttctgtttcctaattctgccaagttattctttttttaaaaaaggcacagcacacgtggcaatctaaaatccagagtttttcttggcatcactgattatgcttttggatgaatgaacacaccgacttggatgaggaaaatgcaaaagaaaaatagtaaaatagtaaaataagagaagtattatgttcaatatttgaaataattacagtcactcaggaaaaaaataagagcatcttaaaatccattagctaacaggactaggagggcaaagaacagcatgaaacagctattggaatttataccttttttttaaactcacagactaaaccaagataccattcatagtttaaggctagggggatagcaaattggcctcacattagaaagaattgtccaggctttgaattgatagcccaaagacaaaacaaatctggctgtgtgtctaaagtcagccttgattttgatgtcagttaatttgcttgtgactttgaaaactttaaattgttgccatctttaacccttgagaaatgagtcatctgtttctgtaaagtagaaaaggacaaaatcagcaagaaagaaaattttattttcaaagttcaaagagaatgcaataagtagtggagatgatttaccagtaactgtgctattgtttttctcaagagtttgaaatactctcttaaggaacacaaaaagcaaacaattttaagaataattgtagaagtcaggttttctttctctcaaatttttgcaacaagagaaagccgaggaatttgcttggcataactataaaggaaagcatagagcagctattgcaattttttttaaagacatgattagaccaccttggtatcttcaatacagtttccaaattattttccttgtaataaataattcatgatcagtattattatcctaatttttcaggtgcataaactgaggcccataggtttttatatcgctcaacaaagtgactggtttccaaggtgaaggtctaggatctgagccctactctgtgactctgtgaactccatcctctgacctctactctagctcacttcttccagtgaatcttcatactttgattgcctgcattgtactttcttttcctatacaaataaagatggcttgcctgtcttactcaggtcatggagttgttataaatatcaaatatcacaatgtatgtaaacatggtttaggaatttaatagtgaagagtttttattttaatgcatatagaaagcatgattgattagtctgaaactggttgtttggatttagagcagctattttagtggtaatctgaaaactacctgccaaacacggtggctcatacctgtaatcctacaattttgggagatcaaggcaggaggattacttgagcccaggagttcaagaccagcctgtgcaacacagtgagaccctggtctttacaaaaaacaattagctgggcatggtgctgtgtgtctgtagtcccagctactcaggaagctgaggcaagaggatcacttgagcctaggaatttgaggctgcaatcagccatgatagcaccattgtactctagcctgggcaaggagcaagaccttgtctctaaaataaaaaataaaaagaaaattactaacctttgcttcctgcccctaccaccacttactaccctcccatagtcaagctggagaattccagagatttatagtaaatcttccccatattcccattcttccaggacacactcagctaccacacctacccatactttacctggaagaaggatgagtgtgaaagcaccattcatgcttctgattgcattttaacctaacactcatgatatacagagtttgaccagtcaaagatgcaaatcattcccaaatgtgctgggttcctgtgtttaatgagaattataggacttgctatccaccttgaggtctgctggagataaaccaaagaaaaatatgagcaacagctctttttcatgaataggttgaaaacttgcccaataattcttagcagttctaggacaagacccaattttctacttgcagccttgtttgaggtcccaggttgaaaaaattaaaagtcagatactgaagcaccccaccaccttgattcacaaatgcagtttctatgtgttacaaccagaatcaggatgcaagaaacttcaggacaagaaaacttgactttgtccaaagtgtgattttgtcagagattaatgcttctgttcccaataccaagtaagaaattgattggttcagatccacagaatgagaatgaggaggcactgatgctgctgagaactcagtgcattgcatgtcacacctaaagcacacatttatttttaaagatctcaactcaatcattctgtttgccaggcactgggctgtgagctttctatgaagtattttaattaatccttaacaaacactttttatgtgggggctatcattttacacatgaggaaacagctagtggatccaaagctagaacacaccccaacactgggctatttgcaaaaagttagcaaaaagtacgtatctggggacaactgcttccttctcccctatgcctttgtgatcagaaggagtatttctatgagaggtggtcctgtgagtgtatgatgaacacttaaaaacaaactataaagctccttttagtgtgttcagaagcgaaaatgttttctatgtgttactagactccaattcacagaattttgtttttttttttttttttttttttttgagacggagtcccgaactgtcacctgagctggagtgcagtggcgcaatctcggctcactacaacctccgcctcccaggttcaagtgattctcccgcctcagcctcctaagtagctgggattacaggcgcccactaccatgcttggctaattttttgtattttttgtatagacagggtttcactatgttggccaggctggtctcgaatgcctgacctcgtgatccactggccttggcctctcaaagtgctgggattacaggtatgagccactattcctggctcacagaaaatcttagaagggagatatatgagaaaagagaagggatcattgtctcctattacacattggaagctataacattctctagcatttttataacataactgaaagcaaagcttagaagtcagtggtgggagatgagttcgctgctacagtgtaggtacttcagccatcacagatttggatgggacttgtctggttctctgagtgccagcttccttggtcaaggctccatgaatggtctcccaggactccacacatacagaagaggtcaaccactgcagagggaagaccaggctttattccaaggtttatgagttgttgcaggcctcaagatgcttggagactaggaagggaagtggacatctgtgtcaatgccagaatgctagccagaccatgataaataccataagagggcactaggaaaatacaagcattcacagaaaggagtgtgcagagccatggtggagggaaatccaccacagagcagggagaggggcttcagctgtcactcagagttaaacctggaaaaatcagatgtctacgaagactgaactttatttagcgatgggagcagcaatagttggagaggaggaaaaaccattgcaggaaaaaggaacagctacaatcaaacacatcaagacggaatgtatgggacaagtgcagaggcccatttagctaagaagaatagtgaacgaataagaacagctaaacatttaaagagcagtgattctttttgcaagtaatttacatgtagcatcttatttggtctgctataaagtaggtgctatcagtataaggcaagaactatcactatagccactttacaaataggacctcggacttaccacctttctatgagaggaggtcctgtgagtgtatgatgaacacttaagtcaactggctaatctgcctagacagtaacagagcagatgcagcctgctcccaggtcccctttgttattatgacttccttttaagtacaatatgggagataaggttgtgaaggggagttgtggccagaagtcaagagtcctggaacattatcctaagataggatcgagaagcatagaaagccttgaaaatgttcaacaggagttagatatgatcagagctgagctttggaaagaccgaagctatccaggacattattttaaaaactgagttactagtttgcttgcttgcttaagcccccacttcaaggatgaagggaaaagtgctgatagttatttctgggtcagtgtcttctgagccagaatcctcaagtgcatttccccactccctctacactcattttagttgcctagaagagtcttacaaagttttctaattggctgaggatcctaaacccggaaacaataaatgaaagtctgagatttgggctcaatcaatgtcacaggaaagaaggcactggggcttatatttttacataaagatgctgcatttggggtagtcaaagctcacacattctgcagtcacccccattacaggaaatggtgggccttggatatggctgactgtaatattaactttatgaggaaacagactctgctctgaagacttatgacctgagggaaagatggacaaacagaagaccaaggcctcatggtgggctcctctgatagcctcctgtgctgctttcctcctcagaaatactgaggttggacgtgaggcactcttcagcaaaaggacatttctgcctttccagcactaaaatggccatgagtaaaattgatatgtcaccgtctcaccaaagtgaaaaactgaagcggactcctaaggccacgcatggagcaaaactgtttatgcaagaagcatttactgagcacctgctgtgtgctctgcttgattgacttggatgagaaccatgaacaatatgaacaagtgccctgccctcaagagtcttacattctagggcaggaggaaagacacctgtaacaatcaagagataataaaatgtctgtgaaagtaaaatcagatcaggtcataaagtaacagagcagtaggctactccacagagcttgccaaggaaggcctccctgaagaggtgatgtgtgagcagacactggagtgacgagaagaagccagcgtgcaaagggccaggcaagcacatctgatggagagagttcagcaagtataaaagcctcaaggcagggaatgtgtttcccatgttcaaggaaaataaggaacaggagcctggagcgtagacagggatggcatgtacaacagaaaatggaagtaaagggggccccactggccagatcatctagggccgtatttataaatttgggttttattgtaaatataagaagccccttgagggttataaacagtgatgcgactagtgatattaatagtattaaaataggactgtgcatgttgagtgcagaatgaatagcacagaagcaaatgtggagacagagagaacactcaattgggtactgcagaagtttaggtgaaaaagcctggtggttttgactaaaggtggcaatggggaggtagaggaatgagcagattcaagatacatttttggagacaaagacaacaagacttcctagttgactgaaagggaggtgggaatggagaaagagagagtgattaaagataattactaggtcttagtcttaagcttaaacaactgattggaaagtgtcatttgctgagtcagggaaaagtggggaggaaaaggagggtcgagaagaatccagaggtccaactgagttgccttatgtttgagatgcttactggtaaaaagacagatatgtgaattaggtagttggatacataagtcaggagtctaggacaggaaaggcacagtggctcattcctgtaagcccagcactttggaaggccaaggcaggaggtttgctcgaggccaggagttcaagaaaagcctgggcaatatagtgagaccctgtctctacaaaaaagatagaaaaaaaattagttgggtgcagtgacaggcatctgtagtcccagctatttgagagactgaggtaggaggataacttgagcccaggcatttgagattgcaataagctaggatggtgccactgcactccagcctgggcaacaaagcaagaccctgtctctaaaaaaatgaaaaagtaaaaaagaaaaaagaaaaagaaaagattctaggagacagttgagatcgctgagggttagagacataaatttgggaatcgtaaaaatttggatgcatttgaagccatagaaccagctgtgatcactcagggagagattaaacatagagaaacaaccagggcccaagagtaaacccagggagttcattcagcacctgtaggttcgtagaaggtgaacagtcagcaaggaccaagaaagtagaaggaaaaccaaaagggtacaagaacacagaagccaagaaaagaaagtgttgtttcaggaaggaggacatggtcaacaggatagagagagtgattaaagccaattactaggtgacatgttgcctaagataaaggcagttttgagctccttcaaaggtatctgtttcctttgttttgatattgtttccaaaaactacatatcaggtttgatacgataccagaatgcagttaaaatgtaatcagtttatttactcaagatgtgtgggattatagaaacattttatcaattaccatttccatttataacttgtgcatcagttatagatcctattgtaagattgatatgcagccaaactgtgctatatactttcagtgttcactgtgtaagatactaaagggcttattacactgtagcccagcctaaagacacatgctaattatcttccatcatggtgcctgcactggctgtacttctactgaattgtaagctctatcatggtgggcacgtgcctgatatgttcaatcaaacaatagtttaatgtttagtatgtttgtttgtttgttttgagacagagtctcactctgtggcccagattggagtgcagtggcacaatatcgactacctacaacctccacctcccgggttcaagcaattctcctgcttcagccttccaagtaactgggattacaggcatgcaccaccatgcccagctaatttttttgtgcattttaaatagagacggggtttcaccatgttggccaggctggtctcgaactcctgacctcaagtgatccttccgcctcggcccccaaagtgctgggattccaggtgtgagccaccaggcagattttttaaactttggctgataaagtgatttaatcattaatcagtcagtgttaagagattagccctcccattggacatgctgaaaacaggcagctggcgactaagtgaagtctcacaggcagaacatctccactaaatcacagtctagctccaaggaccccttgttattcataatatttactgcatatttagtccccacaagctcatgattaattactgcacagattcggatggacaacatgtgacctacagtttccctctgcacagtaattgtagagggaaatgtaataatacccagtcagtctaaaaagcctattagtccaattctccacaaaattccatgaaaatataacatcacagcctgttgacttccaagaaatagtttaccaagagttgccataaacattagtacattttagttttagtgatagggtacttggcaaatatacataaaatcatacacacatgaggcactttgataggcactgaaaaataaaagacatacttcctgatcttaaagagtcctaaaatctagttgggtagatgcttttcataacatgaaaagctaactaatagttagacattgaaatgagaaaaacgaaatgttatgaggttctatagaattgacagctattgatgtgggccaggtatgagatggatatgaatcttcagtggaatctctgataaacacagaaagtgggccgggcgcggtggctcacacctgtcatcccagcactttgggaagccgaggcaggcggatcacgaggtcagatcgagaccatcatggttaacacagtgaaaccctgtctctctctactaaaaatacaaaaaattagccgggcctggtggcgggtgcctgtagtctcagctactcgggaggctgaggcaggagaatggcgtgaacccgggaggcggagattgcagtgagctgagatggcgccactgcactccagcctgggcaacagagcgagactccatctcaaaaaaaaccaaaaaaacaaaacaacaacaacaacaaaaaacacagaaagtgaaggataaacagagtaacataaagtatgtgtgtgttttgttcttcctcaaaataaaaaattatcagtcctagactattttatgtgagaaacccaccttgacacctgtttctcattgtatggcaactacaaagaagtataatgctgaacagtgcatctctagagaacagcttccatgtgggacagtgtttccaaacagagaatacattttctatccctgtaattactcttctattataataagatgtcctttgacacacagaatggcgttgtagaggagcactagatcaagagtcaaagggtttcagaactcctgactctgctgtgaatttgatgtgtgtccttgccatggataggacagcagcgcacgggagtcaagagctctccagacatacctgtcattcactatttgtgtgattgtaggcaaggcatttcagctttctcagactttatttcatcatctataaattgggaagaacagtgtctccggaaactccaatgcatgttagtaagtgaaggaagccaatccaaaaaggctacctactgtatgattccaactacataacattctggataaaggcaaaaatatggagacaataaaatgattagtggttgtcaggggttagaggagagggatggatgaatcggcagagcacagaggatttttaaggcaatgaaactacctcgtatgattctataacggtggacacacgtcagtgtaaatttgcccaaactatagaatgtacaacaccaagagggaaccctaatgtaaaccatggaccttgggtgataatgatgcctctatgtaggttcattaattgaaaaaagtgtacctctctggtggagtatgttgctaatgggggagattatgtacatatacggatacggggtataggagaagtctttatagcttctcctgaattttatcgtgatcttaaaattgctctaaaaaataaaatacatttaaaacaatcataaaagaacagtacttcggccatagagtagtaataattaaatgcgataaatatgtaaaggacagcacagagcttcctaaatagtcaatgttcaataaatgccagctattactctgatcctgtttcttagcatacagcagatcaaaagctgctgactggaattaaaggtcagagctgctagaagttatactgatggtggccagatgttacaggaggatacagaagaatgctaggaaggaagcatcagaactcaggaaacatttcttccaaggctatacagggagggagcaaataatggtctctttgttttttgttttagacactgggtctggctctgtcactggggctggagtgcagtggcatgattatgactcactgcaacctccacctcctgggctctaacaatcctcccacctcagcctcccaagtagctgggactacaggtgcaaaccactatgctgagctaatttttaaaatttttctgtagagacagggtcttgctttgttgcccaggctagtctcaaattcctggcatcaaacaatcctcctgccccccaaagtgctggaattacagatgtgagccattcctggcctgctctctatcttaacagatcaggaagcatcagtaccgtgcagagtcacaacctatagcattgtgatgtaagaaaagcaggaacatttgcctaagaagggctgggttggaattcttgctctctgttggtcccgtgctaattctgggtccttgactaagtccattcacgtccctgaactggatccctgccatcaccatgcgcaataggcacagctcagctactgtccgctctacctcagcagacaggactaggacctttctggcccagcccatcttgttgtaaataacaaagcatgccccataggactccaaagaataaaaaatcatactccatttgtcacagctgtgataatcactcacttttgctctaaaaatggagacagtatgcacctcaccaggcaactgagagaattgaatgaagtcatggcttacaaagcatttgggacacacaacccccagctccgtcaatgttagtgtggctatgaatgttttctaaatgataattcacacgctcaggtgccagcatagagctatacttgctactattctgacctgggtattgtgcctccgttttgaaaattgagtattcatcccgttcctgagccttagtttttccaggtcttatgaactggcttcttcctaacccggcatctcacgctttttttttttttttttttgagacagagtctcgctctgtcaccaggctggagtgcagtgatgtgatctcggctcagtgcaacctccgccttgcgggttccagtgattctcctgcctcagcctcccgagtagctgggattacaggcacatgctaccataccgggttaatttttcggtttttgtttgtttgtttgtttgtttgttttagtagagacagggtttcaccatgttggccaggctggtctcaaactcctgacctcaggtgatccacccgcctcagcctcccaaacgtttttctttttttttttttcttaaagaaagaatggaaaaatgcatacataccgtgctctggtccacatttatttgctttcattttggtaatcctctgggtcctgctgtgtgcttgctagtcccttatccagagcctgaagcccagactcagaacacagtctgctggctgggttcttctcctcattagagatcgcccaaataccactctcattgcttggacatacaagtagaccatgtcccacctctcaatccttgaacttcgttcatgtggtaagataccctattacactatttcttctgaaaatttccattactaattgtttccccgcataaatgattgcagtatgatttggttgcgtgcctatctatggcactcaattcccactatcagcacctgcaaaaggctcagctcagtcaccacgtgctccatctgaataggcaggactagaacctttctggcctggcccatactattgcaaataactaaacaggccctgtagatacccaaagtacaataaatcatgctctgtctcgcagctgacatttcccctggaattcaacagtctagatatatcaagtagatgggtgggtcaggtctacaagaagtctatctacatacacatggtattgaaaagtctcctgtgcggaaaagtcactctcagagaaaaaggagtcaaactgggtcaagtacaaaacttatactatagagaagagacatgcttctatgagttcaaatctgttttccagtctaggcctcccacatattcccacctgaattctagtaagagagtaagagaaagaggctctatgtagtaaaacagtggaatgcactgtagggccacatgggaaacatttggaaaagtaaacagtaaggagagaggggtattccctctacttctgtaccgccttggcacacgaaggacatcagagaacctggcatctcttaggcattcaaagcacattggtggcattatcgtcaggaaagagacagcagcagctaaaggaagtgacagcaacaccctgttgggcagatggacagaacaggagtcgatgggagtcagaactaccctctgagagtagctcacctgtggatcctggaagcaaaggcgaggcattttcatgcaactttgcacccatcaacaacagagaaaggaagcttataccaggaaaagtagagaaataatgaatgtcatttattcagtgactggattattattgcactcagtgataataaacatcctgcctaattgatcagcagaaaaaaaaatgtattgagtgaagtagtctagggatcatgactccacaattattcattgagctcaagagccaataaaaacatgattacctagccactctgttgacgacagcagaaaaattatattcatgtattcatctattcatcatttaaaaataacctgtaagtacctaaccacacatcaggttggtatgacaaacaatgtggaaacagatgattaagttattctccaaaggcatctcataggtaatgatatgcaggttgagcatccctaatttgaaattcccaaatcggaaatgctccaaaatccaaaactttttgagtgctgacatgaggacacaagtagaaggttccactttatttcctgtttcacacataagtacttaacacaaactttgtttcataaggatgtaacacaaacttcatttccatttatttaaaatattgtataaaattattttctggctatgtgggtaaggtgtatacaaaacatcaacaaattttgtgtttggatttaggccccatcccccaagaaatctcattatgaacgtgcaaacattccaaaatccaaaaaaaaaccccgaattcaaaacacttttggtctgaagcattttggataacagataggcaacctgtacaatagaatttcaggttccatgacagaaatatatttgaagagctataaaagcttgaattaatctactgaggaaaacagcagttcatagaagtttgactgaggaagtaacctttgaattggacattcttaagcagaatgaaggcaaaagaaaatattatggaagtggacttttgcaggaggtaatattctaaagtatgtccacaacagaaaaatcaggtaaagtttattcttgtacattccttaaatcatccatgaaatatacatgaatttgtgtgtataaccttatagcatttttaacattaaactttgagaaccactagtcaggtctaaggacatcacaagaaactgtccacatggtctacgtataaagatcattctgcttttaagataacttcttaacaagaaataaacagaaatttctattgtttctatttgtctgaagggtttactctattttattttaatatgaaatctctatgaccacctaacaacagaggttcaaaattcatgaagcaaaaactgatagaactgaaaagagaaatagaaaaatccaaagtgatgactggagatttcaatttcaaccacaatttctctgcagttaatagaacaaataaaaaataggtaaggatatagaagacatgaacaacagtaccaatcaagtggatctaatgtctatagaatattctactcaacaagaacagaatatacatttttttcaagtgcttttagaactttcaccaaattagaccgtattctgagctataaaacaaactttaacaaatcatgaaaactaaaaatcatactaattatgtttcctgcctgaaagatcaaaatagagctcaattacagaacaatagctggaaggtcctcaaatgttgtgaaatttaaaaacatgtttctaaataaccataagccaaagaagaagtaatgaaaaaattagaaaatattttgaattaaataaacacaaaaccacaacatattaagtattgtggtatgcattcaagacacagcttaaatgaaaattaataccaccaaatgcctaaatttttaaaagagcatctaagtttccatcttaataaactagagaaagaaaaacaaattaaacccaaaacaaacagaaggaaagaaataacgaagttaactgaagatatcagtaaaattgaaagcaagaaaacaaacaaaaccaacgggaaaatcaaaatctggttctgagaaacaaatgaataaaactgacaaatttctagccagattgaccaagataaacagagagaagttacaaattatcaatatcagggaaaaaatgggaaacatcacaaagacagcatcaatatttaaggaataataaaggaatgtcacaaactagatacttaaccacactctgactcactcaaaaacattttatgctcactcaaaaacctgcttatgaaagtttatagaggatttattcataatttcccaaatctgaaaacaatccaaatatccttcacctggcaaacagataaacaaatactggtacattcataaagtaacatagtttcacattttgattaagtccaatttatcaactgatgcaaaagaccacaagaaacaacatctaagattgttttttttctagcatttttacctgattgctatggctcttcttcaaacttcttttccctcaaattacatttcctaaccatatatatatatattttttttttttttttttgagacggagttttgctcttgttgccaggctggactgcaatggtgtgatctcggctcaccacaacctccgcctcccaggttcaaacaattctcctgcctcagcctcccaagtagctgggattacaggcatgcaccactacacccggctaattttttttttatttttagtagagacggggtttctccatgttggtcaggctggtctcgaactcccaaactcaggtgatccacctacctcggcctcccaaagtgctgagattacaggcgtgagccaccgcgcccggccatctaacataattcttatccagtactagcatatggctatgacaatggattcaatgttggataagacagaaatgtaagcagatgatgggtcttgaggtcttttgcgtcaactgttcatttgccaagtaacatgattcactcatattattctcatagaaacttaagctcccttaataacaaatcctacatacttctccagaatgccaaacgagaatagattttctagtttagaaatgagaaaattgtgacaatttttgaagtactgaaaaggttataatcagaggaaaggacccagtataaacctctgtgatttttttttaaagaaggcaaaaaaggaaaggcagatgttgtgaaggagtgaaaagagaaaaagggagagtgtagtgttacataaaatctcaatttaggctgaacatccaccaagattctactggaaatcaagcattttactctcatttcatttccctaggaatcctgtgaagtaggtaatagctctccatttatagatgaggaaaattcagtttagagtgataaatgacttattcaatgctacattgctagttaagtgaaggaggtaagatttacactaagaattagagattatacactttttttcaagtgccacttttgggagaaaaaatgattaaatatcagtataaaagtattattttgaggaaagaaggctccttaaaaaggtactccagttgtttggaataattgcagtctcgtttcagtctcagctctatatgcagtacagctcaataaagctctaatatgcagtacagctcaataaaggtggaatgccaaagttctcatcttttagcctcatggctgttgtcccacttaagggacacagaatggctttataaagaaattaacattaaccaagtatatactgccacttatctctcttgcctcatttctcaataaagaaacctgaaagttactttctatggctagcttcaccttgaagcatgtttgttttatctaataaaggaactgtttagcttaattccattactgattttggtgtcagatcacacgatataagctaacaaagatctacttcactgattgcattgcaacattatctgaaaataaaagtggggtaggaagggaaggagaagggagagatgaagagaggatggtaaatgggtacaaacataaaactaaatagaaggaataagttgtagtgtcagcagagtagggtaatgatagttaaaaataatttactgtatatttcaaaatatctagaagatatttaatgttcccaacacaaagaaatgataaatgttttgggagatggatatccaaattaccataacttgatcattacacattgtatgcatgccatcaaaataccacaggtaccccataaatatatacaattattatgtgtcaataatgaaaaaaagttagagttttatataacttctattatagtccttttcttttatcctcacacacacacacacacacacacacacaaaaagagacagaccttaaacaattatacagaaagttgtctacaaggatgttaagagtaataaccaatctactttttaaatagttgagtgggttttcagaaaaaaaagtattcaataaacaggaaatatgtgcaagaataaaaagagaaccttaattataattatgtatttcttttcagcagagtgttaaactctggtaatagaaaaaatatatttttttcttttaatccatggacattttatttacaaaatcttatgatcataggtttattaatgatcctcagacgttttactacaaaaaatgcttgagattataaaccacgacagaaacaaataaaaccacctcatgatagtcttggaacactaagaaaaagtcctaagactaatattaattgacttctatggtcaatggttctctgacattattgtgtgaccttaggtagtaaattagccactccacaaatttgtttacttatttaggaagagaagtagtaagaattcctttcctattaccacctcaaataattattgccaaattatatgaggaaatacacaccaaaatactttgaaggcttcgaaattcagcagaacttcaaactatcaaccaaacaatatacgagtgctccagttcctctacattctcaccaacatttggtgttgtcacttttgaatttttttttgagacagggtctcactctgttgctcaggctggtgttcagtggtgcagtcatagctcactgtggtctcaaattcctgggctcaagcgatcctcccacctcagcctcccaagtaactgggactccagacacatgccaccacacctagctaattttatttatttgtttatttttttgtacagacaagagtctcgctacattgcccaggctgaactatttttattttactgttctgataggtaggtatgtagtgatatatcattgtgattttaattgttatttccctaggtgttggacatctttttatgtgcttatttgctatctgtataactttggtaaaatgtttatttatatctttgcccttggtctaattgtttgcattcttactgttgtgttagaagttctatagtctatattctagatactagtcctttgttagatatggggtttaccattattttcttccggtctctagcttggcttttcatccttacttaacaaagtctttcacagggcaaaaggttttaattttgataaagtccaatttattcactttttcttttataaatcatgctttcggtatcaagtcttagagctatttgcctaggactagattctgaatattttttgctttttctttacactttttataaagttttacattttacatttaagtccatgctccattttgagttaatatatttaaagtttgtacaaggtgtgagacttgaggttcatttattttagtctatggacatttaatcgctctagtatcatttgttgaaaggtgatgtttccttcattgaattgcttttgaatctttgtccaaaaaatcaattggtcaggctgggcgcggtggctcacgtctgtaatcccagcactttgggaggccaaggcgggcggatcacaaggtcaggagatcgagcccacggtgaaaccccgtctctactaaaaatacaaaaatttagccgggcgcggtggtgggcacctgtagtcccagctactcgggaggctgaggcaggagaatggcgtgaacctgggaggcggagcttgcagtgagccgagatggcgccactgcactccagcctgggcgacagagcagactccgtctcaaaaaaaaaaatcaactggtcctatctgtatgggtatacttccacaccatctattgtgttccaaactatctattctgattgctagtggatttatgtgtctgttccactgataatcttgatactatagtgacatagtaagtcttgaaatgaggcagatttatttttatcacattatttttcttttcaaaattgttttagctattttagttcctttgaattttcatatgaattttaaaataatctcaatatttataaaaattttgctcatattttgataagaattatgttaaatctgtatgtcagtttgtgaagaactgagactttactatgtcgagttttccaatcagtaaaaattgcatttatgtccattaatttacattttgtgtgcttcctttgattagtactgtagttttcagcacacaagctctgtacattttgtaagatttacacctaaatatttactttaaaatgtttctgattattgtaaatggtgttataatttaaattttgattttcatgtgttcattgctatgataaatacaacagatttttgtatgtttatcttctatcttatgaatttgctgaacttatttatcagttctgtggatgtttttgtagatttttttcattttctatatagacaattattccatctgaaaatggtgactgttttttttccttcctggtttgtatgccttcccccagccccatcttattgcattagcaataccttccagcactatgttgaataaaagtggtggaacctgtttctaattgaagggaaaaagctttcaggttctagccattaagtgtaatgttagctgtagttttcttgcagaggggatagatgttctttatcacgttgtgaaaattctccgctattgccattttttttttttgcgacggagtcttgctctgtcgccaggctggagtgcagtggtgcgatcttggctcactgcaacctccgcctcctgggtttatgccattctcctgcctcagcctcccaagtagctgggactacaggtgcacgccaccacattcagctaatttttgtatttttggtagagatgggatttcaccatgttggccaggatggtctcgatctcttgaccttgtgatccaccctccttagcctcccaaagggagggattacaggagtgagccaccgtgcccggcctccactattgttatttttatgagaatttttttatcataaatgagtatttaatttttttaaatgctttttctgaattagttgatatgatcatgtgagcctttttttctttagcctgttaatacaattaaacacattgactgattttcaaacaatgaatcatccttgcatttctagaagaaatcccactttgattatgatgtataactctttatatgttgctgaattctatgtgctaatattttgttaaagacatttttatttatatttaggagatacatcgctctttagtttccttttttgaactgcctttggttttggttcaaggtaatactacttcataaaatgatttgagaggtatcttctactcttttgtctggaagagattgtgaattggtgttaatttttctttaagcttttggttgaattctctggtgaaatcatctggacctagatatttctttttggggagttttagattataaatttaagttccttaatagtcatagggccattcaaattctcgatttcatgttggtttacttgtaatttgtttggaattggcctgcttcatctaagttgtcaaattcatgtgtatagagttgttcatatgcgggcaggggtgcctcactaccatctaacagagatgtaaattcaggctccttcctgggctgcctctgttatcacccaggtgagggtgtttggtctcaacagagcctcacaaaggtcaaagtctacgttttctactcaggctttgctaacatgagcagaggcggggccaaacttctttctgtggtgtttggctggaatagaaaggttattatctaaaagctccatatcttgccagcctggccctttcctgatcatttggctagagaaaacaggtgtgtgtgtgtgtgtgtgtgtgtgtgtgtgtgtgtgtgtgtgtgtgttttgctttgattttgatttggcttggttttattttctgtctgcacgtgtgtgtgtgtgtgtgtgtgtgtgtgtgtgtgtttggtttgctttgattttgatttggcttggttttattttctgtctgcacctgtccgcatttccaggattctagttctttagcattaagaactcactgccatgtggtttttcaggtcccaaaggccccagctcaaatgtttcttttctccacttttcagagtcctttatgtatattttatgtataatgttcagaatttttacttagtgggatgaaaaggcaaagaatgcctacttcagcttctagaaacagaagtcatccaggatttagttttaaatgaattggtcaagatgaatttctggtacataaaataggcctagtcaaaacatgaataatttatccatgaaacaaattccttttcgtgacatttttccttggtgggccaatctgctattccccatcagaaaagagcccaggtgagagaagaagaaaatagaagaaaacagaaaatcaggaggactttctctttctcactcctcacttcattcctgcctcactcccaaggcaagttcagagccccacagtaccaagagttcaggaaaatccaagggctgaattcaacatccatctagccagtagagatattttaaaaatcacacatattatactgacttgaaaaaatattttcagcacctactttttaagtactcttatgctaaacacaatggagaaaattaaggtacaaaggcatagcctctttcagaaaatccataaaacctgtatccaaagaactataataatgggcaggttctgaagaatgacatagaatgggccacacatctctaggataggatttaaaatgtcatttaaatataacacaaatgtttgtattgggaactctaaattgtccttgtctacagccttcttccttccctttcttacaacctataagatcagacttaagtaaactcctaagctaattttgaatcatttgtcctccctaagcccataatcacatggctaagccaagaattattcaaacctaattctcccgcaagacctcatccattgctcactgctcctgaagatggtcttgagtatccccctggatctgggcctcagactgtctttgccactctcctgtgttaccacatggagttggtccccgccatgtttggtcaggtctcttagaatgataacttctaacatcatggatcctgaaaattagctaatgtgatttccaactactgtgtctcatctagctgatattatcaatcaattcatcctgcctgaatttataacaccacatttggatatagtgtttagttgcttaacatatgttcaataagcataaattaaatacatatagacaaatggtctagagcagtcttcatcatgcttctccggaaggatctagagtacttatacaatttgagaagattgagtttcataccaagtagggacagggtctggaaacaggcagtacacaaacacttgaatgtatgttaagactgagacttctgctacagaaagtcagaggaaagaatgtgactttcaggtgagatcagcaaagaaggattccctctgccacaaaataacaccttctttcccagaaactcagatttcctttgatataattcactattaattttcactctaggagatgaagcatctgaatgaatgttcctggaatatgcttggaacatgggaataaatcatgctagttgatatggaagacaaacacaacactccagcaatactctcttaggaattccctcatcaccatttaaattgttgattttctgctcttctgtagaaatctctagttctggatgaacataagcactgtctatattcgttagacagcacaatacatattagtctttaatttatttcacctacaccaaacctaaattttttcttcttctaactttatgtcctaattttctttacttaattttgtctacatttttgtcatcattttctcttagatttttgttcagctttccttgaaacccaataaaagcaaaaattatattgagaaaagacaaaatttcacatcccatattctacagcttgctacctctgggcaccaatggacattcaactgaaatataattttttaaagaattttatcagtataatagactcttggacttgaattatgaagcctaacaactggtgctaaatcagatgaaattgtgaagaaatgtctgcagtgtagctctaactaaaagctatattctaacaagtcggcgatggagcctccaactttctcatgcctctggatggaatttattccctaaactcagtaaagccactgactttcagaaaatgaataatctaaaaaaactgcaaaggcaaggcttttgttctttaaaaaaagaaatgaagctaacttctgcttatggcaatggagatcagtttattttgcaccaatttcctactgaaaataactataaaggctgaacaaaatgtccaaaacccatctgtttgaagtcatcagagagccatcaaggtaaagaggggcttcagggcaaataatctgacagaggcaagccaagagatgttcaccccccaaagcagttactaaaggcttggaggttgacaggagtatttaaaagtcgcactgagaaggacaacacaaatttgagtttagtgccttccaggaatgaaaaatccttggataaagacttaggatatcactctgcaatctacagggcttcaccctgcaagtgagtgtaaacagaaaatagaacaagccttataaaggtttaagaaaagttttaggtcagctcaagtcctaaaggattaaggtgattggcatctcacttagctgcctggtagaagcaagttgaagtcccacctggagaaaaacattcactgaagcctcaaaatgccttgcaagttttcatctaaaatgtatgacactcaatgaaaaattaatagcatattaaatagatttgaccagcggggcgtggtagctcacgcctgtaatgccagcactttggaaagctcaggtgggcggatcacctgaggtcaggagttcgagaccagcctggccaatgtggtgaaaccccgtctctactaaaaatacaaaaattagctgggcatggtggcgggcacctgtaatcccagctactcaggaagctgaggcagaagaatcactcgaacccgggaggcagagggtgcagtgagccgagatcgcgccattgcactccagcctgggtgaaaagagcaagactccatctaaaataaataaataaataaataaataaagatttgaccagctaacaagagggaaagaaaaccagacagtgcaaaattatccatgagaaatgcagttgttgtatttatctgataggacttaagataacagtgattaaaatgtttaaaagattaaataaggcaatacaattcagtgaagaacaaaaaattataaaaacaaagaaaatataaattctagaactgaaattaagaactttacagatagatgtaacaataagacatacaggactattgaaaaaatagtgaattggaagataggtcagaaataaatattgagaacaaaagagggagaaaaaattacagaaaataaagaaaagagcatgcaaaatttatgggacaggtacaatgaaaagatctaatacacatgtaactgaaatttcagtaagacaatgaaaagaaaaatggggcacaagcaatatttgaaaagatagttgctgaggatttttccaaactgatcaaatactttattcaagaaatgctatgagccttaagaagaaagaatacaaagaaaaccacatagctagatgcatcatagttaaatttctgaaaaccaaagtcaaagagaaatcttaaaaaaagaaagagatagagaaaaaagtgtattaacttcaaaggggggacaataagaatgacagctaatagctgacttcttaattgaaacaatggaagccagaagacagtagaaagatatctttagaaaggggtgggggcagaggtcaacctgtaattatgtatcagtattaagtgcaatacaaaaattcacaaaataaaagcattttcacacaaataagaactgaatgcaccagcagcagatgaacagagaaaatactaaaggatattcaagaagaagtaaatttgtactaaaaaatgtgtaaaaaaaaaccccatctgtttgaagtcatcagagagcatggagaaaaacattcatttaagcctcaaaatagcatattaaaaatatttgaccagctaacaagagggaaagaaaaaccagacagtgcacacaaatatccatgagaaatgcagttattgtatttatctgataggaactttaagataacagtgattaaaatatttaaaagattaaataaggtgatacaatttattgaagaacaaaaatttggcgatgcagaaaggaatgaagagtaactaaaaggagtaaatatgtggataaacacaagtgaatattgactataaaacaataatactaaagtcttatggattcttaagtatttagaaaattgtaacacatgagaacataaattagagtatgggtaaatgaggctaaagtgtattctaacttttgcattgagttggtgttggtaaaaatagtaatttatgttagacttgaatttcagggatgtattatatttcataagctagggtaagcactaatacaatggtaaaagaatgtgtatctgaccagctagtactggggagaaagggaaaaataaataatactgaatccatccaaaagaatgtaaaaaaaaaaaaaaaagaacaaataaggaatatgctgggttaattagaaaataaatgtaaagttctagattttaaacttaatatatcaataacattaaatgtaaatggactaaacactccaattaaataacaaacattttcaggctggatttaaaaaataattatatgacacaagagactcaccttaaatataagaatataaaaaagttgaaactaaaaatagaaaatatatataccataaaaatactaatcaaagtatctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatcaaagtatcttaatctcaaagtagatggtatagcaagaagcaccactagagataaagatcactttccataatgatagaacagtcaatccatgaggaagacacattttaaaacttgtgcacagttaataaatagtgtcagaatatacaaaggtaaattattagaagtaaaaggagatatataaaaattcaaaattgtagtgagagatttccatacatatacttattaactgatggaccaggcagaaaaaaacaatcagtaaagagataaaagaccaaaaaaaaaaaaaaagattgcaaacttgatctagttgaaatattcaaaacattactactgtataataatattcttcccaaatgcataatttaccaaaattaaacattatctatctatctatctatctatctgtctacctacctacctacctacctagtttcaaaggtttggaaatgtgaagtatattttccaacctaaatggagttaacctagaaatgggtaagaaaaataagtagaaaatatcatggacttggaacatagactatttttcaataattcatgagcaagagaagaaattacaagagaaatttaaaaatagtttgaaataataatgataatgtaacatctcaatacttgtaaggttcaggtaaagtcatgcttagaaagaaatttatatttaatatatacatgagacaaaggctgaaaaatcaacgattaagcactaaactcaaaaaatcaacaaagagcaaattaaatgcaaataaagtgaaaactagaaaacaataaaaaataagagtggaaatcaatataactgaagcaaacacataatagaagaataactaagaaaaaaggtggttctttgaaaaggctaatatagttgatgataacttgtcaataccctgatcataaaaaaggcagaaaaaaatccataatgaacaatgagattattacagctcacataggcattaaaaaggtaatagaatattttgaatagctgtatgccaatgcatttgaaaattgacataaaatgaacaaatttctgaaaaaacacaagctaactaaactgacacaagaaaacgtatcatttctaaaaatatgaatatttctatatttgtgaaagaaaatacatttataattttaaaacttttcataggaaaatctataacctcagtgttgttactggtaaattttaccaaacacatttggaaaaacaaaataccaatcttacgttaagttctttcaggaaacagaaaaaacgtggaacattttccagctgtttttttgaggttaccataatcttcatatcaaacctgacaaggactttacaagaaaaatcaaacaccaatcattgtcataaacccgtatgcaaaaatattacaaatttgtgctaaccaaatccattaatatagaaaaaagataatatacaaccaaacagcctagttcggtttattccaagaatggaaaattggcataacatgtaaaatcagttaatgtaattcaccatatgaagagaataaaaggaaacaatcatctcaagaaatgtaaaaaaaagaagtcatctgattatttatctgatttatttataataaaagcccttagcaaacaaagaataaaaaaaaaagactttattggccggtctcacgcctgtaatcccagcacttcgggaggccgaggcgggcggatcatgaagtcaagagatcaagaccatcccagccaacatggtgaaacctcatctgtactaaaaaaaatacaaaaattagctgggtgtggtggcatgcctatagtctcagctgcttgggaggctgaggttgcactgagctgagattgcgccactgcactccagcctggtgacagagtgagactgtctcaaaaaaaaaaggactttatttatttagtaaacagtatctagaaataacttccagcaaacattatacagaatggtaaaatattaaaaatttttcctctaaaatcaagaacaaagtaaaaaatgccagtgttacttacatttgacatgtacaagaggtcctagtcaatgcaataaggcaagaaaaagccaaaacatgtgaggattttaatggaatgaatgacagaagtctagtcctcttccctttcaaaataagctgtggcttccagaaaaaaaaaaaaaagagaaaggatgatgggaatgaaaacaacagcagatatctactatgtttctctagatgaaaataaatatagttactctgtttttagctgacaactagtcagtgtcaggatattgatgaacctcagtccgtcaatcagaaaaactactgctatcatcacacagaaggggttagaattcaagctgtactgcctgctagctgtaggacctttgacaggtcatatagcatgtctagcatttagatccttcatctgcaaaatgtgggtggcagaagtacttgcttcctctgcctgtatgaagattaaataaaattatacaatgtaataaccctaacatataaatacaaaataaacgttagatgaattttactgaaattattagtaacaactccaaagccttggttccttcagttaaggcgaccactgaagttaatctcatgtgaaaataaattataccccaaatttaacacaaacaactataacaggtgatctggaactgaaaataataacaaaaaattaatgaagcttacattaatgagatatttaaatattaccttacttttttcaaaaagtgttccttttctctctctttcccatgatttttttaaaaaaagcttttaattgctgcaaaccggcagaaaaatacttatttatatcttaaaggtactgctcaatgaattttcacaaactaaacacgtccatgtaaccaacacccagatcaaattcttcccatgatttgatcattcagaaaatctttgacaaagaggttgacaaactcaagctggagtcagacaacccagatgctaattctggctctaatagggatgcactggttgacttaaattagctccttccctacatcctttgcatcctaatttttctcatgtggaaactaagagcaacacattcccctgcccctccaacctcttgtttcacagtggagttccaggaccataactgcaggcaaccaaaaccgtcttcctaaagctccctctcctttagcttccatgagtctagaccttcctgaatttcatccactgcccccggattattgcttagtttagtttctgttcatctttgaatgaagacatttcccaagattctgttctgcccccaactctcctcagtttctcattaaatttctcactgcactttctcattcaattcctggttagtttcatctgatcacctccatgtccagacttccaagtgcaaaatccaaccctaatttttctccccaactccagtccaagattttcaactacctgctgatatcttcaagtcctgttgatacatcagtcccaatctatcaaaagagaaatcatctttcctccccataccttctccctatgttatattctttactttgattaccacttctggtcacctctgtaagacacctgggaatcatcagctttctctggttcacttgccaaatcttgttaattctaccaccccaatatcctttgaaatgtccctttgtcactatgcctaccccacttctctaattcagttcatctgcctgagggatttcaagagtttcctgactgatctgctactcatggatctaatttctgcaatgcatctttcattctctaatggacttcttttcctaaaggtgtgtcagatcatgaaaatttcctgcctttagtcatcctacataaaagcagaataaagaacaaactccttggcctgtcaacctaaaaggacggttcctttccagaaccatccaccatgaaatagcatcatacaaattacactggagcctcaccagagtgtgcactgttcctgcatttccataaacccatgattttctaactttttgcctcttctgtactcaccaaagtgatatgtatccttaaatttcttccctggccttcacaatcagaataaattagcccttcatttcagaaccaacaccacttttttttaatacatatataagaacttaaaaataaaactacttttgtctactttgtgtcaagcatttgaataggtactttatatgctataattcatttaatcctcattagttgaatcttcacagcaactttacattttagagatgagaaacttggtctaattaaggctgaatggttcacccgaggtcttactaaagtgaagtaaacgtaggagccaggatcagaatccaagactttgggattccaaagtcaattttctttatacttcgcaaaataatttctacagctaattgtttatatgtgtctccctaaaagactgcaagctctcagctgagaatgtgaataatctatttcagcccactacctcaaccctgcaaacacacagacacacacagacacacacacacacacacacacacacacacacacacagagacaccctaattgggttacttccacaacagtttgactctgtaactgttgaggaggtgaatgaataaattatcaaggttcttacattaatacctactcagatcttatgatagatattaatgacaaaagaggtatttctgtacctgtctctgtggaacttgcaaacacagaaaagaacaataacaaaataacatcagttgtagcatttactagtccagaaatagctcacctatgaaacaaacacaattttaattcattttccccatcccctaataggaaaatagttctttctgtgggggccaagggaaaacttccctgtcacactctgaaggttcactgaaaatcactgacaaaaggcagattaacaagagaaaaggcatacaaattcatttggtcatagttttgcatgacacgggagccttcagaatgaagagccaaagagacaggagaaattgtccatttttatgcttagattcaacaaaggatgaacagctgtgttgaaacacgattgggcaaaaagggaatgatctaatggtaacagactgagtggggaagctcagcaacgcctgtctgtttagatttctgggcctctctgaagctttccttccttctgggtatgaggcaggcccctctctggaatgcaggtgttatgacctacagtcaaacaagtcagataagttctttacggctagtttttatacagaagtggggaggagtgtagggggcagttagagtagtatttttaggttttatggctggctttaggggaaaggggttctggcttctatgacccgccttcaggaaggggaattctagtttctatgcctaaccttgggggagagtaagaggccagagacaggagggaacgaggtcagagaaacatgcttctgagtccctcatattgggatatcattttctgagctttaacatttctgtaagaataatgacaactaatttgaggtgcagcactaaaaatagaaggaatctagcagctcttgaggggtccatcctgagttgctttgttctgatcacttagcatgtgatcttgctacctagaaaattattttacctgtggtttttctcattgaaacccaggccataaattccatcctgcactaccttccttccactcgatcacatttgcattttttggctgccacgagacttaccttgagttctgcttctttttttatttttatttttgagatggagtctcgctctgtcaccaggctggagtgcagcagcgtgatctcggctcactgcaacttccacctcccaggttcaagcgattctcctgtctcagcctcccaagtagctgggactacaggtgcccaccaccatgcctggctaatttttgtatttttagtagagacgggtttcactgtgttggtcaggatggtctcgatctcctgaccttgtgatctgcccacctcgggctcccaaagtgctgggattacaggtgtgagccaccgtgcccggcctgagttctgcttctttccaagatagatcctctggttttctgttgattctgtgagcaccaggtactccaaagaatatcatttcaacaaacagttttctgtttaaaccaatcaaagtaagatcctatggcttgaaattaagaatcttgcctgacataatccctgtctcttgataaacacaaacaggcaatcaccaaaccagtgccataactccacaactcaatttttaaaaattaaaatataataaatcccctctcttttcatttattcgttcgttcatggcaggtacatttctagataatgaagatacagttataaattttgatggattttacaattttcatatctttgttattggcaaccaaagggtataacatgcacagtccagacaaggaagttaatcagaaacagtaaaaacttatcttcccgaaatgataacctgaaggtcaaatacaacaggagctactcttgccctttcaaatggccaacaatctgaagatatcaactaaatgccaaatattaccaaaagtaaatactataggagttgcccagtttgttaggtgagagtttaaaggaaactttagaaagaatgagcctgaaatgatgggaggaacacaggtgtgtatagagaaggagggatggaaccatttatggtgaaattttctcagaaatggcacaaagaaaggagctcaagaatcacagtcaacacccaaggaggagggtaattcattggattgaaaggatcccagaggaataaaaagttgtagaagaaaagaccaaactattgcatttgctcaccaagttctagagaattattttatcctctaggtcacagagatgggctgcagggggtggatagataagatgtggtgtgcaagttcttaaaatatgtactgcatatcatacattttaggtgggtattggacaattttcttagtgaataaagaggaaattcatttagcaaaaatcaaaattaaggtaactctagcattctttttcctttctctctgaaaaggtaataattgtgatatctgccaatttataatagaaatgtttaaaaacaaaagaattaaacttagagagttctccttaaaagtcagacaaatttatcaacaaaagagaagaaaccattgtctcaagtgtctttttgttgtttctttattcttcttattttctgcaaaaaaaaaaaagaatgagcctatgaaaagcaatgttaatgatggcacactctggggttttcactaatgttttaaataggctttacatagagcagcaattatgtgagatgatatagttaaacagtatcgataataaaatattccatttgagcacctcaaaatactttggactaattcatattagaacatcttgctatcagaactgttgagtttaaaataatatacacatatgtatatgtatactcatatattatataaacacagttacacaaaagtaaatttatttattaatagattcatccctttttatctatggtcataaaattcaaggatcagtaatagaatccatagatcccctaaattcatttgtgatttttttttttttttttttgagatggagtctcactctgtcaacaggctagagtgcagtggcaccatcctggctcactgcaacctctgcctcctgggttcaagcgattctcctgcctcagcctccagagtagctggaattacaccactatgcacaccacgcccagctaattttttttttttttttcagtagagacggggtttcaccatgttggccaggatggtctcgatctcttgacctcatgatccacccgcctcggcctcccaaagtgctgggattacaggcatgagccactgtaaccgactgcatttgtcatcattttttaacatctttcttattcataaaccaattagctagtgggaaaaaattaattagcatttgtaggatatactttttttttttttgagacagagtcttgttctgttgtctaggctggagtgcactgacacgaccttggctcacttcagcctccaccccccaggttcaagtgattctcctacctcagcctcctgaactacaggcatgcaaccaccacacccagctaatttttgtatttttgtatttttagtagagacagagtttcaccatcttgcccagtccagtctcgaactctagacctcaggtgatccacccacctcagcctcccaaagtgttgggattacaggcgtgagccactgcacctggccaggatatactatcttgattttttcctaatcttaactttaaagatgctcctatgaataatactaataaggtcccaggtaatgagagagaacaaagggtaaagagtcttggtaattcccaggctagacaaatattaatagacctatggagaggtacaagacagctgacttgttagaactgtgcagtttgttactgaagccaaaaatttggcagtaatttctagacagtaatttcgtaagtgttttttttttttacatttatgcccccatgtttaacccactagcaaattcagttgactcagcccccaaaacacacctgagataatctatttctaggcatccccattataatcaccctggtcccatggaccattatttctggcctgaactaatgcaacagcttcttaattggttttgctgttgccattcttacccagttacgatccatttgccccatgacttaaagaatgaactttttttttttttttttgagacagagtttcgctctgtcaccaggctggggtgcagtggcgctcggctcactgcagcctccccttcctgggttcaagctattctcctccctccgtctcctgagtagctgggattacaggtgcccaccaccacacctggttaatttttgtatttttagtaaagatggggtttcaccatgttggccaggatggtatcaatctcttgacctcgtgatctgcccacctcagcctcccaaagaatgaacttttaaatacttaaccagatggcttcattcttcttttaaaagtttctcattgggttcacattgctatcagtaaattaggaacttcttactttggcatacaacgtgagaagatggaactgccatctatgtgcccaatcttattctttgtcacggtctttttcatgtaccatactcccagctgcccttcctcagttcctcaaacacaccaatcccatttcctccttacggcattgggactagctctcacatgatttgaaactctcttcctgctcacctctccatgttaaccctaacttaaatgtcacccccttaggccatgggaacacccaatttaacctaattcttcagccacattacatggctcacctttaattctctccatagcacttagtgctgtctcaatttaccttctttctttctccctccctccctctctctctccttttcttccttctttctctctctggttttttttttttttttttttttttttgagatggagtctcgctctgttgcccaggctggagtgcagtggtgcgatctgggctccctgcaagctccgcctcccgggttcacgccattctcctgcctcagcctcccgagtagctgggactacaggtgcccaccaccacgcccggctaatttttgtatttttagtagagacggggtttcaccgtgttagccaggttggtctcaatctcccgacctcgtgatctgcccgcctcggcctcccaaagtctctttgtttctttctttctctctctctctttctttcccctttcccttctaaagatcaagaattatgcatgctttgttcatcactgtgccaggtatggagtatgcactttaaaatgcatatatatatatgcgtaaatatacagctatgtacatatagtttacattttgatatcatgcagaccgatagctatgaaatctgattattcattcagtgaaggtttactaaacacctatatattccaggcactggaatatgagacagacaagactactgtcttcatgcagcccacatttagctcagggagacagagaactaacaaacaaatgaacaaacaaaagaaaatttcaggctgtaataactgctaggaataaaattaaaaaggtaatatcaaagaaagttataatggacttgttcaaaaagcttcattaaccaaacgcaccaaaagaatcaattgaaatgttcaagtagaagacattttgcaatttttaaatatcttattctccaaaatcttccacacgtttggaagcagttgtccataaactaccttcgaatgaaacatccactaaattactgccactagaaaaagaaaagactggctcaatgctcaagattaaaatgcaggctgacactttctgctttacttgttttggggttgtgtggagaaatgctgacatctttgccttttttctttgagatggaatctccctctgtcacccaggctggagtgcaatggtacgatctccgctcactgcaacctctgctgcccaggttcaagcgattctccttcctcagcctcctgaatagctgggaatacaggcgcccgccactgtgcctggctaatttttgtagttttagtagagatgggagtttcaccatcctggccaggtggtcttgaactcctgaccttgtgatccacctgcctcatcctcccaaagtgctgggattacaggcgtgagccaccgcgcctggaccatctttgccttttttgaaaatagaaagagtagtaattcttgcattgagaatatgacataatcccaaccccaaaccatgagtctcatggccatgtctaagccacgccctgacgatagggttgggatgactacgccaggcttagtaatgcacagggacaggaggcatttcggaaccacaccacgacactgctggcaagaaagatgggaaaacggcagcaattctgtctgctgtgctttgtgtgtgtgttctacctggctgattgaatttcctcccaacacctacctcagatgtgttgtctaggtgaaaataagcacttcaatgagctggtctaattttaatcctcagcccttcccagtcagccccgcccccatgtagttacctccgtcatgacaaagaggaacatcccaggtgcaaatctagcacagtttccctatttcacctgtgtccccctccccatcttcatgccagcatcagaaacaagagtccaaacatcctcggcaacactacagaagctgttcaaacaatccctgtgttctttccaatttgccgacgtggtctggcaaacaaagagatttctttgtttctctaagaaacaaaggtttcgtaagagaaaccttaagagatgataaatacaattaatagagagatagccaggcaaggtaagagaatgcttgactgttttaactgcttatcctgtgctgtaacagcttacctaagagatgtcagagggacggacagaaacctatcagcgctcaggcagaacaggtgctccagtggaggcaaggactgcgcctgcatctgtccatgcagaaactatgttctcatggatacaggctgatgatagtaaattctggtgggctatttactggtggagtgtctgttcccaaagaaaattaattattaaatcagtgtcaacttagagagatgtctctagtggtctgccgcagggcactgtctggggcactgtctgaggcactgtccactctgccacttttaacagtgctttgatggcctggggcacacagatgacacacttatctatgtgtgataacgctcagcctagaggaacacagaatgtattgaataaagggatctgattcagataagtgggcataatggaaatttagcaaggtgatatttaacaaaccgcgagcttaccttaaaaataaaaatgaaatccccatgagaatggatggggagaatgtaataaacattagtacaaataagacttaggagttttaatttaccattaataatagtaattgtaataatgataatagtaggtagcacttatcaagagtttatcatgtaccaagcactgttctaataatttaaaacttatcattagaggctgggcatggtggctcacatctgtaatcccagcactttgggaggctgaggcaggaggatcacttgaacccaggagtttgagaccagcctgggcaacatagcaaaaccatgtaagtatgaaaaattttaaaaattagctgggcagcctggcatgcacctgtagtcccagctactcaggaggctgaggtgggaggattgcttgagcctgggagactgaggctgcagtgagctgtgttcatgccactgcactgcagcgtgggtgtcagagccagaccctgtctccaaaatataaaataataaaataaagaaaattaaaataaaatatattattaactcatttaatcttgacagaatctttagagtaccttattggtatctccattctataggtgaagaacagatgtaaagtaacttaaaatgaatcaataatgtaatgtcattgtcaaaaagtattaatgtgatcttagagaatagggtccagaacatgagaattgataaagcttctctaactgcacttaaattattgtattctgttttgggcaaaatggagccttgaggaaaaaggttagcatgaccaggaatgcaaccatatatatatatattttttctttttgagatggagtctcgccctgttgcccaggctggagtgcagtggtgctatcttggttcactgcaacctctgcctgccaggttcaagtgattctcctgcctcagtctcctgactagctgggcttacaggcttataccactatgccccggtaatttttgtatttttagtagagatggggtttcaccaagttggccaggctggtctcaaactccggacctcgtgatccacccacctcggcctcccaaagtgctgggattacaggcgtgagccaccacgcccggctccaggaatgcaaccatttttaaagaggaacaatgaatagaaaagtctgatggatttatggctaaataacagaaagaagggtagaacatgagagtttgagtgaggacttcaaacccttcgtaaagttcagtttaaatagcatgaaacatatgccctgctgctttggagtgtggccatgaaaataatagcaaacacattccatggaatatttactatgactttcccagattacaaagtacaaggattagatgtggaaaagaataaatagaagctcaataaaaagcaaagctttctagtgggattgctttgtgagatgggaatcatgcctcactgaggatgtgcaggcagtggctgaaatcagatgacacagggcgaagggacctccccggatctctactctgtgagtctataaagaataaactgcagacactattttggtaatagatcaacataagaaaatttaaggctagaggtcaattgtggtaaccaaactaaatgtcctctgaaaaggcctccacctgtacttctaagtgtttccataaaatttagtaaatattggccaggtgtggggctcatgcctgtaatcccagcactttgggaggacgagaaggatggatcacctgaggtggggagttcaaaaccagcctggccaacatggtaaaaccccatctctactaaaaatacaaaaattagctgggtgtggtggcgcttgcctgtaatcccagctactcgggaggctgagtcaggagaatcacttgaacccgggagggggaggttgcagtgagctgagatggcgccattgcactccagaccctgtgtgtttattcactaggctatcccctgcccacccagactccatcatgaaatgaaaggcaggcatagcacaatattagtcagataagagtctcatattatgtgggaaccatgccattttatttctgaaacagcaacttcattgtgaggcttagaaatccctgagctttgtggcaactgaagacctgtcaccgtcaccgtagctggagtagtgagcaacacgaggtggtgggacaaaagccattcctttaagtgtcctctgtacctgacaaaagaggacatcaccaaagacctagcatacagttggtactcataaaggttggctgaattgaggctaattttctagctgcagcaccagtcctgtttataaaaaccggtcaaatcaatcttctacaaggaattgaacttcgagcactttgaagtttctaaatggaagtctgtatgtttcatcaagcttaaaaaacagtccaaggcattgatgtagcaaggcgttatggtgtcatagaaaggaaactggacaaagagttaaaacaaaaacggatttgaatcatggtctgtctcgatgcctcagtttcctaatgtggaaaacaattttatttttcacaagattctaaaaatccaatataattgcgttaggtgaaaagcattctgtgtacggtgacaagttatacaagtataaataatcaatatcattactaacaattacattattattaattgaatgagtgtattcacccattaatcattaccaatccattattacatgtgtattattaatgattattattcaattattatatgtattcatttattatacatgtaataattgagtaataaattattcaattataattaataaataatagttaattattacatgtgtaataattgaatacatgtactaattgagtaataataacaaatacacatgtaataactggatacactgaaggaagtgtattcacttatggtttataaacattccaacatcagatatgtaatatttgcctctttgtcatttagaataatctgtatcactagtcaagtgtttgtatccaaaacccaggaacagggtcgacttcgtgggtgtgtcacctgagaggtgacacacggttccaagcttaaagggccttgtgcttggtttaatgctctgctgtttccatcctgaaattcttattagcgtatgcatttttattttgtgctggacctcataaattatgtagccagtcctgtggtgtgaataaaagctgaatctgaagctgccagggtaggagagttggaggaaaaggtgggcttacaggaggaagctcctagctgtctgcacaggagggtagtactcagttgcatctgactgcagcactgaataagaatctcagggaccttggatatcattcagacccatctctcatttcaattgaagaaatcaagagtcccagattttcggccatttgcccgaggtgcccacctcaccagcagggtgtcctctacattctgtctaatgaatgaatggcctgccctggaacataagtagggcttccgcgttgttgtaggacagctttgtgttccagatcacagatgtctctttcataagccacacctcctcccactgctgtgtgggccacagctccggttagatgataactctttgactttttctcaaagtccctgaaatcagtcacagagaaaatggactgatcctttacatcaatctgagtgtccttgtgcgtgtgtttcattttgctttctattcatcctcaatgattgccaacctgcttgtgagatgtacctgagaataaccttcagacaaacgcagtgggctctgcattgatggtgctgattcagaacacatttggggtgttgtgtcatctgtctattagaatgcttccaaaggatgacgactcactgatagataatgttttgtttacaagcatgtccttgggtatgagactttgtagtgtcatgactgaccgtaaatctcactggcagtagcacagcatatgaaacaccttctgctctagtcattactttatgttcatcacaaacaaatcagaacaaattctgaatgcgaatctcctttcaagttagctgactcaggctgtcggaactcatgtaaaagcgaaccaaatatgacaggaggtgaaagctggccgtagaactggaaacggcagaacgtcattgaagtctgcctaagaactagtcagcatcccacctgcttgctcacagtcacactcaacatctctgtggaatttttagtgctcttttttgtattagtcttttagtcgttaccctagtgactctgatatgcattcctaacttatcagtttactttgaattaacattagaccacttgatatataatgtaagaacttcttacagtgtaatttcatgtacagacttcacaatccttttgttgtagctaaagtttacttctacctagattataaactccacaatactttgtcattaatgtactttatcaggtatgaagattcagttaattttaaataattttttaaaaagaaaaatactctttttcactctgatgcccaggctggagtgtagcagtgcaatcactgctcactgcagctttgacttcccaagcttaagcgatcctcccacctcagcctcccaattagctgggactacaggtgtgtgccaccatgcctgggtaattttttctacttttagtaaagacagggtctcactatgttgctcaggctggtctcaaactcctggactcaagtaatcctccccccgggcctcccaaagtgctggaattacaggcacgagccaccatgcccagcaagaaaaatagcctttatatttatctatgtattaacaatgtcttttacttgcctctccagtagatctaattttctatctggtatcatttcctttcagcctgaagaccccctccttgagcatttctcatgttatagacctgtcagcaacaaattctctcggtttttatttatcttaattttttttattatgccttcattttaaaaacattattttctttaatatagaattctagactgacaaggtattttcagccctagaaacttatcattccatgttgcctggtctcaattatccaatgacatgtcaattgtataagctagtttaaacaattcttgtcatttttattcaatatataatgttttttttttctttggctgacttttaaatttttctttcaacctttggacttcagcagatctgcttaaggtgtggttttctttattgactgagattcttgaatctgtgggcgactgttttaggccaaatttggaaaattttcagccagaatttcttcaactatttttttcttcttcattttctctcttctcttcatcaaggactacagataaaagtatatcagatcactctatactgtccctcagatcattgagaatgtgttcattcttaaaatctttttttaaatttgtgactcattttaggtaatttctattgattcgtgaccaaataaactgcttcttttgttgtgtctggtctgctgttaatctcatccagtacgttttttaaagcttcatctattatatatttcagttcttagatttacatttgctttatttttaaatttttcttatttttcttgaagttccccaattctttatcctaactatggatactataactttaaccattatatctattttttcctatggattctttatgtgcttatcatagttaatttagagtacttgtctgctaactccaatatcagaaatatttctgtaaaattattttttcttgactatgtctaataatttttagagtgccctggtcaaaataacttttgattgtatagtggcactgtggatgattcattgtaaaattttagaatccattatctctctttgaagagtattgagtcttgtactagcaggcaattaaattactaatgaatcaccctgactatgctgagacttgatgtgtttcatgaggatatgtctattttagttatgccatctctcagtcttgatacatggtatttattactaggagtggcccttataggttttcagtgaaaagttcaacatagttatcaatgccctctaacttcacgggactcatacttcaaacgctggctcttagcaacaggaagtagttgaaatctctgttaggctctttcagccttctgactgttggtttcctctagggctccttgactatttcccgaataaatgagcaggtcaggagtcaaccaaggacttgagaggagtttacgttcatattgtgcaacccctccttctatgtctctctcttttctagtatttcctcccccagtttccagctgctctggctgttctaaacttcctttctgactcctcaggcaaataggacttcaaaaattttttttggcctcagttctagccacccaagagatattattcgggaagtcctcgtaggggaaaaaaacagtgtgtatcttaaccaatgtcattcccttgtttgaagcgttaaatgccctctaattccatctgcatttggttgctttcattaacttgaaaattctctttctatttttccccagagtttataattgctatcagtagaaggcttaatcttatacaagcacttctaccatctccaagaccagagtgctccattggtttaatgtgtaaccatgagtgaacaaaattgttttcaaaaaatagacaaacctcactgaacctcaatgaacactgaaaagtaagaataaaggccgggcgcggtggctcacgcctgtcatcccagcactttgggaggccgaggcaggaagatcacgaggttaggagatcgagaccatcctggccaatatggtgaaaccccatctctattaaaatataaaaaaacgtagccgggcgtggtggcatgtgcctgtcatcccagctacctgggaggctgaggcaggggaacaggctgaacctgggaggtagaggttgtagtgagccgagatggtgccactgcactccagcctgggtgacaaagcgagaccctgtctcagaaaaaaataaataaataaaataaaaataaaaaaaggaagaaaaatgagaataaaaagaggtaaaacatggcgtttcatcttataaatttaaaatatacctgatttggtactgaatgattgtaactaagtttttaaacagtgttcatggcgtgactgtaaacccagctcacttttagaaaaacgtttttaccaacccaaacagtatcctactcaacaccagttatatttgtgggaagagagatagagttttctggggaaaggcccactcttctaagaaaatatatggttttctttgcattacttttccttctttattccctattcacgctattgaacatgtctatcccaacccttttttctggtcacataatccaggtctgaccacttggccttcttcttctcaatgtaattgatttaggaatgagtttgtggcccaaacaaatggaaagagatataatcctgggaatctgaatgaaataattggtaagataaagttttcttttcactgaggtagacagtagaatataaacttggaactggtatggccatcttgtcatctcttgaagacagcctgcctaagaatgaaaatcaatgctgagaaatataggacagagtcctgacaatgtcagttaaacctgaatccagcaactctgatagctatccctgattgcttagttatttgagccatttcattattgttaattgcccttacagcattttcagctgagttggtgttgtagaatgaacatttgtgtcctaccacaaattcatatgttgaagttctaacctccagtgtggctgtatttggacacagggcctttagggaagtaatggaggttaaatgaggtcataggggtggggccctgatccaataggattggtgtccttataggaagagccactgagcttgctttctctctccaggtgcacatattgaggaaaggccatgtgaggatatagtgagcaggccacctgctatgagccaggaagggaccccctcaccagaaacagaattttctggctccttgattatggacttctaggtttcagaactgtgagaaaataaatgtctgttgttgaagctacccaacctgtggtttttgctgtggcagctgagcagactaattcagttggggtcacttaaaactatgagtctccagtcatccaggaagtaggggtgcaaaggcagatttgtactgtgaccctgtcatggcaattcattctactggcaaaaatttccctcaattaaaacccaaatgatttcaaaacaccccataataggatcagcaagagactccaccaagactgaaaatccactgtgccaacaaaagccttctaaatgcacgttttagactttccttttaccttttcaagtggctcactggcaaaaatcaaggttctaattaaatctaaagggctatccaatcacacggttggcaccaattactcatttaactatgtatgtgttaagcataagctaattgcctttctctcaaaccagagccagttcagatcaggccattcaagagcatttaaacttggcacaagagggtagcactgaaaactgacaataaagaattctctcttgcaggagaacctttcaggaggctttcaatcaatttttgcaagttccaaaactcaaagaagcaaagctaactatgtagctggtgtatttctttctagatcttgaagcattaataaaaagatggactcatctgagaatcaaatatctggtgaaactatacataaatagatatatttgtgtgtctgtgttcatgtgtgtgcatgtggatatgtgtgtgtgtgtataattgcatgatgttcttcctcaccttcaaattctgacagattctaaggaggaagggcacagatgtgtttcctgcaaaagagccccgagtatcttttttcacctcccttccttccctttgtccagatgagaatctttgttttaggggaaatggaatttaatatgtaaaatttattctcagtgagtttcaccaaaataggaaccatatctctaaccttatattattattatctgtacaatacctgtcaaacggagcccccagtaaatgctgaaagcacttcacatccattgggaaggtgagtgcatttccctaacgtattttagagtataattaacacacagtgcctaacagagaaaatcatttttgtgtgttcagctaaacactcaactccacataagttgcatttgatatcgggttcactcggagaaatggctctcacacttgagcctgtgtcagaatcacctagaggggctgttgaaacagactgctgctctgggtcctttccccttcccctgggtttctgactccttagacttaagtgggggggtcccagaattacaatttttgtttgtttgttttttgagacggagtctcacactgtcacccaggctggagtgcaatggcgcaatctcggctcaccgcaacctccacctcccaggttcacgtgattctcctgtctcagtctcccgagtagctgggattacaggcacacaccaccacacctggctaattttttttttgtatttttagtagagatggggtttcactatgctggcaagactggtcttgaactcccataattagaatgtttaacaagttttctggggatgctgctgctgctggactggggaaccacactttgagaaccattggctaagaagctataggacaagagaggcagcttgccagcaggaaaggcattaagtgctctgctttctgggggagttttgcagtagttcacccactgtcaggagctacaaggctcacatccagctggtgtgagggcatcatgacttaaaagctacatgcctcacatctcttgtaataacttcatagacatagtgatgcggtttggctgtgtccccacccaaatctcatcttggatttccacatgttgtgggagggactcagtgggaggtaactgaatcatgagggcaagtttttcccatgctgttcctgtggtagtgaataagtctcattagatctgatggttttaaaaagaggagtttccctgcacgagctctctctctttgcctgctgccatccatataagacgtgacgtgatcctccttgccttctgccatgattgtgaggatttcccagtcacatggaactgtaagtccaattaaacctctttcttttgtaaattgcccagcctcaggtgtgtctttatcagcagcatgaaaacagacgaatacacagagcttgcagggaccccactagagatgtgccagttacccgagtcacagtctgagatggtcagagttatggcttcctttcaggtatttacaggtcacccagtacaggaatgacacccattagtaccaatcagggatcactttacaatgttgcctagtgacaaagttgaaacataccacctttgtatgtttgcagagaaacagagctagaaagataagatcaaattttcatgcagaaggggaaagaaagcattcctttgttaagcctttattcacaaggtacatatctttactcacattatgcccctattttaaaagcttaagaaatgtaaacattatgtcaaaaatttttcattcttggtttagctgaatctcaaagccaccagttggaaggatcatgccaatcaaggaagcagatggcttgctttgggcttcttcaacaaaatcacctagatcctaaattgctgtttctgtgacaatccatattgtctgtttctgttgcacatgataccacaggatttgctaatctctaacctaatttgtaaataggaagtaaatttctacttcagagcttctatcatctagtttttcttcacctgactgctatatggtctgcttcattttgttatgttgcttacttgaaaagaccatggagaaaatgtatttgttatttaaataaatacccaaatttgcaactccagatcttaactctgctaataaaagaaacttttaaaagaaacaatcttggcctaagtaaggaattcttacccttgttacataaacctagagatctaaagaagtaattattagccctggttgcattcacttaaagatctttttaaaaatactgacgcctgaaccatactgcaggccaattaaatcacaatgtctagagagatagggtccaggcacagaatgttcttaaagctccccagataattctaatgtagagccagcgttaagaacttttgaaactaaagtctatcactgagagaaaattatttttccttcctgtcacccttcctccccttctccttttttttaagaaagaaaatactgggaaagaaatcctaggctgtaattatgtgggttggttacagctttctttacaaacactcctgggttatcagaagaactgctctaaccttggggcaggtggactcttcctataatgacatgtaattattagtattattaatacttttgcaatcatattaataattaaggttcttttgcaataaaaaagagacatgggccaggcaggttggctcatgcctataatcccagcactttgggaggctgatgcaggaagactggcttgagctaagaagtttgaggccgcagtgagctatgtttgcaccactgcactccagcctgggtgacagacagagagagagagatgaaaggaagaaaggaaaggaagaaaggaagaaaggaaggaaggaagaagcaaggaaggaaggaaggaaggaaggaaggaaggaaggaaggaaggaagagagagagaaaggaaggaaggaaggaaggaaggaaggaaggaaaagaaagaaagaaagaaagagagagagagagaaaggaaggaaggaaggaagaaaggaaggaaggaaggaaggaagggagggaaagaaagaaagaaagaaaagaaaaaagaaaacaaaagaaggaaggaaggggaaaaaagaaagagagaaagaaagagaaagaaagaaaaagagacatgaatctaagctaaaaaattagacaaagattaggttctgcacttcagtttaaaaaagaagaaataagtacgcaaatctatcatttaatgagagcaaatatttatgtctccatgtcttaaaaatgcagatgtggcatagactggcgagatgctcacccacctgtttcctttcttcctgagcatgtgcctgaacatttcccagcttcctttgtccatggatatagtgacgtgactgagaatagtcagtggaatacgggcagatgtaaatatcacatccagagctggtcaatgaagcctacccatacatgactgtgatagttacttttatgtgtcagcttggctgggcgacaacgcccagataagtagttaaacattattctggacgtttctgtgaaggtacttttgaatgagattaacattcacatcagtgggctttgaataaaacagattgcctacaagaatgtgcctcatccaatcagttaaaggcctgtatataacaaaagactgaccacccccaactgaaaaaagaattctgtaggagatggccttcgaacttgaatggaaacatctactcttctctgggtttccaaagttctggcctattctataaattatagacttgctagcctccataaacataagccaattccttaaaataaatctttctttcctttctctctctctctctctttatacacacacacatacattttatactcacacatatacactttatacacacacacatagacatacccgtattctattggttctgtttttctggagaaccctgactaatacaatgaatttctaggaagaactcttaagaatgaagaaagaatttgggtttctttgttggaagtcctcttgccaaccagggacatccacatggacttagcatgaatgggaaataaactttcattgtgttaagctactgaaatttgtggttgtgattgttatagctgccagcattacttgatctaactaatatagcagatggtgaatgagatggttgttaatttccctttatcgctgacattctaaagcagtggttctcaaactcagctgtgcataaaaaaatcttaaagctttgagaaagtactcatacttggtctttaccccgaaattacgatttctttggtttctgaggtatagcccaggcactggaatttctaaattctctccaggtgattctaatatgtcaataatttgaagaactactgttatacaggatgactgagaccagagttaaaagttcatggataagagaaaccaagagggttctgttggtgaaaggcttcatctggatgaatggtatgattttctggcctcaaagcagagctcttgagctatataattatcgttattattaatagtaccaagaggatacatgcattatcttactaccttgctaaattctcacaataaaactcttccataaatattatgattctcacattttaaatgagagaagcaaagctcaaacagagattaaggtaacttgctcaaagtcacacagctaaggagtagagcccatgctcccaactctaacctgtaatacctcccattatcctaaagaaaatgctatcccacccccagccccccaccccctgacaggccctggtgtgtgatgttcccctccctatgtccatgtgttctcattgtttaactcccacttatgggtgagaacatgcagtgtttggttttctgttcttgcaatagtttgctgagaatgacggtttccagcttcattcatgtccctgcaaaggacatgaactcatcctttttgatggctgcatagtattccaaggtgtatatgtggcacattttctttatccagtctattattgatggacatttaaataacatatagtttcccaagccatttagcaggagaacctgctatagatcgagaaccactataattgagaaccactgctttagaatgtcaacgataaagggaaattaacaaccatctcattcaacgtctgctatgttagttacatcaagtaatgctggcagctataacagtcacaaccacaaatttcagtagcttaacacaatggaagtttatttcccattcatgctaaggccatgtggatgtccctggttggcaaatgtcctgatttgccaagatttgtcctgataaagaaaatgtcctgatcaaaataagtaagaatcacactgtgcaacttgctgctcagatacctgaaatattgcattcaattcccagagtcccagtttaaagaagaagatagtaaaattgtgttcagagaggagcaagtaggttgttggaaagcctggcaagcacgaataagtggaagagaaaggaagggttagatcccagaaaggcaatgctaaaaaagaaggaatgattaaagaaagagaacataatagcgcattcaaatattgtaaagtttgtcacgtgaaagaggaattagcctgttctccctttgtccagagggttaaatcaggatcataaattagacattgcaaaaaaaaaaaaagaaagaaaattctgtttggtataaagaagaccttctaataattagagcttttctgaaaactagcagggttgctaggatttaatgagaaaatatgttctgtaaatgcgtataaaacactgagtatttttgttgctattatcatgtaggtgagtgttccattcattgaaatgtgcaggtacatactgaaatggtggttctgcacaagataggaataagttagatggtcattaaggtccattctaatcctaagattttatcctcacatatcttgggtccctccaaaaaaaaaaaaaagtgttttataaaatgtcttgtctaatgactggttgactggtgaccaatatatatatatataccatatatatatttctttaatttattttttaattatactttaagttctggggtacatgtgcagaacatgcagttttgttacatagttatacacgtgccttggtggtttgctacacccatcaactcgtcacctacattaaataattctccaatgctatcccacctcccagccccccacccctcaacaggccctggtgtgtgatgttcccctccctatgtccacgtgttctcattgttcaactcccacttatgggtgagaacatgtagtgtttggttttctgttcttgtgatagtttgctgagaatgatggcttccagatgcatccatgtccctgcaaaggacatgaactcatcctttttgatggctgcatagtattccaaggtgtatatgtggtacattttctttatccagtctattattgatggacatttatataacatatattttcccaagccatttcgcaggatatgcagtctatttcttcccaccataaaagttaaagaaaatctacagcaataatttggtcaattgtggtttactgaaaacttactaggaggctaactttgagatattcactttacttgaatataaatatcacgaagtacatatagtggatagagtacttcctgagacagcacgaaggcccatgtctgtcccctttagctcctcccatagtcaatcattgtgttgagttgttcagtctgcattgtctcatcttctccatggcaagcttttctgaacaggtccactacgctttggtattctctccacagtatagctcagtgattgccacaccacagatgctcaacaaaagtttgatttggagatgacctagaccctacaaaagttgtctgtggtcctgcactcacagcatgataactgagggataatgtacaaggaaaaatgtgttttttttttcttttaaaaaaattttatataaatgtaagggatacaagtgtagttctgttacatggatatattgcctagtgatgaagcctgggctgtcagtatacccatctcccaaatagtggacattgtatccgttaagtaatttctcattcctcatcccccttgtaccctcccacttttccaagtctccaatgactattattccactctctgaatccatatgtacacattatttcactcccacttataagtgagaacatgtggtaagcaaaatacatgttagatatatctctgtaatgaaaggaaaagtaaaagaatcagtcttaaactactgaaataatttatgcatttctcccacatgtggcaaatatatcaactctctttaggtataatatacctgacctcattgctgatagcataagagctttaaacaaatacttattcaatacttagctttttctctcataaaatggaacaagatatactagggtagagaggacgcttctcacgttcactgctgtatcctcagcacttggtacatagtgtttgcatcacaaatactggctggatgaatcagtgaatgaatgaatgaatggggaggctatggatgtgaaatgtttgatatgccttttagagagatattacaggcctttgagtgactatgatatttccaccaagcttctcttttgagcatataacttagtaagtatcttaaagttcatgttgacagagagggtgaaagtatgaatactttcttgagcttggttatttctaacttgttaggtacagttatcaacagtgataacagtccagcctgagctagatataaacaagaactgtatgccagctttcaaattgcagtttccatgataagctggctctgttttgctgccactgaatagagtgccatttagcagtggtgagagtaagaaaaagttgatcctttggtactaaacagttgagacctactcaagggagctgacattttcaacaccacttgaaacttgggcttggagccaggagaaagtttacacacaatcaagagggcactgctgcatctgcaaaagcagtttcctgtagctagatcgtaaaccaagagtgatggagatgagagcacccaagttcataaaaattccctaatatgttcatttgtaaaagaagaaaacaacattggccaaagaaagatgttctcctagaaaaaggaaaagaaaaaaaggaaatccatcttaccctctaggtgaaaaacacaaataaaatgtccgcgggaatattaaatgcttttccaaaatgtgcaaaacaataagcttcctactgtcctggtgtgcaacgtttgagaggaggctggaagaaggagcattcttgtctatgggcacctgcttctgccatgctggagagaaggcaaatctcaaagggtctggtagttaggatgattggatagagtgatatctctatctcagtctaaaggattggaagtactacacattcttccttcatacagtccaccttttctgagcacctgttagcagccaggcagtgtagtaggaatgaggagataatcagttagccagaccacccctgcactcatggatcttatacaaaaacagaggtaaaagacaatcaacaatggactgattccattacaatgatggtgttagaagaagaaatagtactaggaatttacatagtggtgaaatctgacctacttcattccatgagcaggtgacaccgagctgaacattgatgcataagcagaaactgacaaaaggaagccattgccaccattgataggaataagaaataactatttcccaaattctttatgttatcaaattattctccacacaggtgttttggctttgcttttttaaattctgaagtctgaagtttcagaaactacattgtaattgaaaataggtactcccctctttttttctctgatgctttcattaaaaattctcatcatctttttatgttacttattcggaccttaaaatgtataaaaatatgtgtggtttttgctttcagaaggcacacttgggatctgaagcagcaataattatgaactgacaatacgaaggttggctggctctgatgaggaactccaaggaccttaaaattcacttatgtcaagaggggaaaaggaggaatctaccatagcaaaataagacccttgtacaggatacacccacgtgcacacgtgcactgagagaaaatgagagttgtagggggctgtaggatcctgactgtctcatgcctacagtgagaggttcatagagattaaagagattgctcaggttgtccagcttggaagtgacaaaggctgggagtgctgaatactggaatgtaatggaatccatctacaggtaaaaagcctatggcaacaattagagggagaggtaaagtctctgaggcggcaggcaattggtacggagcctgaaagcccaggacaaagttttatttgctttcaagagcgaataggctcacacctataatcctagcgctttgagaggctcagatgggaggatggtttgaattcagaagttcaaagccagcctgggacacacagtgagactctgtctctaccaaaaaaaaaaaaaaaaaaatagaacaattagctgggcatggtggtgtgcacctgtagtcctagaagctgagatgggaggtttgcttgagcccaggaggctgaggctgcagagagtgagccatgattgctccactacattacaccgtactcctaggtaacacagcaagaccttgtgtcacctccagaaaaaaagaaaaagccttaacaaacagaagtgaaggtaccctgagggaatattctatttggctggggactccttatcatgattttacttagtgttgcagcatattgtgttttctgaaggtaggtgttccccctcaatctttctcatcccaccggcccttctccaatgtgaccttgccattcctccatcaagaagggaactctaacttgcctccctcttcagatctaggctaccttatgagttgctggtagccaacaggaggtggtggtgaaagtgacactgagtgacttctcaggctatgccagaaaagccatggggcttgtgcttgattctcttgggacactggctctggggaagccactgaccatggaggtgactgactagcctgacgctgctattttgaaaaggccacatgttgatgctctagtcaatagagtatcaggtgagcccagcgttctgtccaccccggccacaatgccaaaacacgtgaatgaggaaatcattgtagaagtgatctcctcccagccatttacgtttccacctgagcccctagaaatcatggagctgaaataacatgccctgtctaaattgctaacacacagaaacggtacgcacaacaaaatcacataaatatagataaaatccactaggttaaaaggagtttgttacacataaaaaaaatgactgaaataaatgttatattatctatctataaagactactatgggcattgagcccgctgaacagataagaaacccaaggtacagagagataaacccaactagatgatagaatcataagtagaatcttataaatgcagcaataaaatgatcataaaagtacatgtgaggacactgagtttcatagaaaaatgacttggatccagatgcacagttaataaaggcagatccaggaaaagaacttagatttcctgaagagtgctggagtctgaagctctttccaaaatattagatcaagcacggggtagttaaaaaaaaaaatcacatgctttggcatcagatctgggctgattatatccctgaggtaagtttactttatgcctggttgcccctatctttaaatagaaagaaaacagagaaagaaaaatatgaataaaacaatgaaatttggaacaggcttgtagtttaataggatcgtactaacgttaattacctggttttgattattcaactatgattacataaaatgctaatagcagcagcagctgagtgaggggtaaataggaaacctctgcactatttttgcaactttttgtaagtctaaaattagatcaaaataaaaaattaaaaaaaaaaaaaagaaggaaaaaccatacctaacttgtggggttttaaaaaacaaatttggaaaatgcaatgcctggtactttaaaaagatttcagatataattctcctctgcttccctcattccaactttctgataaagccagaacagatggcccacggacttctggttcagaccttgctccccaagaaaaagtcccctcatactgcaggtatatgccagcactttgcagctagaacacctctcagaaaatgaatcgaggaagcagacgatgggaaacttcccacggtagtgaaatctctaaacctcttctctgacctttgaattcttggcagccacaagctacgttcttgccaagagtcctcacgcgtgtagcttccacatctcctcgccctcatttagagggtagacttcctccacactccagtcatccggtgccatctgtctgtggccatgaattagctgaaagctctccgaaaccgccttctcaagctaattgagctgctctaaatatttgaagagacagaaatggggttataccagagatggtttaataaaatattgaaagagcttttttctaacggtgtagtagtccacttccttctttcctcccccagggaaatatgcatcttatcagtttatcatccgaaatgaacttgactggtctgggaaatcggccacaccgtcaggggagagtgaaggagaaacttccgggaaatgatcagaactattttaaaatcattttgctagtgcaaatcttgaacattcataaaacttatctatgaagataaagactgaacataaagaatagcaatgggcttggcctcctaccttaaaaccatagagattgactgtgttaaaatatattgttgaggatctgtaacaggaaacagataacctcggaagttcagcgtgaagggctactgcaccacagtcagcttctggctacaagaggaggagtccatcagttcacaaaaccaatgacttccatcaatttatatttaagtttttttttttcactgaataattctgtccttctaatataaatctgacttttctaaccttgccttatacttcttggaaattcctacttaatatgagtccatataatcagaaaacatgatgaatttggggcacaaaaactaatttttatttatttatttatttatttgagacagagtcttactccatagcccaggctgaagtgcagtggtgtgatctcggctcactgaaaactccgcctcccaggttcaagtgattcttgtgcctcagcctcctgagtagctgggactacaggtgtgtgccaccacgcctgactaatttttgtatttttagtagagagagggtttcgccatgttagtcagtctggtcctgaactcctgacctcaactgatctgcccaccttagcctcccaaagttctgggattactatcatgagccaccgcacccggccagggcacaaaaactaatttttctactaacagttgctgggtatgccatggggcccatcaacaatggagcccactttgactcacagttctgtgctctgagtgagcaaaaacattaacctcaaggcctgtacaatgcctgagcattttctgaatcattaagtacaatgacgcagggaaagagaggacaggaagaaggctgggaccaggcccccttcaccctagtgttctgtcctaggaccgtgagtacagctgcagtcttaggtgtgcttgtagatcgggaggaggcaggaagcttgggaaggaaacagacactttggttgtccccatattgcttctggacccctcatggtgctctaagaaggagagagcaaatttgtctactgagagggacattgtagtggacatcaagatgcaagttagtgctttataaatttatatttcctcatcttttcaagttttacctctgatcatgataactcttttggttgttggtcgtactccctcctgtttcccttgactagtctagaaatccctcctccctaagttctccacccttttctccttttcttcaggccaaaatgttctcaagttgcctttgatgaaactagatctgaaatgacttctagttgattaatttgttcatacaatatactgtgaaactgggcaagagatgatataaacactccttgaagctagctggggaggactctgccactgttttttcattttacaaatgaaagagcctctatttatggcttttgatgacatagaatagtctatttgataaaaattaatagtaccccctctagttctaataaaaaatttatttattataacaatatctttataaatgtggagtgtcttcctcttaatgattttctggaactctagtggtaagatcacattttgattaaccatgcctggctaatttttgtatttttaggagacagggttttgccatgttgggcaggctggtctcaaactctataggcacgcaccaccacgcctggctaatttttgtatttttagtagagacagggttttgccatgttgggcaggctggtctcgaactcctgacctcaagcgatccacccaccttggtctctcaaagtgctgggattacaggcgtgagccaccatgcctggcctcttttcccattttctaattaatcatttgtcttattgagttgtaagatccctctgtgcattctgaatacatgtctttatcagataaatgatttgcaaatatttcctctcaagatatggcttggctgttttcttaacagtatcttttgaaaagcaaaaggttttaattttgacaaagttcagtttatcaatgtttcttttatagattgtggttttggtgttacatctaaaaactcattgcctaactcaagatcagaaaaattttctaccatgttttcttttagacgttttataacttttgctcctctgtttagttctattattcattttgaggtaattttatgtatagtgtaaggtaaggatttaaattcgctgctttttgtatggatatataattgtcccagcactatttgtttagaaaacaatgcttaccccctttgaattgcctttacacctatgttgaaaaccaactgaccatacatataaaggcttattttgggatctcttaattctgttccattgttgtatatgtctattctctctctctctctctctttctctctctcttttgagatgccagagtgcagtggtgagacaatagctcactgcacccttggactcctgggcttaagtgatcctcccacttcagcctcctgagtagctgggaccacaggcttgagacactgtactcagctaattcagctaatttttaaatacatatatttttttttggagagaagggatctcattttattgcccaggctggtctcaaactcctggcttcaagcaatcctcctgtctcagcctcacaaagtgttgggattactggtgtgagccactgcactgggcttatatgtctattaagccaaaaccacattgcctgataaatgtaggctggtcataaattttgaaatgagtggtgtaaatccgctaactttcttctttttcaaagttgcttggctgttctaggtcatttccatttccatatatattttaggagcagtttgtcaatttctggaaaaaaaaaaaaaggcctggggggagcttagatagggattgggttgaatctgcagatccactgcagaacgacagtcttaactacatagaatcttcctatctgtgaacacgtaatgtctctccatttctgtagatctttaatttttcacatccatgtttgtagttttcagtgtgtacttcttgcacttcttttcttacatttattcctaagtgctttgtactttttgatgctatttttattgttatattgtccattgctagcatacaggattaaattattgtagttttgtaggtcattggcttatataaaaaaaatcttataatctttttacaggaatcatatggtgacatgaaaagggttccataatatagtccccacctgctactccagcatcactccccagcacccgtaagtcagaatgtatgtttccctagcactgaacttctaaaaattgatacatgttagatgtccatgtgataatttcatacatttacataatcaaatcaaggtaacttggatatccgtcaccttaattatttatcatttctttatgctagggacattcaaattattatcttctagttattttgaaatgtccaatcagctaatattaactctagtaaatttactgatctacggaacaccaggtgttatgtcttctttcaagctgtgtatctgtacccattaatcaacttctcttccctcctccacactgccattcgcagcctctggtagccaccacactactctctatcttcatgagatccactcgctagctctcacagtctcacatatgactgaaatcatgggatatttgtctttctgtgcctgactcacttcccttaacataatgacctctagttctatccaagttgctgcaaaggacaggatttcatgctttttttatggttgggtaatattccattgtgtacatctaccacatttttcttatcctttcacccattgatgaacacttagattgactccacattttggctattgtgagcactgctgcaaagtacatgtgagtgaggatatcgcttcaatatactgatgtcatttcttttggatatatacttagtagtgggattgctggatcatacggtagttctattttttagtttagtttttttttttttttttaaggaaactccatactgttttccacagtggctgtactaatttacattcctactagcaacgtatgagggttcccctttctccacatcctcaccaccatctgtcattccctatctttttattttaactgggataagattatatctcactttggctttgatttgcatttctttaatcgtgagcactgaactttcgacagtaccctgcaaccttatgatgtttttacttaaatttaatttcaacctcaagtctcagtttatgcattacctcatcctagaagcctttcccgttttctctctacttgcgctacgctgcatacactggggaacgcatgtgtgcatggacactgtcatttctataccaaattttaaactatactaaattttaactaactacttacatgttcatcttgagaaacctgtgtcaccatgtatagcaaaacctgccagttgtttatcgatatccatcttctctttccaaaacaatagaacccctaattttttgctaggcataaagcaaaagaaataaagaccatatttctggccccgcttgccattaaatgcagtggtacgattatcttgcatccagtgagagaagctcatcgggcagctcccagaaaccttccctcaaaaacagccaatgcatatcttgtttttctttttctttttttctttttttttttctccttcttgccagttaaaccagatctgctaaatgaggctagaccagccaccctgagtggatgaagtgaagtgactgtgggaacagagacccacatggggcaaagcaacaataggaggggagcctgggtctccatatcccaccctggtctgcctacttctgggctttccatgagaaagacacacaattctccctgctttaggctgttatttccttgggtctctcttaactgttgccagacttagtcgaaagaggtttataccacatcctattgcatcttcagtacctggtgctgtgccaaacacatagtagttacttaattaatgtttgctaatttactgcaaaaggatagcaaaagttaaaaaaaaaaaggaaaaaaagctttatggaatattaccttcaaatccatcctgctccacatggttaccaaatctctttccaggataataaaatcttaacattttaggcatacaatttggccttcaaaggcctctcagctttttaaatctaatttctattctaatttattcatcatgatgttaataagatgtttggtttttcatgtagaaggaaaagcaaatttatacaatgattccatggatagtcaagagacagaaggcctgtaattgactataataatagatctcacaaaatcataaaactgatagtaacaatggggttcaagcaattaaacaattttgattccacagatgaaaaagctgatgttcagagaggtgacacaactaattccaggccacacaaacattgaatggcagatctgatgtcagaacccagataatctaacttccaacttggtactctcagaatcagttagagtgcctttggttgtcaagagcagactaactaacataagcaaaaatccttttaaaatcttagaatttacaggatccaaagcctggaacaggcaggaaccaggcagctctgttcctgcctggtttccatggcaacatcagctacagagctcatactgatttagctgacggaatgaatgaataaactccaacaacggttattgttctgtttttcattctgattgtagaatgcttctttttcttttcttttctttctctttctttcttcctttatttttctttcttcctttcccttttctctcttttttcttttttctcattctctctttctttctctttctctctctctttctttctctctctctttctctctttccttctctctctcccttcctttcctttccttctctttctctctctctctctctcttcactcctttccaccattatttttgcttactgaatctgcttcccagaacagtggctgatgagaagcctaggcaccaattttctcattcccatttccctcaacctaatatagggagtgagatacaagggtgaacccctaggagatgcactttgagagagagagagagagagagagaaagacagacagagacagaggagaggagagagtaagagttagctctctggctttcctggcttcctctcattttctgtttttatatgcattttatttgttcacatgtttttaaagtctgcagtttgagaccatgagatgacaaggagagaactgaaagccaaacttttgagaatacttaagagaaagttaccaagtgcctgagtcttctatgatatcactgagcaaatgacgacctccgccccccatattttagaaacaaataactgaatgcatgaataccgtaaaggaagatgagtacatacatgtaagcacttagagaaatgagaaaccaccttgtatttttatctggaaactaataaaaagcaaaatgcatccaggaatattatacgacatgcaatttcgcaattcaaggtttttctctttcagtgtgtagagttagccataaagcaaattgacagatactgaatgacctagttaaatcttccacggatgctaatatctcctgttaacaccctgcagcttgaccctaaggacttccgcgcacccatcacatgtatagtatggtgtttatttcttgattttatatttttaatatataaacacattggttatggacaggaaagaccttctgtcttattaaatgactcacatgatttgcctcgaaaccacaagctaagtcaaacttgtgctaagcatggtttaatctgacagaatataaagattctaggacaaatcaaacccaagtgaaagtttccagttttattgccacacccaagttcgataaagaagcaatatgagcttgaattaaacttgcagccgagaaaggttacaacttgaatatagtattgagcagaaagaaaactttccatggatcaaggactcaacataattctaggatctataaaaaaaatatccatctgatcttcaatgtgtgtacattctaggagtaaaacctatgctttgttaatattacaaagtaaagcaatcttctttcttcccaacagcattgctttgcccattttagtctgttatgtagcattatccatgaagagcacgacaagggaaatgtacagcgagcccttgttaatggtcttcggagaaaatggtttaattgcacagacaaatgctgagtcaaaggtgattgtgcaagccagagaaggaagaaaagaaaatattttttaaaattagccaataatccatttataaggacaacaaacaatagaagcttaatgactttttgccatattactaaaacatgtaagaattacacgtgacttctggaacacaaaattcttaatcccaggtcagaatagttaattcaaaactaatttgttttcagggaacatatctgagaaataataaaatgtagggtctcagctcacatccacccttgctcagatgaatgatcataaaaatggtcctaggcaaggccacagggtctggctggctgaggactttgtgcactggaccatataccatgagcagtgagttatttcaaactccagctatggggccagaaactccttaggagtccgcaccagaatgtctagaggagcacgtatattaacaagcatattttacacttaaaaaaaaaattaaccacagaaactgagattccaccagacttccttgataggaagataaattgtaaaagttttactgaaggacttaatttttaaaattaagccatttaatttaaaaaaataagacttttaaaacaatgttgagaaacacacccttcaccagaagaagaaaggggcgtggccagggaagcagagcagttccgcctgtacctggtttatgcagtgcacttctgaatattgccttcgaggaaaggttaggacaggataaagcctccagacaccaccgttcgagtataatttgagccaggaaagctgtcagtgcagctttttactgtgttgtagaatcctttgggaaagaaatcttttcttgggttcctctgagaattccgactgaggcaaaaccagatttatcagggattttgcagatatcctgaaacaaaccgtctctcagcgtgagtctaaaactccatccgccaagaccgtcgctgggactaagccctgaagctgagtgatcacttgcttcctctgctcctctctcgtaagaattccttccctcaaaggcctcacaggctagatagggaggcagacacaccagagaaacaacagtgaagcatgcaaagtgctgtgaggaagtgttgtgcaggtattgtagaagctcagattgggagtgcctagggctgaccgacccagacagtcttttatactgggcatgtgtgtgtgtacatgcatatagaaatttggggaggagaagaaaaagaaataaaaggaagtaatagtggctgcaacttctgcctacagatactatgaccttgtatagataatgcttttgtgactatgacttggccttgcttgcaacccaccatctgagtcctgctaaccgaggaccaactatttaggaacaagctacactgtgccaccaaaacagacatcaacaacacctttattacatacacaattgccccaagaatttttatatatactattttcctttgcagcaactttactcaccctctctctcttttttcttttaaaatttttagaggagtttcactctgtcacccagggctggagtgcagtggtacaattatagctcaccgtagcctcgaactcctggggtcaagtgatcctcctgcctcggcctcctgagtggctaggattacacatgtgtgtcaccaggcccggctactaagctactaaccctctcttaaatacaagctactaaatctattgaatgatccgggaagaaacaatatgaaaaataaaaagataattaagaatttcacaaagcaaatatatgtataatgtctagaagaatcaaagatggaaagataatatggtaatatgacactaaagagcctgatgaactttttgatttgttataaaacatttaaaaattttccttcaatatttaattggccaatgagtctccaaatagctattgcctctctctcttttttttttttttttttttgagatacagtctcgctctgttgcccaggctggagtgccctggtgcgatctcggctcactgcaacctccgcctcccgggttcaagctattctcctgcctcagccttctgagcagctgggactacaggtgtgtgccaccacgcccggctaattttgtgtatttttagtagagacgggtttcatcatgttagccaggatgttctcgatctccggacctcgtgacctgcctcccacggcctcacaaagtgctgggattacaggtgtgagccaccgcgcccggccatccctctctctaactcttaatccacattgccatgcattggttccctgctattaacctctttggttctaatctagatgatggcatctgctggtcagtgtcctggtccaatgtggatcccatccagcatgctctccaccttacatgcagagcagtctttgtaaatcacaaatctcatcatgtccccccttcactcaaatgcttagatacagcctttcaggataaagtccaaactttttagccgtctataatctgactcttttcttgttacttgctcaatttgggacatgtactctggacaaatgaactgtgtcataccccaagcacgccatggtcttgtgtgccttcatcttttttactctccactccttaccagggatgaactgcctcccattctcagtctagatccgtggttctcaaggttctcaagggaacagtggcgacagcagcaaacgggacatgtcagaaatgcaaatgatcaggcttcatctcagatctcctgagtcagaaattctggagaatggaccagcaatctgcaaataaggactatagaagatcttataccacagaaaagctaggcagcgtgcagagaactagagggccatcgatgacttctttgcctgcagttcagcaaatacacagcagaagtgaagaccactaggtcacttggtcaagctattcataaaacagaagtggctcaaggagaataaatggattatacgcagggacccctgtagcttgaggagtcagatagacattatagaaacagagactgtcagtgtcccaggggtccaggaggtcaaatagtccagtctcatcatgtcacagaggataaacaggagtcctggaaaggtgaaatgacttactcagtgtgagacagatggccaagagaacactgaaaccaaagtgttttagaaggaaaaagctgcatggtaaaaacagctgagtcatctgatggacactgacacaggcaagtccctcggtgggcacccaggcagaatgagaagcatgacatgtttgttcttaataactcagtgggctgatcctgcagtctaggcaccctgctgacgggaagaagcaacgactcagttagactcacgtggatctgtccagcactggacgtcagcagtagataggtttgatggagctggaaagtttatcctttaaaaatggccacaaatattacacttataaatatgtatgtgtgtgggtgtagaaacattacttgtaaaaaatgaaacctgttagattagatcaaactaggttgccgcttctaaggtagtgaacgtgtaaaagagtaaacctcatagaaacatgaggctgcccaatgcatgtgtacatgttggtgttgtgtgcatatacttcatcatatacatatagttagaaattgtatgtataattaaaaatataatcattcaatcataacattaaacagtgaaattattacatcataatgttaatcataacatggagcaattaaactacagtgttttatgacatatagttttaaattataacattaaaaatataggtaaacggctaggatcggggagcaaatattaaagtaaataaatccctgccctactccctgagccctttctgctcatattttgcactcttctgaggactgatgttggcctcccaggcttcaggacaacctgacatcaagatgcctttaggttctttctgacagctgctgctgcttcttcatcacagagagttcatttgctctcctcggcaggccagagctaattaagaagagaacagcccaggttcaccctcccaaccctcctcatcggctagaactgcctgtttgctgccctccaggtcttctgcagtgagaccccctgcttttctccagagagtgaggaaaccaccactagaggggtggggtctcaacacagacatatttacccaacaggagcagaatgtttccatttgacaattccactacaagaagcaggccttcttggacctcttgcccaacttctggccttctgattctaagtagaagttgtcatttttctatgactactattaggttggtgcaaatgtaattgtggtttttgcaatgaaaagtaatgacaaaaaccacaattacttttgcaccaactagtgctagcaatgccttaaaaaataaattgggctcaagatttcttggggcataaattgttttgtgctgttttccgtttcatctccatgttccacgggcttaaacaccacagagcaaaggcagcacgtgtctgtggagctgccccctttccaaggaagctgctttgaccttcaccttctgcctcctggtagtgtgtgatgatcacatggaatagtaaccagagctgtgtcacacttcacaaaacaccttggggattttgtgacctcaaagtattctcttcacctggcaggtggcatgagccatgggagatcccgacactcccaactttgctaccaatgactcagatagagggacacatgtatacatgtgtctgtgcacattaatggaccagcactggccatgtttctatgaggccttttcttttacatgattaccatttaagaagcagcaggtgaatctaacctattttgttttcttacaagtaatactgtgttcgctttttgaaatttcttttctgaactttagtaaaaccatttgctactctttcactctctttttgtgtttttttttttaatttttaattttgattttcataggttttgggaaacaggtggtatttggttacatgagtaagttctttagtggtgattcatgacattttggtgcacccatcacccaagcagtatacactgaacccaatttgtagtcttttatcccctactgccccccaccctttcccctgagtccccaaagtccactgtatcattcttaggcctttgcgtccttatagcttagctcccacttataagtaagaacacacaatgttcggctttccatccctcagttactttatttagaatatggtctccaataccatccaggttgctgctgctgcaaatgccattattccgttcctttctatggatgagtagatagatagatagatagatagatagatagatagatagatagatacaatttctttatccacttgttgattgataggcatttgggttggttccacattttttgcagttgtgaactgtgctgctataaacatgtgtgtacaagtatctttctcgtataatgacttcttttcctctgggtagataagcagtagtaggattgctggattcaatggtagttctacttttagttctttaaggaatctccacactgttttccatagtggttgtactggtttacattcccaccagtagtgtagaaggtttccctttttaccacatccctgccaacatctattattttttgattttctgattatggccattcttgcagaaggagtaaggtggtatcacacggtggctctgatttgtatttccctgatcattagtgatgttgaggatttttttcatatgtttcttggccattttcacatcttcttttgagaattgtctattcatgtccttagttcactttttgatgagattgtttgttttttcttcctgatttttggagttccttgtacattctggatattagtcctttgtcagatgtatagattatgaagattttctcccactctgtgggttgtctgtttatactgctgattatttcttctgctgggcagatttttttagtttaattaagtcccatctatttatctctgtttttattgcatttgcttttgtttttgtgtgtgtcttttgtttttctcctctcccactcttatccccaacccaactttgatttctctctttattctctagaacgtgaattaaccagcagcctgcatttcacatttaactgaagaagcagaattgatgagtgtcacctgaactatcttgaacatttcatgtcacattgcatgtcagatatttaatcttgacacctcctctccgtccagagccaaaaagtcaccaggaatgaagaattctttcttcatcatatagaattttgtaggccatggaaagcaatctagacattattctaagtgctatagaaaactgtgtttgagttttgagcaggaaagtgatatgatttgaattctacttaaaaactcaggctgggaaatagaagaatgaaagcaaagagaccagtaagaggatttattgcaagaatgaaaggatcacatgactatgggggagagaaatggatgaatttgggatatattttgtgtgcagccaacaagacaaaaattaatgcttgcaaggaggggaaaagaggcatgaagggaaagagatggatcaaagaagattcataggcttttacttgagcaactaaatccttgcagctgccctttaacaaaatagggtacagagggataaaggaaatttggagagagaaggaataaaaagttctattttggccacattatgtttcagatacctactaaacacacaaatagaaacgaaggaaagtggtcaccttattttaatgggaaggcagcaacctgaaaacctagtcatcctggagcatccagcagagaaaatttctattgcaagaagtaaacacttgattttgccttccagacagatcatttcattattcaaagaacattttttttcagaaggaccatgagatatgcaaatatatagcagagatttttcagggtacacaggtgttagaagctaaaagtagtggagcaaggtgacaaaaaagagatcctttctagcgggcagtgaaatgcctatatattattttctttagagcaagattccctttccaagtatgaacttaaactgacctatccaggtacatattattattttcttagaaaatgtgtgtgtgtgtgtacacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccaccaaaaagtgggcaaaggatatgaacaggcacttctcaaaagaagacatttatgcagccaaaagacacatgaaaaaatgctcatcaccactggccatcagagaaatgcaaatcaaaaccacagtgagatatcatctcaccagttagaatggcgatcattaaaaagtcaggaaacaacaggtgctggagaggatgtggagaaataggaacacttttacactattggtgggactgtaaactagttcaaccattgtggaagtcagtgtggcgattcctcaaggatctagaactagaaataccatttgacccagaaatcccattactgggtatatacgcaaaggattataaatcatgctgctctaaagacacacgcacacatatgtttattgtggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccattattctcagcaaactatcgcaaggacaaaaaaaccaagcaccgcatgttctcactcataggtgggaattgaacaatgagaacatatggacacaggaaggggaacatcacacaccagggcctgttgtaggttggggggaggggggagggatagcattaggagatatacctaatgttaaatgacgagttaatgggtgcagcacaccagcatggcacatgtatacatatgtaactaacctgcacgttgtgcacatgtaccctaaaacttaaataataataaaaaagaaagaaagttggacttaagaactgtaaaaatgcaaggtgatataatttggatttgtgtccccacccaaatctcacatcaaattataatccccagtattggaggaggggcctggtgggaggtgattggatcatgaggatgctttcttatggtttcgcactatccccctagtgctgtcttatgacagagttctcaagagatctgcttgtttaaaagtgtatagcacctccccacacccccctcctcttgctcctgccgtgtaagtgtgctcacttccccttcgccttccaccatgattgtaagttttggtgatgcctccccagaagcagaagcttgcacagcctgcagaaccatatgccaattaaacctcttttccttataaaaaaaaaaaaaaagaaaacgtgtgtgtgttcaggcctggcacagtggctcacgcctataatcccagcactttgggaggtcgaggtgggcagatcatgaggtcaggagttcaagaccagcctgaccaacatggtgaaaccccatctcgactaaaaatacaaaaattagccaggcgtagtggcaagtgcctgtaatcctagctactcgggaggctgaggcaggagaattacttgaatctgggaggcagaggttgcggtaagctgagatggtgccactgcactccagcctgggcaacacagcgagactccacctcaaaaaacaaacaaacaggcaggacgcggtggctcatgcctgtaatcccagcactttgggaggccgaggtgggtggatcatgaggtcaggagatcaagaccatcctggctaacatggtgaaaccccgtctctactaaaaacacaaaaaattagccaggcgtggtggcgggcgcctgtagtcccagctactcggaaggctgaggcaggagaatggcgtgaacctgggaggtggagcttgcaatgagctgagaccacgccactgccctccagcctgggggacagagcgagactctgtctcaaaaataaataaataaaaaaccgaaacgtgtgtgtgtctgtgatgatggggtgtggatgaagactgggcaagctatctcaaaggcaatcagaaattgacattccccccaaaatccaaaaatagcaggaaaggtatgtaggccacagagtctgcttgagggtgagatataattatagaagggaaggaaacctggactgataaatctatctgtctttttccacttgtcatatatataccaatgcttcactactaaggtagtgaaccgtgatagagcatggttgtgaaattgaaatcctgggaccagaccatgtccctgcgggtagaaggtaaaattccttccaaaggaagtagatatttttactgtctgtgttccaatggagagatccattccagtactaatacgaagtttaagaaggcatgtgttaaactagaaaaaactgaagatgaaaagaacacagcttcctcctaagagacttagaggaagcatggctctggatttcgattgagtactatctacctgtgagtagtccttcgggggtaggcaaagtggattctgcaataaggcattaggccagaagctaagggtctgggtatgttggctttaatagttaccatatctagttgctattataaattgtcctctttgttgtttttttttctattattgaacacactgtaaatcttgtagaattagaggcccatgcttggatgaaacatcatgggggagagcagtagcagtccaaagggagccatttcaggaagtaggggatacatgaacgtcagctgtggcccttgcgcagaactgagagtgctggctagctgaggaacacagcagcaagggaaggaattagtttaacagttaccatctcctagaaactcccagaaatacacagaaagaaaattttgcaaaagactaaaattactgcattcaagcaggagggaggctgggaccattgtacatatgttctttaaaagggaatatgttctcattttatctaaaaatgagacacacctggcacatttgtctgtctccttctgtaggctataagctctttcaaaacaaggacctatcatgtcagaaagacttaataattatttacaaacgaaagaataagggtatccttgaatcaagcctttaatttgaataactcgattggttttacagtagcaccaagttctacttcctcatttacacattgtgaattacaatgctattattatttggaagtaatggcttttaaatgagcctggagttgaaatcgtaggaagaaagtagttctgtgtatgtaaattatttggttgatgaagggggcctgccgctccacacctgtgggtatttcttgcaaggtggagacgagagactgaggggagtctgatctctctttcccccacaggttgaaagagatggttgcatgctgttgttctttaccaataatgccagggataactagccacggagggtcaaagggtagtaaggctttgtaacaactttcttaatgcaatgcaatcatacaggtggtatgcatggccaccaaggagatgcagattggatttaactagaataacctggggactaaccaaggttccttttctcaactaaaaaaaaaaataggtatagtgatgctaaatctctaaatactcttagaaagattaagaaaataattataagatatatgtcctcatgatggaattaaaaatgaatgtattaatgtcttgtattggtagatttgttttatgacccagcatgtaggctttcctgataaatgcttcacgtacacataaaatgagtatgtaatctgcagtaattggatgatgtaaataactctctatatggtcaagctgatggatagtgtttcttgagttttctgtatcttcactaatggtccatcacttgttctgtaaattactgagagaagaatgttaaaatgtccaaatatctttgtgaaggtatatctttctccctttctgtcactttttgcttcatggatactgaaggtatgttattaggtgcataaacatttaggattgcgaatcattatgattttaccctttttatgtctaataagacttcttgtcttgaagcctattttgatatttatacaaccatgtgcaccttcttgtggttagtgtttgcaatgatgtgtatttttccatgaatttactttcaattttttaattgctgtgcatctttatatttaaattatatatgtgcagaatcctatggctgggtcctgttgtagatatatatacatatatatatatacgtatatatatgtatatatacatacatacatatgtatatatatatacatatatatataatcaaataatctctgccttttggaaaaatatattttggtcgtttacatttaatgtaagtattgatatgactgtggttcagtctcccatcttgctggcttttttaatatttggcatctctgatcttcgttactttgtcccttatctcttcctcatttcctgtgttcttttgtgtgaagcagtattttttttaaaatttcttctatctcctccactgcattttaagctacatctctttgtatttttaaattcattcctagagtgaacatatgcatccttaaagtgtcacaatctactttgagcaccaatactaaatgttagggattcaaacacgagcaaggcatatccctccttttcggatgagtggagaaggcagacatgtaagtaataaatacagcaaaacctctcactattcagaggacctttaacatggccacaaggctcaagcttatcattcgacgaacttgctaccagtatttcttggttgtacagattattttttcctcttcgctcactggatttcatatttgtctgaaaacatttcgccctgtttttaactaaattgtgttgtcatttgtatagtctatatacaagtgctttgttggatatgtattttgaaaagattttctcccaatctatatcttgtcttttcatcctcttcacagggtcttccacagagcaaaagtttctaattttcgtgaggtataacttattgattttttttggtttatagattgtgcttttcatgttgcatgcaggaaaactttgtgaaacctaaggactctaagattttcttctatagttttatagtttcaggtttcgattttcactatatgattcactttgagtcaatttttgtatgtggtttatggtaaaggtcaagatttttttttttttggcatttgactatacctaatttatcctttccccattgaattgtcctagcattttgtcaaaagtcattgctcatatatgtcatctatttctagactactgttcccttgaaatattggtctatttttatgccaatactacactgttttgcttactttacaataagtcctgaaatcagtagtataaattccttaactttgacgtctgttttcaaaattattttggcaattccagacctttttcatttccatataaattttataatcaatttgtcaggttctacgaaaaagcctgctgagatttcaattgagattgcaatgaatctatagatcttttgggggagcactgacatactaatcatatcacctcttctgaacatatgcattcattatgatctagcaatctctttctaagtatgtcttagaaactcttggacaagtgaacaaggaaatatacacaaggatgcttctagtactgctgcttgtaacagaaagacaccagaacattttccttatcacttgagaagatagaaaaatggtggcatatttatacagaaaaaaattttggaatttcatgtggcagttaacaatgaattgactcataaacataacagttacattttaaaaaaggaatatatatagtattatcctatcaatattacattaagaaatatgtaaaaccaatcacatgttgtttgagaaagcaaatatatgtgttaagactatacagaagaattaggaaattataaatacaaagttcataataaaattcataatgagctttttacaggatggggaaagcaataaccttgggagggccacaaagttgtatttcttaatcttgatggtgagtacacagaatgttatcaaagtgttattctatacagcatatatgtattttagtatatccttttctatttaatatttaatatctaaatcatttttaaaaggaaagacagagaattttatcgagggggaggaatcagagtaaacttaaatcttacactagtgaaacagggcacaagcatttatggttcaattgtgtaatcgattcttcatttatactattccatttgcagcttatgaactgcaaaacagcatcctgaataaatactaggagtcgccaatgtaaacctgttaatattgtgggatttttttttttttggacactcaccttctgcaaagtaacaaaagcactttaaaatgtgagaataaatgttgttgattgcagaagaataccagggaaaatagcacaggccatgcctttctctcttactcctcctattgggtctgcaggcctttcgcttgcatgagtcatccatactcaggtaagcactgtgcctttattctttattgcactaggcctcttgacaaatgactgtttaaggagtgtttgcacacctgtcaatggttcctgtcatttgtcaagtaacaaatataaaatctgataactaaacaggagaaaacctgtataaaccaagaaatattggtaccataagaagttcaacagatgataaggctaagccctgtggctctctggaagcccctccgaatagtgagtggttctgctgtatttgttatttatgtgtttgtctcctctgctcatttaaaaagtagggactatgccttgctcatctttaaatccctaacacttagcattggtgctcagtaagtgtccttaattgatggaaactgatatctgttgatcccaaataaaaacaggtcaaagccatctttcacggcatattttcaaaccttctgttttcgcattaaatcgtgaaccttttgaaagtatctacacacttttaaaatattttggaggcattattcaaataactattttgatactgagaaaatactaccagtggcatagatacaaattaactcctggatgcttttaactaatttttgtgtttggtgctaatgaaaaagtacctgaagcctttaactttgaagcccgggcttcaaagacatgattgctcagatgtcttgctttattgttgcagtttagcaagacaagaaactctcccaaaatgtcttactattatgtactcactgtagagaaaatatgattgtgaggaagaaaagtaaagaaggaaagcagtgtgagagttaagcacttgaagtttgcctggagtgaagaaggtcctaccagttaagtgctttggattttttcttttttcttttctttctttcttttcttttttttttccagatggagtcctgctcgattgcccaggctggagtgcaatggcgcgagcttggctcactgcaacctccttctcccaggttcaagcaattctcctgcctcaacctcccgagcagctgggattacaagcgcttgccaccacgcccagctaatttttgtacttttagtagagacggggtttcatcaccttcaccaggctggtcttgaactcctgacctcaggtgatctgcccacctcagcctcccaaattgctgagattacaggtgtgagccaccacgcctggctgggattttttcaagaatgtgtactcaaggtccaaacttttagatcatttgaaggaaatccttttgccactctcaggtaaatcactttggagctctgtaaagagtaaaacagccctccgcagccacacacagatttgcatggtggggctgcggagcctcggagtccaagcgtgacttatagtccctcataagcagaggccaagaagaggccagcttttggctttttctttctttctttttcttttttttttttgagacagagtctcactctgtcacccaggctggagtgcaatggtgtgacctcggctcactgcaacctccacctcccaggttcaagcaattctcctgcctcagcctcccaagtagctgggattacaggcgcccaccaccactcctggctaatgtttgtatttttagtagagatggggtttcgccatgttgaccaggctggtcttgaactcttgacctcaggtgatctacctgccttggcctcccaaagtgttgggattacaggcgtgagccacagcgccggaccttgactttctttcttgataactgtaaaagcaactgaaacagatgatgaaagaagaactcactaccatgagccagagcccatagttctcaataactcaccttgcccctgagctgacaccctcccacaccctgcaacaaatacatgtggttttctttctttgagaaacatcactatatttgggcaacatgtcacacacagcccagtgtattctcggtttcccaagtaacctgtagagaaattctatgatgtgatgccctttttcctggaggaccatagaattcagagggagaggaggccttgagaccatcctcaggtctcctgcctgaatgttgctaagcctcaggactccctccacccacatgcaaccacacatagcttttacaaataaattaagagtaagtcttttgcgggtaggtattatggcattttcacctcctctaggcagaagtagtgtggtgcatttttaaggaaggggaggttgctttgcacaggcctggaggcagaagatctagtcatccatatctccccaaagcacactgccccccttatcctcggacttgcttctaagatttgctgtcttgctgagaagttagcagtactcatcctctgaagatgctagactttccagatatttggggaaagccaatgtaatacatagcaccctaggtcagaagtgtgccttgagacagagttctacagtgattacatattttcttcctagtctgagcagccacatatcaactatcaagaaggtttctaccctattcttgatgctatgcctatgcagtttaactccagaatttatgaagacacataatactgttgacagattggatgagaaccattatcatttccccagattatcgacatgtagcatgctattagtaggagacaagcagtagattatgatgtcagtctgtttatgtgtcttctcactaagagaggtgagaaataaaagccagtggggatagaagactggttttggtctggcttaaacctccatactgtggggttttattctacgtagtttgctgtaaacgtgtgcccacttcttccttcttgagggctcccaggtggccatagatctctgtgacatgaagcttctttggagtattctgatgataaaagggagaatttcaattccatttgacaggaagagtcactccctccttgaagtggaaatgaaaatggatccctaactgtgcaagaggcaacgatgaaatagctctccctctgaccctccattaaatgacagcaggcagtagaattattatttggtactttatgcccaccgttgtgtcagctgtacacatgggccaaccacacatttctctccttccataattctgactcatgctgcatgggcttgagaacaatgttgaaaagttcccccagggtttctgatttacagtcccctcccttttccctggtattcaactaatgatttagaagctggaagtagaggaggctcttcttatttctgtcaaagagacagaaaaagagcagtcagagacagactaagaaatcatgattctaggaatggaatgtcccattctagaaggacagtgttcaatgtggtgaagaaattgaggaggagagcagtaggcagaggttattggttttgatggtgatagattctgttaagaaattagtggtaaaatcctggctaacacgatgaaacaccatctccactaaaaatacaaaaaattagttggatgtagtggtgggcgcctgtagtcccagctactgggaagactgaggcaggagaatggcacaaacccgggaggtggggcttgcagtgagccaagatggcgccactgcacccagcctgggcaacagagcaagactccatctcaaaaaaaaaaaaaaaaaagaaagaaagaaattagtggtgaagccatgctgtaaaggggttagaagaatatgggagtagtttgaagatgtggcaaggtcatgtttgtgaacaatggaattcacagagaagaaattttcttgagctgtgatttagtcagattgggatgctagaataccacagactgggtggcttaaacaacaaaatttatttttcacggttctggaggctggaaagtccaaggtcaaggtgccatcatggctcttcctggtttgcaaatggcgtcttcttgtggtgccctcacatgctggacagacaaagagctctggttccttcatcttctaaggatactaatcccatgacctcatccaaactcaattaccttccaaaggtcttacctccaaataacatcacctcggggataacggtttcaacatataaattttggaggagacacaaacattcagtccatagaaagattttttttgaggtttcaattgtataattcttatgaataagttacaagatgtcaactatttattctcagaataatgtttaactgagtaaattgcaaatctataatgatatagtaaaaaccacattgtctgggattttaccacctggaaagtgctagatatcaacacttctgacatttcccaagaaatatttaatttattcctgaggctgatgccaaaagtcaccaactctatgctgaaacacccactacatagcatcacagaatttcagaactgggcaagtatcccatccaaccaactatccttctacagatggagaaacataggcctcatggagaatagaagatgactgttgaagtcctttctaaccctgaagatatataatctcagaaactagcttgctaaagttcatactattcttttaaataagtgaacaccattctctgatcctgattatgtcattactagtgggcaactattgttttttaattcatctgagtgataaatgtgaaatagtacaagcagactatcgccagttctgaatcagctgagtcctaatttatgaggtataaataaatgtattttgagcttctcctgggaatgagagcctatctataatgtttcaatcctgaaaccaggttttatagaagagagactggcattaatcatcacctaaaatccttccaactcatcattgacaggtgtagttagtgatacccatggcttttacacaatgttgtttaaccaggaccaaatagaattctaggaactgattgtccatgacaggaaatcctacctaaacaaaaggcattctaagctcacacagaaaaatgagcaggcctgaacttgagggaacacaagaatgacaacaattgctacatttaaaccaagtgaggggggtaaagagaaactgctgtcagcatttagggagcccaccatcctggttgaagcagacagggcttgattcctgagagatctgcaatgtgcttccttctttagataaatgtggagagaattctgcattcatatgcaactggaattctgaattctgcattcgtattcaactggaattcagagaattctgaattcatattcgactggaaatatggtggttcctaccgcgatgtgcttttctaaaactcccaaatgggtgttcactaagtaaacatgcatttcaaagagaacttaggtaattcccttagcaagagaaaccagaaattctgactggggctccacaatatgtttatgaaaataatctatgtttccggaaattttgggacaccagcggtaaagaaagaaataagactgagaagtccttgaaaatgacaaactaaaaagaagagagatctggaacaataataaaactgcacatagatgagggaaagtttcaagatcttttaagataccagttaactaattgggaatccctgttctgtaattctctagccacacctcccccaataaaacaaattcatttcagcaagactgaaccatcaatttcttatttatgtaagaggatatagaaaattagggtgtcaatattttaaaatttatgcataatttaaaattatacattttttaaaaggctctgggtggttgtaaaaatttaaattccctctcaaaagatctttttggaaattattaaaaagactatgctctgaaaaaaatgtttgtcaacacctggcatgatttcaaagagtgatcctgcacagaaaagtaccaaccagctgatatccacagaaacacttcactgtcaatcattgaggatgaggatccaccataactgtgaggtattcctgttggtcacttatttacaatttcttcaagcaactgtcatactcaggtcaggttgccataacaagaataccatagactgggtggctgacacaacagaaatttatgtctcacagttttgaaggctggaaatccaagatcaaggtgttgccatatctggtgtgtggtgaggggccccttcctagctggccaatgactgcattctcgctgtgtcttcacgtggtggagagcacagggagtgagaacaaggtcttgtgtctcttcttataggggcactaatcccaaccaggagggcttcacactcatgatcaatttacctcccaaagaccctacttcttaatatcatctcattttaacacatgagttttggggaggcacaaatgttcagtccatagcaaggatatttgtcaacttctcccgtaggccaagaccccagttattcttaaactaccactagaaatacacacacacacacacacacacacacacacacacacgtgtgtgtatctatatatacatattgtatatatatgtgtatatatgtgtgtgtgtgtatacactatatatattgtgtatatatacagtgtacatatatacacacacacattgcttttctaagactactgtcttagtccatttgggctgctataacaaagtatctgaaaccggataatttataagcaacaggaacttatttctcatagtcctggatggtgggaagtccgagatcaaggtgccagcagattcagtgtctgttgagggtatgatctctacttcatagatgtcacctctttctgtattctctgacagagtcccccaaacccttttataagaaaattaatgccattcataagggtagggccttcatgatctactcaccacctaaaggccctacttcttaatattatcatattggggatcaagtttcaacataaattttggagggacataaacatttaaaccatagaaatcactgtctcctaacagacacttaggaatactttccaaaaaacttaaaccaacctagattgtgccaaaattaaccagtcaatgaaataaaaatttgaaaaaatttgcaacactgtgcccaaaatgtttttatctaatttaaggggaaacaatacatttccctttggggaattaaattctgtccaaagtgtgagtaaaacatcaagttttaattcagaaggccaatggtaaggagattctttctccaccttctcttttctcacctctcattctcctaccctccttgcaagcacacacaaaggaaaaaaaatgtggtctacattgcctcatagataaggaaccagaggcacagagaactgaaatgcttcactgtatttcatgcagaaagtgtttgctagaattagaattcacttttcactctacaagaccaaacacgacatagactatatagttcctttattgtcattgaagatttaaaatctataacacaatgcaggtagaatgatgtaaattatgtaaagatactcatatagtataaaggtattataatatagtatgtagacactatgaattccaacctcctaaaaacttagctctcctgaaaacctcagagtaaagaaaagtctattgactatgtaatgagactatctctgataattcttatatatagtattctggattggcaagaagtttatttctttttttatttcatcacattcatttagatttatggaagctggaaagatttcccttctcttatggaaatggaattaattgcagcacttcaataatctcagtgaaacccatttcccctggggaaatgaggaaagagacctagacttaatgtagataaaacaaattgacatgggacgtgaatgggagagaaatgagaaaaccattctagactaaaggtcttacacatttcaggaacgagaagtaatagagggatttttattggcagaacttattgaatctcataatttataatgtttaaagctactggtgaccttttcaaaagcaattaattcggttacatatttattgggagctacatcaagctttcaggagtcatgcacgcataccaaggtctttaaaggaacagaattaagtagataaaaggaggaaatcataaaatgtaacatcctttcccaggtggccacagcttgttcttattctatgcttctattagtaaagaccaaggtcacacaagtcagaccacttagagtcctaacaaggaacagacacccttgcaggttctaattgaactgatttgggctagaaactctgtgaacatcactgaagcctgaattttaacaagcaaaaattcaggagggaaaaactattcagatggtcttctacgggaggcaaaatacaaggaaacttttctacgccaacgaactttgcctagcaacgtgataattcacagagtattatcctgcaggcttcaaagacaacagacaatcagcctaaaagttacacctttgcttttaaatttcttcatataactaggaatactggtgtaacaatgtcaattacagcagggggccatacttcacaagcaggaaaattgtagagagatacaggtatgcgccccagttcctgcccctccctttcccacaatggaaagaccacctttcacttcttcgctcactccccatacttccagttaatagcatcaatttcaaatactactacaactttctcatgttccaaaaaattgacaagcacatgaacatccgttcaattttctctggcaaatatttatcaagcagcaaataatgtggcactatactagccgtg

SEQ ID NO: 319 - DNA, 1115 bp, Homo sapiens
ggaagccaagaatttgctccaaatgtaaacagcgagttattttcagtccactcccccccaccccgggtggcgttgacacatttgacattggcgggaccgggagggggtgggggtgagggtgtgcgtgcgggtatttttaaccttgctcctcacatccctggagtggctggtgccgagtggcagataatggggagggggcgcggaggcgtggggagccctgggtggccgtgcgcgggtgggcgcttggcaaggccgccctgctgttggcaccacgtgtttaacccctcagaggctgcagaggggctgggggaggcggcccagggcccagtggtgccccagaggctcccttgtcaccttctcctggtgtccccccacccccaccccacccaggagggcagggccgggtgcccgaggccggtgccagcctgcgccgcccagacctacaaaatggccgccaaggccggagaaacatctggaacaggggaagggagaggcgagaaaatggccgccagagggatgatgtcatgggcggcgtggcctcccagagcgtccccagcacggggcgagtccctacgcgcaggcctccgagcaggggccctgcggcctccagggacctccagacccgctgcccaggccggacacccacaaagagtgacaccggggtccccaggggtccccagaggcgggcccgagacctgggggagggcgaggccagcactgggcctccagtcccaacagcccgatgctggggacggttccggggcggtggtggccgctgacctgacccgcaggacaccgaggcgtccaccagcgcccgggagggcccggagccaggccatggagccggcgggggccgggtggaaagaaaaaagaaacttttctttgaaagtgattccgaagcaggttggctccggcccaggcggcccggcggcaggggagagggagatggaaagtatgggccagacttaaggaacgcaggaaggacgaggccggggaggcccgggatggaggccagcgtcctggaggtcaccccgtccacgcctctgcctctcgggcccccccaggtcacatccagattttcctccctgtccctggggcgggcggggagtgcggag

SEQ ID NO: 320 - DNA, 1192 bp, Homo sapiens
aaggtgctagaatccatagttcatcaatgcaaaatgtaaaatgggattcacttccacaaagtcaaacacaagaagtaacagcaaaataaacagaaaaactttatgtaacacattcatccaatgaaataactatctaccatgactggtaatggttgtcctacaagatggacgaaaatttcatgaaataacaccaatacgaaaaatttaaataatagtaatgtttctacttttcaattataaatggctatccacataactgaattttcttctaatctgcttcaagacttaaagaattttctttttctttcctgtactaatcattgaacctcagtttctaataaattttggagcatctgggcctttgaactccttgaataaaggtactgttaaaatactaaggttttcctgtttgttggttggtttgactcaagtagttgcatatatttacaggcttaagaatttgatgaagatcacgtggctgtcactagggagctaagacttgggtccacgtctccccttccaccagactctcacttccaccaatgggagttttactatgaacagatgacagttttccttggagctccccagatggacccaaggtccacgattctatcaatcaatttaggctgtaagaatgttggtccaagagagaaatgctgttcctgtaattgtcttttattcatgaaacattagctctcccactctactgcactactgaaaaataaatgaattaagtggtttttaaagcactgccaaaataggtctttgtgaacctggtgatatagtttggatatgtgtaccctccaaatctcatgttgagatatgatcctcaatggtggaagtggagcctggtgggaagtgtttggagcatgggaggtggatcgttcatgaaggcttggtgccctcacggtggtaatgagggatattgagtttacatgagaactgattgtttaaaatagtgcggcacctctcctgtctctctcttgctcccttttgccatctgatacactggctccccttttgccttccaccaaacttcctggggccctcaacagaagcaaatgccagtatcacgcttgctgtactgcctgccagaacaggttgtaggccaaataaacctcttttcttcagactaacatacctggttatgtatcagctagttacatttatgtcagctctatctctttta

SEQ ID NO: 321 - DNA, 1600 bp, Homo sapiens
cttgaaatgatacattaatgtctctggaaggcttccagagtttttccagtagttctctttagtggaatctatttatgccattaattaatgtaatgtataaatgtaatccatttaacctcaccaatctcagttgtcttatttgctaaatgggtttaaatacagtgcctaattcataacttaatggtaaaaattatacaagaatatgcatgtaaagcataacaccattgttatataatataaagtaaattttcagtacattttagctgttgttatacatgtgattgtcatctccaatgacaatatatatcattggagggattcagtttgtaaatatttcatttatggttgttgcaactgcattcatgaaaatgactgaagttaatatttatttcttttgtatgtgtactaaaattttgatattaatgttatcctactctcataaaatcaattaggatgggtcctttttttattccctggaagattttgtgtaggatcggtgttacttcttatgtttggaagaaatcactggggtaaagtcaccttggccaggcatttttttttcatgagaatgttttaaaaaacatatttaacctctaaaagaaatgacaagtcatatttcctatcttttcttgtgttcattttggtagtctgtgtttttctaaaaatttggccatcttttaattaaattttcaaattaattggaataaaatttcttagttatttagtaggctaaaaaaatggtctcccaaaagatagtcatgtcttaatcctggaaattatgaatgtgacctcatatgaccaacaacaacaacaacaaaaagttttgcagatgtgactaaattaaggaacttgagaggggggagattattctgggttcttgagtggaccctaaatgtgatctcagatatgcttgtaagagagaggcagacgaagatttcagagacagaaagaaaagacaggaccacaaaggcagagattgaaatgatacagccataagcccgaccatggggtagctatccaaagctggaagataaacgggacgggctttctcgcagaactttgcgaagcagtgtgatctagctgacaccttaattttgacccagtgactctgattttgttcttctggccagaaattcaagaactgtgagagaataaatttctgttgttttaattcatcaaaaggattatgtggtaatccctattaaaacttgtcctggctgggcgccatggctcatgcctgtaatcccagcactttgggaggctgaggtgggcggatcacctgaggtcaggagttggagaccagcctgaccaacatggcaaaaccctatctctactacaaataaaaaaatttagccctcgtggtggcacatgactgtaattctggttactcaggagaatcgcttgaacctgggaggtggaggttacagtgagcctagatagcaccattgcactccagcctgggcaataagagtgagactccgtctcaaaaacaaacagacaaacaaacaaacaaaaaaacttgtcttaatactgtaagaattttcaactgtatttttgtgtttattacagaagttaatagctaagtttttgaaacattaat

SEQ ID NO: 322 - DNA, 3424 bp, Homo sapiens
acagattagaattggctgctcttaagtaataagtcaccattacccagaaaaaaaaaaactttgaaaagtaaaccagaatattttagcagtaaaattttataggcagtttcaggatgacatttaatactatttgccaaatattctatttcttttttagtacttaaagctctacaactcttcattattatataccagtaactttgattcattcttctttctcaaaaaggaattactatagtttatattgtcttagctgaaatgataaaaatattatctcttaattttaaataaatatccaattttttggaagtattggtaactgaaaaaatcttcctgacaatctggaattcttagaagacattttggtgttttcaggagagcataagaaaatttaaggcagaaatatatattaagttatattttgggaagtttatttggagaactagatgctctatatctgttggatttttgttgttgctgttgttgaaataattttttttaattttcaaatgttacgtatataattttgtccttcttaaattttcattcattcagatgttgtaatactgtattctaccaattttactcctaccttgaaaattaatcctctcatatttgagatgtatgtatgaattattttttctaaaaattctatatttaaactcatttttttactgtgtattctgtatatcatttcaattacgcacttcaacaaatatttgctgatctgatatatattttccaagtcattcttattctatagacagacctacagtgattatctagaatagataatacattatataatattaataatttatagatcattattctatgtagatattatctattcacagataataatctatgctgacagaagtccaaacagtggtcacctttgtggtggctaataggaaggcagcaggagagagactttttacatttctacataaattttatctagaaattggtgttgatttggtaacaatttatcaaattctacccttaacatttgtgtactttatgtaatacatcaatgaatatttacaagttatatgcatataacatatacttacatataacaggtaatacattgtgtacatatatacagtgactatgcataaatataactataagcaaagagagatactcttagaagttatcatacttaactacattgagaccaaaatttgaactttgagagcaatgattcttagtcaacagacatatgctaacttcttccaatatgtctggcctgttgcttggtgctacaggaaacaaaaatgtataagacattgtccctgccttgccaaagacttctaccttattattacgttgtgagctcatttaatacaagttgtgcattattaatttctctatcccagcacctaacagtgtagtgttcaaaaaaggtattcagtaagtatataataaattaactcagtagaaggtgaggagagtgagccaaatgcataaacaaaacatatagatctacacagcacatcattaaccataaaggcacactcgtgagttcctaggaaacagggagaagctatgtttaaaaccttgagacatttgtctacccaatgttagaaaaatacagaccttgctaaaatgaagaaacaggatctactaaaataaaccttacacaggtgggagaaatatcttgcttagatgacaagataagtggagctccctttgtggaagccttcataagggaggttttatcctcttgagctgtttctcagggtttcctgatgggtaaacagccttggactgcctatgggaaactgattcccaaatgtcagacaccagttatgttttctctagtcctcaggaaactgaaaaatatagggagagcatagggcaatttcatattgttaaatgtacttacctaaaataactttttacatatgttactaacctgcacattgtgcacatgtaccctaaaacttaaagtataataataaaaaaagaaaaaaaaaagattatgcaatctttaacatgatattaaaatgccttctctatgccttctctgaaatcatgaaatcaagattctattttcattttattggtctcaattggtcaaaaacaaaatgttgataacaataagtagacctccttcaggtctacttatgagataattatatacatgtatgcacacacagatacattattatgggtgtgtgtgatattgtttggctctatgtccccacccaactcttatctcgaattgtaatcccaataagttaagggaagaacctggtgggaggtgattggatcatgggggcagtttcactcacgctgttttcataatagtgagggaattctcatgggatctgatgatttcaaacgtggcagtttcccctgcactctctttcctttctttctcctgctgccttgtgaagaagttgcctgcttctccctcaacttctgccacgactgtaagtttcctgaggcttcctcaaccatgtggaattgtgagtcaattaaacctcttttctttataaattccactcttgggcagtatctttatagcagtgtataaacggactaataacaatatatataagctggccttttaaaaccaaaatcctagaaatatttacaaaaactaatccaactaaataaggcacttcaatttaagaaaccatacaaaacgtgaactgagctctagcttttcatttatttgtttgtttggtgtttatgccaatgtacctaggaagacaagaatagaatttcctttggaccttgcaggattaggccccaatatgtatttggttccttcccctcaatgttttgttgttgctgctgttttgtctgggtaaatgagcctatgattaagatcaaaggctaactatggggtaacaggtatacaacagtcataaatagtagaaccctgcatacagataaagaaaatatgagtacgacaaagtttgcgtgagtgatgaggaaatgaagacaatgaatgcatatgaactgctggtcaacaggccagtgaggccactagtccattatcttgtatactctaatctcttaatattctatttcttctggagtggtgatatttctctaatttccttagatagactactctaccagtaatacaccttcttctgcaggtttttcacacattttaaatcttccaagttccagagatattttacccaggcatttaaaaaaaacaaagctaagggggtacttgtttttttttaaatgactgatgatatatcctgaatactaatagatggatatgtgaatggctagctaggtaaacagtagatatagatacatagatgtatacatacatacatataaacagactccagcatacaaaaacaacaaaattgcaattaatgttaaattaaatgtacacaaacttatcaatgagtaaagtgaaactcaactaaattcttatataatt

SEQ ID NO: 323 - DNA, 3350 bp, Homo sapiens
ttgaagtagtctgtgtatgtatttccccaaaaaaagtgaaatcaactaatcataagtgcatatatatacatatatatgtacagatgcctacggtaatttcaacaaatgtttatagaaaaaccataaaagaggcataatttattaagaactaataataaaaaagtaaccccatagtaaattaaactctatgcttaatgttaaagttagtctactttcttttgtttcaggaattggacattgttacagcttttctcaaatacagaaatccttaatggtaatcagtaaaattagtaaaaatgaatgcttgaaattacttgagaaaatagctagcttgagattgtctattattaaatacatttcttaaaataacccattagtagtgaggattagactcatttgctaagttagtgatgaaaaatgattcttctttatttgacaataaagccttaggtattgccctttgggttaagagagataagaactactcaatggaagaagctggatcaatccaaaaattatcaggatgctgtgcctgcaatagtactgctacttactagctctcttaaatctgataaggtcacttagcctcaccaaaatttcagtctcttcccttgaaaaactaatatactactattatttattgtcagaaagaaaatatgaggattagaagtcatgttaagaaaaagcatctggcttacccatggttcttaatgaatgatagctcttattatttgagtctcatcctatcaacaagcaaatcaattatttatctaaatttaaaaacataagaaaaatggaatatacataatataacattaaatatggttaccttaagatataatgattaagaataccaaatacttttctgcagtaactatctgaacagaaagtgatggcctaagattttttatgtgttaactttgaatgtaatggaaaaccttgcaatcccttaacatacagatcataggttcattagcaaactaatgttaccctgtggtacagattgttatatttaaatattaaagtatgttgaaatattctttccatttgatttaatttctaattttcaaaaatctttctttaaagcaaatcattaaattagtcaaagtatgtggaatagtatgaccatatatagccttgacgtatgaggttgtcataagtaatgttatactcaacacagtaacacaactttgtctggaattagaaagaaaaagagaacaaaactaaaattaaaataaatctccacatggatacaataagacataaaggaaggttattcttaatagcattttccaacatctttttgtacttttggctgcaaagtagagtaacaatagacataaaactaaactgcaaatggcttgttattgttcctttgaaatgcaatgtattgtgaacaatatttgtttgggatattttcatttatttggtggaaaatggtcataaaagcaaaggttttttttctttgaggagcataaattgttacattactttaaatacttcttactcaatatagcacaatgctttgtattaaccttttaatattacatgtaaatccagtattttatttgaacatcatttatttgtacaagtaactatttttatataaattttttttcaactcaaggtttttaatgtgtttttttttccctattccaaatttggtagacgtctaaatcatcttttaggaatgtaaaaagctaggcattttaaaaacagaaaattctaggcagtttacctttcaacaatctaaaccaaatcactcagattatccataaaattgtccagaaccaatacaaggaaaaaagcaacattttgacctatgtatcagaaatcaaatcaattatcagacctgtaagtaaaccaaaagaggatccatgcaggcagagataaatcctaaatctcagggtactttgacagtcacatagtaaaagtgattggaaaaggttatcttgaacaaaggttcttttcaagcacataaatcatacaaataattatctctctgaggtgacaggggcctaggaagtgaactactttaggagtagcctccagagatcctcaaccatgtttatgagccgcacagtcatctctataaaagacaagctccagttgagtaaaccatgttaagtactacattccaaagaagaaaaactgtgaatagaaaagttaacataatgcaccattgatatggaataaacacttaatgtctagtttttttatcaataaagtgagtgggatcagtttttcttatttattcactgaagcacattcttataaaagacaaacagcaagcacagcatatttattgcatggtagctctcttatacagtgttgttgatgtttgtttcatttttttgctcatccatgtaacctacacatgttacaaccagcatgctaggtacatgggatataataagattgagtcccttcacaaatcttatacattaaaaaagaattgagaaaaataaatggaaatgaaagttgcttcacattgtgattaatattctagaggggtagtatacttggtttcatcgtggagtgcttcctgcatttaaactcagtccaaggatgagtaggaaattgccaggaaaggtgagtaaggagccaatgttgaaagagaagaatataaatgtggaagttcagggaagagaatgataaattgaagatgcctaataaatccagagtggcacagatgaagaggacaagggcaggtagaagaggtagaaaaccaaggggctataacaaatggcattgtatgctagaataatgagtttgtgcttcagaacaaaggaaagttgttaaaatgttgtaaaaaaaaaaaaaaagactgacactatgaaagttgcatattggaaagaacacactggtggcagtatagaaaacaaatggaaagataggcgggacaggaagaccagaggaaaaacagatgaattaggaggctttcttgtatttgtggtgaactatgataggggctcaaatcaggctgctgtcaacgggaatgaaattatgtgaatgaattggagatatagtttaaagggtagaattagcaggacttaataattaattgttaactctttttgaattggggtatgttcttttgaccattattctttcttctcttagctctgcctatgttctggaggggtcatatttaaatactgactcatctgtaaatttcaagtcagtagttctctttattgcacattttcaaagtggttgttatctactatccacttccttttataattaaaaaaagattatctacatcaaatataaggtaccagaaatagccaattgcaaaccaaaatgggagcagtccagagataggtggctagtaagagctaaactag

SEQ ID NO: 324 - DNA, 3332 bp, Homo sapiens
tgtcaaaatgccagaccattatcttaatagagagaattttgcaggaatctaaagccttcgaaagctaccatgcatcttggtttgattatggcattataacaagtaagtttttcgtttaaaataattatcttgtttaacagacagtgacatggaatttttacttatattttctacaaatctgttaacaagaaaagtaaactttctggtcctggaggggagaaaataaaacagataataatacttcaaccagtatagtagagcaagggttagggaaaaacacagttgccacagtacaacatatatagaatatgattaattcactaaacaaggaaataaaataaaagcaactgatataaataatttttattctgctctgactgtctggttcagaatcttctcaatcacttatatattagtttatactgcgtaaaaattaaagaagtgtatgtacagaaattttgtagtgatccaataacaagcttatatctgcaaataaatacagttaaatggaaactcaataatatggaccaaaagaataacttcaactagtaaatattaactaacttaacaataagatggtttggtgaagcctaattacatcaattcaagggaagacgataggcatcaagattttattaaaataaaatttaaaagaattactttataggaatacataatataaaaaaaggaataaaaacttaaagattggactacctcaagtgttgagttctacagcatattaatgctcttaaactatatcaatgtatattattatgtgaatgttataaggattaatcacaaaatgttcttgtaaactatccattataagatacattagctcagatcaatatttcttggaaatagaagatatattctaatgtatattaattagaaattactgatgttactagctgagaaatattgaataaaatattttctcggctagagaaatattcctctagctgagaaatattgaataaaagcagaaataaggatgatatttgttatttatatatgatagttataatttcagcagttcacataatttaaaaagagaaaattttattagtttattcatctaataagtaaccatttaagttaccatataaccagatttaattataaaactaatatcacatttgtacaaaatacctaatattatagtggaataacaaacgaaaattgaagaaatagtaagaatgtatgtcatgtctacacagatttcatagtattcatttgcgtaaagaaaaaagtgaactgtgtgtaccctatcaaaaatcttgacaacattctgactttggaaattagaaaaatgcatccataccccacagagcaagcatcacctgttctactgcaggaaaagacaccataaaatataaaacaaaatatctgcaaccaacatgaaacacattgctggtgtgtagaggtctgcccatatactgtaactttagctgtaaatatctatgacagaagaattttcacttttagcatgtgtatatcaattttctctaaaggtggtttcaatttaatcagcacaaaatcaaaaatgagagccagatttcacatgtcagcatgggtgagcaagaaaaatagatgtaaaaagattttgaaaattgttagactaaagatgttcatagagtccatttcaatctcacgatctcacaggatccctgtggtgagtggaaatggcaacagacaggagcaatcacctatttactgatttactagaaaaatatatggtcatcttcagtggtctcagtagttacaataaatgggcaatgttcaattatttttgtattaatgtcatcagaccatagacacaatttcctatagtattttcttaatgtttacttacaaacccatcaaataaatattataatgcccaacgtcttctcaccaacaaatttaaaaaatgccaaaatatctctgataccgggcagacatgcagataagtggaaacttaattattggaaagagtctgaaggtttaatctatgattataaaattaaaataaaaaatattgttctatatgattatgtcattatacccaataatgtcttaggctatggatttaaaatgaatatggtgtgataattggatgaatgttatatatacacataagaaatgccactcaagacacacagatgtgaatatctttgcgagaatatcctcgttttcatcataattcttatgttgagtttcattttattataaacttccatgtattctaagtatgagattttgaaaaatggatgaaaatatatatcctacctactaatatagttggttggctagcaccattcctaatagaaatcagctgcaaacagctttcggcacaccaaagttttccttaggtagaagaaaggttaaactctaagtcataaggtttacaactttttagaaagttgccagaaattcccagtgatttggccaatactcttctgtttagtgaacttagtttactgatgatagggtttctatatcagtatgtttaaattcatgacctattttgataatggtggcatgtatgtataatgatttttctaataaaatggtaacctgctagattacctgctagatttctaataaaatggtaacctgctagaaggaaattgtattttgttccagaatgctacatactgcaaatgtttcaatttttttttaaattttaacaaattaaaatttgttttggatataaattatcaactcatagtaagactttttcatggggaaacttttggaagaaggcgatgatttctcaaaagcttattttatctaatatgttacatgtaagatcttatatgttacatgtgtatacatatcacacatgcacctacatatatggtaagacaaggggtagaacattatagtttactatggtgatgaaccccatggcatttccctgccttgttatctttgcttgtgtttcttctacctttcttgtgactccgacttatctgaaaacaagtgacaaccaacctaaggttctggttcctgtaatgattttggaccaagaatgaagccttcctaaactgggtatttttaagtctctctctctctagaatgtggttatgggctaaattctgcttgtctaggtctctattatttccttagaataatactatgtgaaatttggagttagcctgctatgtaatgctataatctttcactatgtccatggataggcaaagagctgacggtctgtaataaaaaagcatcttaaataagaaagtaaatttcaaagatggtgcaatggaatctcagtaactttcaatgactgcacaagttcatccagctaggaattaaggctaggaagagaaagctggtatttt

SEQ ID NO: 325 - DNA, 13289 bp, Homo sapiens
aacaatttgtgactggaatgatttaaagccaatacacatgttatgtaatcttctgccctgttataaaatccaacacaattgcttaggactagcgagagacacccagagagcaaaagaaaatctagaaaagtggcaaaatgatccattttaatcccactgaccagcatgagaaaggaaaaaagaaaccagaataatgcatttttaaaaaaattttagaaatctattggagaagaaacctcagaaagactttagaaaaggcgtcaacagcttcagagatacaagactgctgaggctcaaacagtactacggcttgatttcataaggacaagattgaccctacccagaacagccagaatgagaaatggggagtgtggctttatcaggcacacagcaaggtcccgcaagcctgcctggcaggcccctacctactgctttgggtttaaatatcctcaaatcgccctgcaaaatacaaacaggtcgactgcaggaggcacagagacaaactttcacgtgagcttggattggactaacacctcattagcaaagagctgcctcactcagggtaggttcaggagggggaaagagagcctgatgcctgagcaggtgagtgcttccaggtggctcctgggctaagtggaaaaggggagggacaggagggtaaatatggggaaagcctctgaacaaagtacaaagaagggaacagaaggaactaagacagcagttaccctttcacattttgtcagaggatcactctgtgaatataacagtaacaatcttaatttcaaactacatgcaatatagaccatttataaagtttttttttttattgttgttaccctgaatatctctaggatttttctgtggattcccagagtgtttcagctgaattctctagctccccacctcctctgagcacttgctggcatatttccaagctcctctggcatctctcaattcctcaggaagatacctattagccccttcatcttccttttccattttgaataagacagtccaatcttgacaattattaactataactcatcaaatatgttcctctaaaaagacatatttagggaagcactgacaaagacactaacagacaagctgcttcatgctggttcccattaaaatatttaaatatgttttcaggaaagaaaacttttaagttatttttccaaaacagctataacactgatttcaaacctgacaaaaataaccagaaagaaaagtcagatcactctaatttataaataataatgtaaaaatatgaactcaaacatgagcagacagaatccaccagtgcaataatagaataagataccaccaccaaatagagcttattaaagggataccaggatcattcaagaacagaacttttacctctgtcattcataatatcaatacattatagcagaaagatcctataatcatcttcacgggtgctaaaaaagcattcgacaaaatcaaaatccattctgatttaataggcccttaataaaatagaaatccatgaatattttttgatatgggaaagagagatatagatacacatgcatcagctcaaaagcctaaatcatactaaatgataccctaagaggcattcctattaagacaagaatggtcattgccaataccctataattttacactttctaattagtactagtgcaatgaggagaaagtcatgaataataaaaattagaaagagacaaaattattatttttgcagattatacatatatgtacctagaacgccaaagaggatcaactgaaaatggatggatacattaggagagaaggcagatgcttataaagctagtacacataaatagcttatataaacaaaagccaattaaatatacagaagaaaggtatcatttttaagagcaaaatgggcatatatttaaaaaaataaatttagaaaagtatagaattcacaagaaaaaaattttaaatcctacagagagatgtaaaagctggcaaaataatggaaagacagactttgtacttagatggaaagactcattgtaaagatgtattctcccctaaatttaatgtgaatccaataaaaatgtcaataagagtattttgaaacttggaatgttaattctaaattgcacctgagaaattaacctgtgagcattgccagtaaaattctgaaatataaggttattaactctattggctattaagacatacagtaaagctaaggaattagaacagtttgttattagcaaaccaacaatcttctgagggaaaaaatagttcagaaataaacataatgcacatagaaacatttgttatataataaagttgacatttcagatgtgggaaaatggtggattgtctaataaatatgttggtacaactggccagttagtagggagaaaataatgctggttccactctcacttcttacataaaaataaatctcaggtggctcaaatatttaaatgtaaaaaataaagatcttagcggaaacaaaggaacattagaaaaacaataatcttagcataagggaggctctattaggcaaggaacaaaaaccaaatgctatcaatcaaaagagaaagaaaaaaatgataaatttacattgcattcgaaatttctgaaaggcaaagaaaaccacaacaaagtgaaaagcaaatgacaaagaggcaaaagtatctgcaactaatatgttagataaaaggctaatttctcctaaacagaatcccttcaagtctctaaggaaagaacaagaaccttgtgtaaaaatgggtagggttattgtcctctactgggctccctgggaagcagatttaggaggtggagagtcatgtgcaggtttattggggagtattctcaggatcaacacccacagaggaaggaaaggagccaggactgttcagagacgttaggcagtgatgaaatcacaacagagacctcagctgattccacgggcagctcgagctgcgatggccattcagagttgtcccaaactggtaaaaaaggagctgagccttttagtttttggatgtagggtattccgaggaaaggggcgtgacttggccaggggagtgtgttcagcgaaggctgagttccttctgctacccacatgcacagcaactgaggactgagaacttgggtcctacagagggatctgggaagctcagcacagctgccatgactgttagtaggaggcagtccatagaaacagaaaagcaaataatggctagtccatatacaaaaagatgctcactccattcataacaaaatgtaaatcaaaacaagtatcatctctcttatcagataagcaaagataacatggttggcaacagagttgttaatactgatattcttaatgctgttgagtggaatatgaaactctaggatctcttggaggaaaatttggcagatctttctaaatttgaaatacaccctttgacccagcaccacatttctaggaattgtttctatagacagagtcacatgtatatccaaagtatgcactaaagttattaacattggctactttgggggagtatgtctggaagtgaaagaaggataggaaactataagtttcgctgtatatccttttacagtatattgaattttttattctgtatgtgttatttttaaaaatattaatggtcaaaaaggaaatctgaacaggaatttgagatacctatctataaagatatcttgatggtatacgcctctatctaaaagaagcctttttttgtttccatactactatatctaaaatatcttctagattatcttacactcaatgtcataaacttacttctctatacaggatatctgtacaaagattttaaaaatctagatgtatttatcttatgcatagcaaactacaccaattcaactcaaatcctggcagttgttaacacttttggaaagggaactgagctactgatatactactgtgtgcctactatactaataggcactttaatacattatctaatgtaatcccaacaatcctgcaagttacgtcttatcattcccaatttacagatatggacacagaatgcacacaggttaagtatccagtgctctgtcatacaactgaatgtgggggagtccaggctacatctagatgtgtacttccttcgataacatgctcctacctcccagggtattttccttttggcttccaaaacattttgtaagcaaccactggtaacctcaaataagtggtatgatttccattataaagaagaaaagactgagaaagagtaacagagaaatgtctttctctagctcagaaagctacaatttcacatagtcctaaaatgcctgtcttcatctttctgttatctccttttgaatacacttcaatccactcataacccttttcctaaaagagaattcaaaagactgaggtggaatctctgcctcagtcttcctctttgaattgccatcagaaaaacgatcaggggaaatatgttcagccaagagaagggggcagtatcccagcaccatcattttccttttaaacactaaactccaggctatatactggaaacctatcttagggcccattatatgaatcccacagaaagagacccacaaaatttggagacaaaaaagcaatagggagacaaagtgaaggatgcttctctcaaacatcaggacaatttacttaactaatgagttatgagatagcaggtagcttgagtttcccaatatccaacggaattgtttcccaaatgaaaacaaccaatgccaccaaaaattagacttgagccaatggcagaaatcctttttacaatattttaatcgtaagtaatcagaatgcatgatgggttggtttaaaaatatgtcgaggatttttcccctagatagtgttgctgttatccaaaggaaagatgctattgcttctgctccactgacactgtttatcacttcgcccagacccttcaatagaaattgctgtttctcactgccgaccatctgttgtcatctacatgaaaaatctacataaatccctactagttgctgtatttcagaagtgccccccaccaaagaaaatcacagattaattgttgctgctttaaaactctaagaaagggaaatgaatctaaatataccttcctccccccaacacacatacacatacacacacacacacacacacacacgcacacacagcaactttcatctataatttagaaaatggatgcagttcagcaacagttaaagactaatttcttatgctttttgtgcatttacataattgattcactagataatgcactctgcttccttatttaataaacatgttaatgatttcagacaattactcaaagctgcctacaagtgtctgcctaagaaaagcaacaaaaaataattaaaatgaaaatacacaccaaaaggcacatccttcatatcacattacacaagatattaagtcaatatgtcaccctgtcaccagtcacttgctacctgctgttatacatttattcaaattctaatgtattagctgaggctgatacattggttagacacccaagcgggcagacacacagagctagaaaataaacctggtgctttgtcagggtagaggcagtaaaatagcagcagcaaaggaggggagacaataaaacacgggacagaaacagaaggttgaagcagacgctttcacaagaaaaccctcttcaggctattcatggtggggggcagtcacgggggaactaaatggattccatttcctctgccacctctgagtgcttggagagcaccaagcgggccagacatcacaataggttagattttggcagatgcctcatgcattctggccattttcgggcttattttattccccagaacctttgcatgcgtcaaccactagtcatgccttgaaccacacagcaccgtggtcgtttccaccacccaagagaaccgtaaaggtggaaaggggcattaaaggagctcagatgccagacagccacgactttggccctctgtggtgcctggccagtcccactaggcttggctcttccagttcctgctggaagccatgttgcctgggcaccgtgaggctcaccctccctccccagccctccaggaagagagaggtgggtaacccaacaggtgcaataggactctgaagaaggaatatgagagcttccagcccttgctagaagctagctgattctggctggggaagtcctggttccaaacctcatagaagataggttggaagcaggaaaaaaagatgaaattatttgaggagaaagttagctgtccatcagtaacttcttccgctagaaaaggagtgtaggaagaagagtaagtaaacaagaggcttgcttgaccaggtgacactcttcacatttctaagcccaagtgtcctagctggagttaacccatgacttcagtcctaaaagaaaggttgatggtcagtaggcacgtgcgcacacgcgtgtgtgtgtgtgtgtgtgtgtgtgtgtgaaatctttaggtttttttacctgcctccttcactgtataagcccaacctgttcactgtgtatcatgcagaggaaacaggcagaaacttggcagggcaggaacaaggatagttcatccagaattaccttaagaaataggcattttatcaggaaggttatggagagccactaggggacttgaaacaaagggtgacagaaactgttttgcttccagaaggatcattctggcagtaaggtggaaaatggcatgaagggaacaaagagaccaatgaggaggctgtcacatcaatccatcgatgccgaaggcgtgagccaagggactggcagtggaatctgagtgacatcagcggcaacatggggctaaaagaggagccactgaagttttgaggatcaggccacagcagtgatgtggaaggagatgctggtctcagagtggaagggaaacaggaagtgggcaggaggtaggtgggtatcagggtggaagaggaggtatggtccttaacacagctttgtttcagttggatgctggcattcaggtgcctaaggtacatccaaatgaagtattcagaagatggtgccggaattctgcctgtagtttcactctcccacatattaaatggtccactagactacaaaggcagcaaaagggatcttttacccgggttatggcatcaccccgctcaccatcagaaagactctctctagtctctggaaacaacaaggcatgaaacagtagatccactcctatcaagtagcaataaaatacctaatcaataaattaatttaaaccacccctcccttgaaaaataaagaacaacataaatagaatgggaaggaattgcttaatgacattaattgcactcctgcaatttcatggccaattcattcatgttagaaagtggagcagataattctctaaccaaatgtccaatattattatgaaattcttataaatctactcagcagttaatttaaaattagattagaatgggatcatgaagcctgactaggccgaggggaaaggtaacctaggtgaccttttacagaggcaaaaatctacccaggtatgaaagttgattaaccaaagggagtgcacacaccctgcctaaaaagcgtgtggactgcagaagggaggggcagctgcatctacggatagacccatgatgggggctccctctgcagctctgttggggcttcacatcagacaatgtgctcggtcttcttgatgatgccttctacaaatgaacaaaagctacattccaggattccaaatgctgaggtgtggcttacgtaatcaaatgtgagccaggtgttagagacttcatccattcagctgactctgttcctgtgctatctcctacagaaaaggcagcctcctcgccagcttccaccagaaatccaacaatcccagacctattgtgattgttcgtgttactgaaggtctgcagagccatggcgggggagttcccatcagagagtctctttccatgtctctgtgcctagcagctccatctctggtctttcttgtctctcttcatctacagagaaacctcatcttgaaatctggatacccaaggacttcactctatcctacaacgaactcatcagacaagtttctcatcaaaagaaccccaccaccactactagaaaagaagttacttcagcggttaagaagacactattctctctaaatcatttccttcttatttatttatttattgcctttcctatctccctccagaaaggatctgaagaaacttacagcaaaggagtgatgtgccataattcagctatgaggaagggagggagaaaataccctgaccccatgatgattagaactgttgagattccatatgaactccagccaggagctccaggtagccacaacagaacggaaagcactattctggaatagctatttatttcatattgtcataatgataaaacatcctgataccccagaggagaaaacttcagggcagctttcaaagcatcaacttggaaggccaaattattggataagaagtcccattttgtctcattcatagccatgtgacttcagacagttttccattttctttattattgacttaaggaaagaacagatatcggactgggagtcaagaattactggtgtgatgatgaactctgagtccaatggcaaacagcttcacctttccagtgaaacaggaggcaagaaccaaacacagagctttccatctccaatgtcatatggtttttaagataagtatcattggttttcaaagagtactacacatggttaaactcctttctatgtggagagacaggactaacaccccttataaattaactcccaagcttatatagtatcttcaacagcctgtggttctgtgtaacaataagccacacatgacaaggggtgttccaccatatttcttagaagtagaagaaatacacaatcagaaaaccatacgcgaagcatttattggcctccttcagttaatcctctttgggcttataaagctctacatcaattgccattctttaaaatacagtgtacagtttaaaaataagcactgtagagccatcatttgcacacacatgaacattcacaaataatatgtacatacaaacagacagtctcatacatttggtctatatttaatgaccttgttcagccctccctatgctaacactagtatgtataacaatcttaatttaaacccatactcaaaagataacattcctaatgaaacacaatttcaaattggagttaaatctgtctcctagaccaaaatatacaaaaaggctcttgcttatatttttaaacttcatgtgacttatttaaagattcaaggttttcgctgaaatgaggcatagatgactaaactcatttcggctaagtagtaactcaggcagaattctacctgtggatttggattaatactcctcatcaaaacatatggaaagcagtttgaccaggggaaactatacttttctcttgttctgtttaaggcaatggtctgaaaaaaaaatgtgctgggaggaaaattgccatttctctacttatcagtgggcatttgtaatcattacattgtgtcagctgccctttggtgctttcattttttaaattaatttaaatagaactatgcatatctgcagagcttttaaattattagaaggcaaagacttaccttaccaagaaagagaatacaggtattggaacttcatggattacctgacgcaagatagcaagtaagttgcacacatgctgtaattcctacccatcatccagagcagacatcaccaatagatcatgaatagcactcttttactctatgcccaatgtagccttagatttcttttcattgctaccaattgatagtacatgagatgaaagctttttgtattctgtgatgtcatccaagcctgatgttatgagaaagacaccaaacaaactccaagttgggtaagatacacagtagttaggcaatagagccaggcctacaccctgaactctaagctctaaatacagtgctcttccactagacattaagcgcaatgttgtacacttaatatgtaatcctaaataggctgagtgaatagatgaaactttcccctttgttcttcagtaccttctccttttcttttggaaagatatgtctagaacaaagctcctaatcattattaagtcataatttttgggtaccaaatgaagcttactaggcaaataagaaatactgcaactcatccatctgttcaaaatactggagtgtcccattataaatcatctcatgatatcaatctaaatatcctgcatgttaaatcccacaggataagaactgcacacctctgattttgctactattgatctgtgacaccttgaactgaatattcccttctctggccaccattgtctttacctgtaaaacgaaaagtttcaaagatctgacctctaatatactttttgaatacgaagcttatcaagcatgtactttaaattcagcagctatttattaaatgtctcctggaagcagagcactatgacaaatgcaaggcaaagccaatggaaaaaaaacctaaattctggattctgccctccctctagttcctgcattcactattagcacatggtttgtcttgccactcgccaggcccatatcacaaagagggcccactgtgctctagagttgtggaaaatcgttgttcccctttctccatgaagctgtcagtcagagtagtttgggaaaaattccagtgcgatttcattctccgcagctcaatagcttctctatatgcaaactaaaaacaaaaaacaaacaaatacaaattccaccaaatatcctggtggagaatcataaacccggaaaggcagtggcaggaaagcaaatgttataaacacatattttaaatgaacgtttttctgaagtcaacacctaaaactcacattctcttaaagcttccccaactcctaaactggagaaatagttgagttcctgcccagctatcaatgaaaagaagctactagaaggaagtggaataagcaagcagtcccgaggaatatgaaaaaacatgcccattcactgtgaggaaaagagtcattacagatctaatagatgtttccttccaaatcaaacatgtttatgagcaaaagtaatatttatagttaaatatcatatatttatatttaaatgttacataatcatatatattataaaatattatatgtaaatattatattgttaaatatagttcaaatctagaaaaaatattctattgtgtttcacttattcattcaacaaatatgtactaaatccttttgtgtgctaagtaccattctaggtgccggggcatttagtgaacaagagatctttctgcccttatagagctcacatttatataaaaatgaagcctggaaagcaactttttaggacatctctctaagcatccatccatccacagactcaaagatatttattaggtaactacatcatgccaggctttaggttaagctgggagaaaatcaagaacctaagatgcaagcacttgtagataaataagcaactccctacagaataatgcaggtctggacaaagcactgtggacaggctgctactcctttaaatgtagctcactgaagagctactttcatggaggtacggacaaagcattgtggacagaggggtgatcaatgttcttcacattttagaggaagacaagtcacaattgaactggcctttgaagggtgggtaggtgtgtaccaggtcaactaagggggaaaaggtgtcctgattgataatcctatcagaaaaaaagtcacgagagtacacagagggttggacatccacaagaagccctggagcctgcagcactaggtagggattggaaggagaggattccggaaaggcaggttggagccccaaggagctggtctcaatgtcatgtccaggagttcgcccttaacctgcaggaatggcaagatgaacccatttttagtaaatatctggttcaattaaggctacaccatgtatacctaagtggggtgggatggtttatccctcaatgttttgattctcctccaactccaaaaccagtgagggaaattttactaattattactaagaaaggacatgggagtgtgaatggcacaggctggacagagcccaacacattcagagagagagaattttcttcctttcaacagctgcatccagtgagcagctgctaacccactcatagtgccagagagactcagtgggtctgatggctgttaacgggctttattaccttgttgagtacctcaaactccagttactaattacagggcatcgacttgaatgtttggctatataatttttgttaattgatttgcatgaggggatttgggcatgatcagctgtaaatgttcttccggctctaaaactccatgactcttctctattgctacatgcatcaataatgaccttgtgtattttggattgtgggtttcatgcacaattgctaagaacccttcaattgctaagaaccctcaggagcaaagttgttatgcaagggcacacaatgacatggaggcccaggccggaacaggacgcagccattatcattcatgctagctagcatttattgatctcctatcaagaaacagatttggtaaggccaagccacttctagccatttagacaccttgcctgcagtgggctcacacagcttatagacacgaagcaggtggttctgcttgattagtgaatctcaaacccttatatcctgcacttcctagccaaatcctttctatatttctccttcactttccaataccaggtctttaactcaccccttttctcatgcccagttcaccctttaacctccccaaatccacatctcattttgaaggcattcctccccaccaacaacattactctttggggtctttgactgacattctttttcttggcatttcctatttgtgggatgaaaaggggtacaaaagtaaaggccaagataggaaggacccacaggtaggctgattcaatatttacataccagacttccctgagaccatcagcgaactgctggtagaccaagcagttcacactaactctcagagccataagcctttctaatgccctggctttcaaggtgaaaaatacaattactaagaactgtgagccacagcactccattaccaactgagcttccgggcaagagatccttggaaaaatctctgtagtggaaacaagtgattctcagtcacagacaggtcacagatctacgtgacctgtcatccagatgggtcatgagccatttgttgctaagagtagtacaaattttaaagtttcaaaataatta

SEQ ID NO: 326 - DNA, 716 bp, Homo sapiens
aacaatttgtgactggaatgatttaaagccaatacacatgttatgtaatcttctgccctgttataaaatccaacacaattgcttaggactagcgagagacacccagagagcaaaagaaaatctagaaaagtggcaaaatgatccattttaatcccactgaccagcatgagaaaggaaaaaagaaaccagaataatgcatttttaaaaaaattttagaaatctattggagaagaaacctcagaaagactttagaaaaggcgtcaacagcttcagagatacaagactgctgaggctcaaacagtactacggcttgatttcataaggacaagattgaccctacccagaacagccagaatgagaaatggggagtgtggctttatcaggcacacagcaaggtcccgcaagcctgcctggcaggcccctacctactgctttgggtttaaatatcctcaaatcgccctgcaaaatacaaacaggtcgactgcaggaggcacagagacaaactttcacgtgagcttggattggactaacacctcattagcaaagagctgcctcactcagggtaggttcaggagggggaaagagagcctgatgcctgagcaggtgagtgcttccaggtggctcctgggctaagtggaaaaggggagggacaggagggtaaatatggggaaagcctctgaacaaagtacaaagaagggaacagaaggaactaagac

SEQ ID NO: 327 - DNA, 1189 bp, Homo sapiens
agaagccaatttacaatgaaacacttcccttagatttgatgaacagtgatatggtgtcagaaccaggaaaattcttatgataattgggtgcattttcctctgcactgttaacatgatggaaaacacagtttaaatattaaatattcctttgtttattatataatgtgatttcagaaatttgtccatttttgtggctgtgattattttccaaagagattaggtgtagttagataattgatttaagtggtatattagcattagaccttggtcctgttttagttaattggtggtattcgtatttttatcataggacagtgtttgtgaaactgaagcttcttgattcttgtatcaggatatggtgagctacttgaggtcaagaaggaagatcttctagcagaatgcctgagtgtgtaatcttgctaagatttagaaagttcctgccctgttcttctttttattaaaattgttttcttctgtacttaatttttctgtttgaatggaaaccttaagttatttaaggaaggctacagtatggaaatcttgagtaattatatacatatatatatatttagagatagggtctcactctgttgcccaggctgaagtgcagtggcacagtcgttgctcattgcagccccaaactcctgagctcaagcgatactcctgcctcagcttttcaagtagctaggactacaggtatactctaccacatgtggctaattattttctgtagagaagaggtcttggtaagttgcctaggctggtctcaaactcctggcctcaagtgatcctcctgccttggccacccaaagtgctgggattttaggtgtgagctacagtgcttggcctgcataattttataacttatatattcaccattttacacattcagagaaaggagttgtaacaagacactttataatatagactaagtcattttattgacagtgtcatgaaagcctcttgagcacttaaatgtggctagtctgaattgagatgtactataaaaatggaagatagtcttgagttatgaaataattttttttgtttgaattcaaaatgcatttttctactgaaattatgttgtgcatggtaggtaggttttctggcctaccctctaaaatctaatgcataaatagagaaattatccttaagaattgatgtatgtttatggggaatgtttttcttt

SEQ ID NO: 328 - DNA, 2469 bp, Homo sapiens
tagagacaatagatatgcttgtatttccaccaattcccctgtttaagatatcctttgggagccataattaatctgtagcatttaacaagtgttagctttaactacattggaagaaaatttgttatagattacatgcatgggctttggggaaaaatgtttctctttattccaataattttaatatagaacttcattaagcacacaaatcagtgggaacatttgcttataaaaataacataaaccaaactaactttgcattttaaaaatcctcttgttcagttttgtgagctctgcagtcacatttctgatgtatatgctaatggtgtgttttctcacacgttatgtaaaagcaacctattatcttcatttcagattcagattcctgagtcaagcccctattatgacctcagtatggtattttttttactgactcgtttaatcagagcatgaactttgtgaaataatactgttttcccagttttatacataaggaaacaggcttagagtggttcgtgacttgctgaatattatgtagtcagtcagtagaggggctgacccctcgatattttctatttcctgcttttgaatggtgatcaaattagcttggtttgaaaatacgtacccaaaagggaactctattttcctctcaattctgcttttccctcttcccctccacctctctctctctgaaatggcaatgtcattcatttaactttgttttccatttttcacctctacatccaatcaggtccttaaaattcttcctttctttcttttcattactgtggaatcagctatttgctatcctccctgccatttccttgttcagattctcaccctctttctcctgaagaacatcaacagccaacttacttatcatcctgcctacatcctttcttcctcttagtaaaggctcttctgttcttcactaaaagacagatcaaaatgtcttaaacacaaattttattttggtacttccctatttacaatcatcaattggctcccctgtgctcttataacttccaaacattttaatagaatctcaaagctgatattatgcgtcttttttcttgggcctttagcttcattccttgtcactttccacctacaattctctttgacattctttgctctagagataatacatttctttaattcctagatggctgaacattgtcacttgcctttggttctttgaatattttatccctcctccctgaagcacttacaatgtgttctttttaaaaattgtgaaataaaacacacatacacacatacacacatgtgttaaaaagatttaaacacaatgtactatataatgagtaattacaaagtgaacccctgtgtatcctctactgccaagaaataaaatgtcatcaacattccagattcctccaattctcttttatattacattcttcttatcccctttcttccactccaaggacttattcaggctttgtggtgatcatttccttgcttttctttatcatttcaccaattgcacatgcattcccaagcaatacagttcaattcttcctctttttgaaataaataaccacactctgtgttttccttttttcactcataataatgtttgtaatgtttatacatgttttagagtgtatctctagtttcgttttcattattgcattgtattacattgtatgaacatagcctttaaaaaaatccattctcctctcgatgggcattttagctatttcccatttttagctattagaaataatgtcttcaggatcattcttgcatacatgtctcttggatgatgggtatccccataactctagaatatgtatattcaggagtaaaggagagatacatattttcaccttcactagataatctctacagctttctggaatatcactttacacccccacaattagtgtatgaaagttatctttgttctacccgtttccttcacctaatgtttatagacttacattttagccaatccggtggttgttcagtaacatctcattatggcttcaatttgtattcccctgattattgtattgaccattaaaaatctttgtttctgaagtgcctgttcaagtttcttgcccatgtttccattggtttatatgtattttcataatagaagagtttttaaatattttctgcatgctaattccttgtcagttgtatatggtgctcatttggtacctggtctttttactcttcttatgggttaaagcataaactttgatgcaaaattgtctgattcaaataatggctctatctcccttaacaatttgaactttggtaagtcattaaacttctccatgcctcttctgtaaaaatgagaatagtagtagtcctacctcacatggttgttgcttaacctatataaagcagtaaaaagagtgcctgaaacctaggaagtattatgtaaataaacatttgctgttctttatttttattttttgatcatgatttcttaattat

SEQ ID NO: 329 - DNA, 1322 bp, Homo sapiens
aatatagtcaactttttaaactttagtaacttttagtgttttattaagaacaaaaaggttctaaagttattaagatattctttgtattattttccaagcttactgctttgctttttaagtctacaatccaactggtgttaagtggttgcagcagaagtaaacttttattttttcttatatagataaaccattgtcccacaaccatttatggaaaagtttattttttttccactggtctgcagtgctacctttgccatataatgtacatttatttgtgggtctattttttaattggcctagttactcagtaccaatatcacattctcttaattactgcacatttattattgatatatgttgaagtagttcctgccactttgctctgcttcttcaagagtatcttcataattctttggttctttatttttaactttaagaatttttccatttaactttatgaatcagcatgtcaatttccacaataaaattggaatttcgactacaattttattgagactatagatcaatttgtgaagaattcacattttaagaattatgaaccttccaatctctgaatattgatacatattcctttatttgtgtctttaatgtttctcagtaaacaatatcatgttctcaattacatattcctttatttgtgtcttctttactgtttctcagtaaacaatatgttctcaatagacgtgtttgaaatattactagcacttggtatttttaaatactattgtgagttatagttttttttaatagttttctttcttacttttgtacataagaatccactcaaatttcatatattgattttgtagccagcaagcttattaaattattatactaattttaatgatttatatgcagtttatttttgatcttattaatatcatatctcttgtgaatgacagctttgttttcactgttttcagttcttttatcttttctctctctgtcttgccttattgtggtggttaaaaccacccaaacaacacttgaaatgagaagagttgagttgttacttatttcaataaagtctttattaagtatgatgtttgcagagagttcatagtttacctttatcagcttaatgttgtctccatttctagtttgcttagaattttattatgtatggatgttgaatttcatacaatgattttctgcatctgtggaaataatcatatgatcatatatatttcagttaatatagtaaatcacatttatttattttcttgttttctttttcttaatttttttttgaaactcaagtacacagaattagattaatcataatccttgattcaggaagc

SEQ ID NO: 330 - DNA, 1652 bp, Homo sapiens
acaacactacaataaatatcactgtgcaaatctcagatgattttcttagcatacattcctaaaaggagaactattgagttaatggtatgagtagtgtgccaactggtactcccataagtgagtgagtgtgggtataatttgtaatattttttaaaagaacagactgcaattttttttttttttgacagggtctcacgctgtcgtccaggctggagagcaatggtgtgatcatggttcaccatagcctcaacctcccagacaagtgatcctcccacttcagcctcctgagtagatggaactacaggcaagtgccaccacacccagctaattttttttgtattttttgggaaaacatgaggtctcgctatgttgcccatggtggtctcaaactcctgggcccaagtgatccacccaccttggcctcccgaagtcctgagaccacagacatgagccaccgcacccagcccagattgcaaatttttagaagtgctatagcgcgtatgaacaaaaactagaatatacaagtaaccaagttttaaaatttcagttaggccaggcacagtggctcacacctgtaatcccagcactttgggaagctgaggtgggtggatcatggtaaaacctagtctctactaaaaaacaaaaaattagccaggcgtggtggcatgcacctgtagtcccagctacttgagaggttgaggcaggggaatcgcttgaacccgggaggcggaggttgcagtgagctgagatcgtgccactgtactccatccagcctggcgacagagcaagacttcgtctttcaaaaaaaaaaaaaaaaggaaaagaaaaaacatcagttaatgtgtagccatattgctttacagtctaaatgaataacttctgggctagcttcaacggacgccatcattctcagattttagccctcaagaatagaggctccctagtttgctttttgtttttgaggcaatagagtctcactctgtcgcccaggctagagtgcagtagcgccatctcagctcaatgcaacctcccacctcctgggttcaagtgattctggtgcctcagcctcccaagtagctgggactacaggcgtgcgccaccacatctggctaattttttgtatttttagtagagatgaggtttcactatgttggccaggctggtctcaaactcctgacctaaaatgatgcatccgcctcagcctcccaaagtgctgggattacaggcgtgagcctctgcacccagcccaaggctccctagtttgattcacaccacataaaatgcctctctgacccacagctaaattcttagtgtcatggtattttccctccagaacacagagtagtaattctgacttaatgacctttctgcaggaacgccactcgtggcagcaacattcctttcctttaaagtggcttttgcttagctgtgaccttagcatttcatcctaacccaggtgaggaatataaagtcattcattataatattctccctcaatcacttgagtccaggaggtcgaggctgcagtgagccatgatcgcaccacggcactacagcctgggcaacagagtgagacccttaatatacatacattctccctctttgtttatgttggaaattttttataataaaaaaaatttaagtacattaag

SEQ ID NO: 331 - DNA, 4739 bp, Homo sapiens
acactcggaggaaacaaagaattgatttataattacttgatttgctacctttgtccagtaattgattaggttaggggttggcagacttctcctgaaacaggctggagagtaagtattttcagctctgtgggccatatggtctctgtcataactacgcaactgtgccactgcagcgtgaaagcaggcatagacacctcataaacaaatgagtgtggctgtgttccaactaaactttatttttggagagtaacatttgaattttatgtaatttccatgtgttgcaaaatatcattcttctctgaatgtttttcaatcctttacaaatgcaaaaccattcttcacttgagggcctttcaaaaacaaggcagtgggcaagatttggaccacggtttagcagtctcttcctcaggtcacagtttagggttgtagagctgtgatttacttagcaaattctatgtgctgggtactgggctttatcttttcatatataggctcacataatcttcacaaaaactcttaattatgtatttatttgtttatctacaagggggaactggggcttcttgaagttaactcacttgcccaaggttatattttagttatgtaatagtggtggcatgacactttattttttattttatttttttgagacagggttttgctgtgtcacccaggctagactgcattgtgatcatggctcactgcagcctccaactcccaggctcaagcgattctcccacctcagcctcccaagtatctgggactgcaggtgtgcatcaccatgcctggttaatttttctattttttgtagagtcagcgttttgccatattgcctatattagtccgttttcatgctgctgataaggacatacccgagactgggaagaaaaagaggtttaatcagacttaacagttccacatatctggagaggcctcagaatcatggcaggaggcaaaaggcacttcttacatggcagcagcaagagaaaatgaggaagaagctaaagtggaaactcctgatcaacccatcagatgttgtgatatttatttatttatttatttatttattttgggacagagtttcgctctgtcaccgaggctggagtgcagtggcacaaactgagctcactgcaacctctgcctcctgggttcaagcaattctcctgcctcagcctcctgagtagctgggattataggcacctgccaccatgcctggctaatttttgtagttttagtagagatggggtttcaccatgttagccaggctggtcttgaactcctgaccttaggtgatccacctgcttcagcctcccaaagtttgagacttattcactatcacaagaatagcatgggaaagactggcccccatgattcaattatctccccctgggtccgtttcacaacacgtgggaattctgggagatgcaattcaagttgagatttgggtggggatgcagccaaaccggatcattgcccaagttggttttggactcctgagctcaggtgattctcctgcctcggcctcccaaagtgccaggattacaggcatgagtcaccactcctggccgagtgacaatttgaactgaagtctgcctgagtttaattttaactataaaggccctgttcttgtggagtttgcagagttgtggtgaagagagtgggtaataaagcagttttgcaattgttagtagaatattataatttaactaataagtaactctcttagatacaccatattggtaaagcctagaatgaggttggcttttggattgttcatcacttttagtgacagtgcagtggacaggagaggttgtttgggtttgaatctcactccaccccatggaagttcagtgaccttcaagttatttgtcctccctatgcctcactttcctcatgtgtgaagtagaagcagaaagagcgtttgcttaggagcattgttaccaagattatatgagaagggagactgcaggtgatggacatgtagtacattgtcaacagacatgagctcttattgtcactattttttaagagtcaaataaaccccaccggctatatttaagactcacagtgctgctaaatttttttctcccctgctctgtatttccaaaaatatttttggaaaaaagattcagtcttatcaattacattgttcagatcaatgtctttgctttttactaaaccatattactaaattctagtgacctgattttatggtataccaccacaacagagattctatcaagttctctttaccttggtgatatggtttggctgtgtccccatccaaatctcaacttgaattgtagctcccagaatttccacgtgttgtgggagggacccagggggaggtagttgaatcatgggggctggtttttcccatgctgttctcatgatagtgaataagtctcacgagatctgatgggtttatcaggggtttccgcttttgcttcttcatcgtttttctcttgctgctgccatgtaagatgcggcatgtgccttttacctccccacatgattctgaggcttccccagccatgtggaactgtaagtccagttaaacctcattttcttcctagtcttgggtatgtctttatcagcagcatgaaaacagacgaatacagttaattggtactagcagagtggggtgttgctgaaaagatacccaaaaatgtggaagcagctttggaattgggtaacagggagagattggaacagtttggagggctcagaagaagataggaaaatgtgggaaagtttggaacttcctagagacttgttgaatggccttgcccaaaatgctgatagctatatggacaataaggtccaggctgaggtggtctcagatggagatgaggaacttgggaactggagtaaaggtgattcttgttatgttttagctaagagactggcaacattttgcccctgccctcaagatatgtggaactttgaacttgagaaagatgatttacagtatctggcggaagaaatttctaagcagcaaagcattcaagacatgacttgggtactgtgagttttataagggaaacagagcataaaagtttggaaaatttgcagcctatgtgatagaaaagaaaaaacccattttctggggagaaattcaaggcagctgcagaaatttgcataagaagcaaggagcctaatgttaatccccaagaccatggggaaaatgtctccaggccatgtcagagaccttcacagcagcccctcccatcacaggcccagaagcccaggaggaaaaagtggttttgtgggcctggcccagggtccctgtgctgtgtgcagcctggggacctggtgccctgcatcccagccactccagccttggctgaaaggggccaacatacagctcaggctgtggctttggaaggtggaagccccaagccttggcagcttccacatgttgttgaacctgagggtgcacagaagtcaagaattgaggtttgggaacccccacctagattttaaaagatgtatggaaaaacctggatgcccaggcaaaagtttgctgcaggggtggggccctcatggagaacctctgctaaggcagtgcagaagggaaatgtggggttggagcccccacacagagtccctactggggcactgcctagtggagctctgagaagagggccaccgtccaccagactccagaatgatagatccactgacagcttgcaccgtgcacctggaagagccacagacactcaacgctagcttgtgaaagcagccaggagggggggctataccctacaaagccacagggttggagcttcccaagaccatgggaacccacctcttggcatcagtgtgacctggatgtgagacctggagtcaaaggagagagatcatttggagctttaaaattggactgccctgctcgatttcagacttgcatgggccctgtgacccctttgttttggccaatttctcccatttggaacagctctatttacccaatacctgtacccccattgtatctaggaagtaactagcttgcttttgattttataggctcataggaggaagggacttgccttgtctcagatgagactttggactgtggacttttaggttaatgctgaaatgaattaagactttgggggactgttgggaaggcatgattggttttgaaatgtgaggacatgagatttggagggaccaggggcagaatgatatggtttggctgtgtccccaccaaaatctcaacttgagttgtatctcccagaattcccacctgttgtaggaggtacccaggaggaagtaattgaatcatgggggccagtctttcctgtgctattctcatgatagtgaatatctcacgagatcttacggttttatcaggggtttctgcttttgcttcttcctcatttttctcttgctgccaccatgtaagaagtggcttttgccttctgccatgattctgaggcctccccagccatgtggaactgtaagtccaattaaacctcttttgcttcctagtcccagtgtgtctttatcagcagcgtgaaaacagactaatacacttggcaattggtatttatttatatgtttcatagatgtttatggttttataaatacatagtgttctctggtttgcaattttcggtgtgcctttgacattttatgttaactatatatccatttcttaagtgaattttgattcatttactcagtaacccagccgtttttacttttatttctttttagaaatctgtatacat

SEQ ID NO: 332 - DNA, 1188 bp, Homo sapiens
tgtcaccacttcttaagaagcatagtgcatttacaaaaacactcttccaaggcttatttgcaaatcagtttctcaaagcttcaaggaaatatgattaccaaaaagtaaaagtattatcccgagaaaattgcttatagggaatatcttactagggagtttcgatgtggatctttgttttaataaaacaagcccagacagaaatcagtcagccaaggaaatgagttttgagactggcaacttcagtcaccactggcgtttttttctgcatctgtgaaaattcacaccccacagagatgaggcttcctttatcctacaaaaggaaatgctcttaattccttgacagttccctttccaatctgaaggaagttgttgtttcagcatgaattatcttttcagcaacaaaggtgaaagtgctacttccacttaaaggcaaagcactggcctttgggtcctattttcttgtgagattatttgtgagctggatgcagtgtttgattgttttaaaaggcagccgacttgtccttttggtatttatatgtatagcagaggcaattggaactctgggcattaaattaccgtaatgtgccagttgagaattctattcaagccagccaactccttcctcaaaattatatttttagtgtttagcagctgcaagttcccagaaatcttcaaagtgggatcacttatttcacccagtgcaagagctcttagctgctgccagtgtgagatgatctggtctgggaggcagttgggtacctgggaggggcgagagatcagaggccccctgggttgcccttagttctgcacttatttgcatatgcttccccttggtcaggttactgaacctctgagcctcagttggaaaatggggctaataatatctaccaaatggagctgctttgaggattcaaaataattatgaatcaaccaggcgcagtggctcacagctttaatcccaccattctgagaggccatggtgtaaggatcgcttgaggccaggagtcggagaccagcctgggcaacagagtgggaccttgtttctaccaaaaggaaacaattcgcagggcatggtggtgtgtgcctatagtcccagctatttgagaagctgaagtgggaggattgcttgagccgggagatcgaggctgcagtgagccgagattgcactactgcactccagcttggagt

SEQ ID NO: 333 - DNA, 751 bp, Homo sapiens
tcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctac

SEQ ID NO: 334 - DNA, 4009 bp, Homo sapiens
tcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctacaccagaccaattcaatgacagaataatttggccaaaactaaatatgcctagtcactgtaaactggttaactcatggttggttaagatagccttgggaatatgcacagaagttataaaaccatgagctattcattgaaaatgcagtccattatgaattcagttctttttactttatcaaacatgaccattttattttgtctgtatttcaatacagtatttttggcctccacttttccactacagcacatgaattgtgaaatgtgattctatataacatttaatgttaaagtgatatgaaatcaataagacttctaacaaattcaaggtgtgaagaaatgtacaaacacaacctgaagtctctatgaaaattcagtggtccctcagttacacacattactatggctcacagtatattgtccaaatttgtcttgagtatctaccatgcactagacactgccggttctggagtaaacctgataggcaccaaccatatggaacgtacaaataacggaggaagcagacaataaataaacaatttcaggaaaaaataattttgatgaatgttatatgtaacctgacattccctgagaaagggcaacagtcagatatttgggaggtgggagaaatgaatacaccagaatgacagaaaaatccagtcatcgttacaacataaccttgaataaaaatgtaagtgaacaatgactaaacctgtagtacttcttttggaagaatattcattgactccagtcagcttcctgttatttcacttcaaatggctatccagtttacaaattactatctagccaaccgctagcatttatcatgcttaaaattgagtcaacattaaatcattagcccctattccttccagaacctgtaatttaagagttagagagagacaagacttggttgcctcttagaaaagttaaaataaaactaaaacaacaggctgacatgacacattgtctccatttaagccaacatagactatttatttctttgctttattatgagtaatgaacatttctttagcaatcacctaggagcattactattatgcaggtaccgtactaactaaagacagagacgaatggcctcccagacccccatttgctcacaggctagtgtgggaggctgagaagttcacaaagaattacaccctgattggaaatttctttgacagaggtttgcacaggatgctccagttgtaaaaagagctgagggtagctttcggcagggcttagccttggaagagagcaggtaatagccaagggagaatgggggatggccaaggagggaaggtgctgaggtagagatagaacatgtgctgggtcatagaatatctaaaacaatcatattttctgcagatatctgtgcttgaatattaaaaattaaaaagagatcatttaacggtgaaaactgtagtactactcttatctctgtgtccacccttgccttttctaatcagtggtataattctactagagtgccttggcctctgctcccaatcatccctgctgtactctatagagcaccataaagaaggaataataaacagagccacacataacaaagaacttttatttggcaggaatgtttccttttatgacacctatctctgccctgtaagtagccacaaggccagaccagagatctgctggaaggaggcggagtgagagggtagtcaggtgggaatgaagaagctccccgtcctattcccacaaatggccccaaagagcctttgaagtctcagtcatcaggtaataatagccttcctctaaattagaggaagaatgtctgccttgcaacaaagatgatatttaaagaataatctgctttggggtacaaggggaaggaatgcagagaatagaccagttgaaaaggtaattcctgtttataagaattaataatcagaacagcaccattttaaaaagtaatgacttaaagtaaaaatggtcaaagatttcagaaatgttttagagaattttatgtttacaatagaatttatctaacaaaaatgataggaacaatacacattgatttaaaaacatacaaaaagttggtagcagatactttctcctactgacttgagacattgatttaacacctgaaaactaatctcagttaaaaagctgccagcaccatctctccacctgtaaaaatgtgaatatttatttatattttataatttcattttatttattctctatcttgttccataaaacattttggggtactagaactggttattagcctttattttttaaaaataattgggactgatttcaacggatagaattaatgttggggcgggggtgggcagagactacaaattacttggtctatgtctatatcttcaaaagtttggggagcttatattctccagctattgctttttttttttttttccagctattgcttttgaaacaacagctgggaaatataagctcctcaaacttttgaagcaatagctgaagaatgaatataagctcccaaaacttttacctgatctatgaagttgaatggctcaatatccattttactttgaaatgtagagaaaacctccattgcactatgaatggtatttataagaactaaaaggcatatgcccaagttggttctaagctctgcctatctaaatatctctgcttgccttatgagaacttatataaaacatattgagcacttaaacccttgggcaattgcagagtgtgctttggattttttgagtatcaaggtggggagggtcgaaaagagggagaaagggaacacaggtgtcagaaaagactagatgaattcctgttatgtaactactttttcaaatgcccccaaagtacttatttaacctaagaaaatctttagctaagtttagaaattagctttaaatatgctcaattgattttccttagacattccacatgcctttcgccagctcaaaagccttaattctggttaaaaggaaacatgtgaaatatactgcacaacttcagtggccagatcatattaactggctgagctgtgaggtcttatgagccaaacctgcttaccattcactgaaagtcagttcctaaaaagatttcttaatatctgccataccacttatctaagttttgggtggctaattagaatgagctcttcaaaaagttcagctaaagaaagtgcaaatatttgcattaaattgacttagtacttaaatgattcagtgtgttaattcttttactgaaattgctctgaagttatagtagacacttatgcttt

SEQ ID NO: 335 - DNA, 3633 bp, Homo sapiens
tgagtcgtgtaaactatgaaatcaccaaagtcatgtttaataaaactaatacctgggggtaaagcaacttataagacaataggcctatttttgttgtattccttttttcactacatttattttttagagcagttttatgttcacagcaaaattgaagagcaagtacagaggtttcccatataccatctacccctgcacatgcacagcctccccacttatcaacatcctccagaggaatacatttgttacagttgactaacctgaattgacacatcattatcacccagagtccatagtttaccttaggttcactcttcgtggtgtacattgttctggtttggacaaatgtacaatgccatgtatccaccattgtagtatcttacagaatagtctcactgcctaaaaatcctctgtgctctacccattcatccttccctcccttgaaaaccactgatctctttatagtctccacagttttgcctttttcagtattttacaggatgtaaccttttcagattggctttctttaactattaatatgcatctaagtttcctccccatcttttcatcggttgcttccaagttttagcaattatgaatagagctgctataaacatctgtgtacaagtttttgtgtggacataagttttcaattcatttcggtaaataccaaggaactcaattgctgggccgttggtgagagtgtgcttagccttgtaaaaaactaccaaactatcttccaaagtggctttaacattttgcattcccaccagcaataaatgagagttcctgttgctcaatatgtgcattttaattgcaattctgtaaggctctagagagaagtaggcaaagtccaggccctgcagtcaaaaaacttgagttccagacacagctctgccaagggacaactggaagaggaaggtgacggtcggatctccctgcatggtagcgatgaaggataacctagacagtgcgtgcaagtgcattcacagcacctgccgcacacaataaacactaaataaacacaacagtaattattctatgtgcgtgtgcatgctcatttaggaaaaagtagtcagtggctacttttgaaaaaaccaaatatccaatattctggttcttatttttcttctttgagtattttatagctttttagacatttttattttaggttcaggggaacatgtgcaggtatgttatacaggtaaattgtatgtcacaggggcttagtatacagattatttcatcatgcaggtaataagcttagtaacagataagtagtttttctatcctctccctcctctcaccctccagcctcaagtagaccccatgtctcttgttcctttctttgtgtctacgtgtactcaatgtttagctgccacttataagcgagaacatgtggtatttggttttctgttactgcgttagttcactcaggataatggcctccagctccatccatgttgctgcataggacatgatcacattcttttttatggctgtgtagcattccatggtgtatatgtaccacatttcctttattcagtctaccattgatgggcatttaggttaattctatgtttttgctattgtgaatagtactgtgatgaacatacatgtgcatgtgtctttatggtagaaatatttatattcctttgcgtatatacctaataatgggattgctggatcaaatggtagttctgttttaagttgtttgagaaatcgacactgctttccataatggcagaactaatgtacattccaccagcagtgtataagcattcccttttctccgcaatcacaccagcatctgttattttttgactttttaataatatccattctgactgatgtgagatgacatcacattgtggttttgattttcatttgtctaatgatagtgatgttgagcattttttcatatgctcgctggctgcatgtatatcttcttttgaaaagtgtctgttcatgtcctttgccaacatttttttttttttttttttttgagatagagtctcactgttgtcgcctgggctggagtgtaatagcgcgatcttggctcactgcaatctctgcctcccgggttccagcaattctcctgcctcagcctcctgagtagctgagattataggcacctgccaccatgcctggctaatttttatattttttagtagagattttatatttttcaccatgttggcaaggctggtctcgaactcctgacctcagatgatccacccacctcagcctcccaaagtgctgggattacaggcatgagccaccatgcccggccctttgcctactttttaatgggcttgttttttgcttgctagttggtttaagttcctcatagattctggtattagacctttgatggatgcatagtttgcaaaaattttctcacattctgtaggttgtttactctgtttcttttgctgtgcagaagctcattcatattctttttgtagcgggggaaaattacatatatatttaataatcctatattaatataatatgtatatttaaataatcctactgtgtggtatagcagcttaaataaagggtccatacctttccctgctaactgtctctggctctcacataatctttagctcactgattgcatcgctgttttctttgctgtcctcttttccctggtcttgttgcctgtatagtatctctacttggatgtcaaacttgccaagtgcaaagcagaattcttaaattttccacagaagcctgctgctccaagagtctccccatgtcagtgaggaactgaggacccctgttagaatcagtctgagagttttgatgtctttgattccaatctgtctctcacttcacattcaacccatcatcagctccagttaactgtgtcttagaaatgcctcccaatgtaggctgggtgccatggctcatgctggtaatcccaccactttaggaggctgaggtgggtggattacttgaagccaggagttcaagaccaacttgggcaacatggcaaaaccctgtctctactaaataaataaataaataaaattagctgggcgtggtggcgcatgcctgtaatcccagctattcaggaggctgaggcacaagaaccgcttgaacccaggaggcagagattgcagtgagccaagattgtgtcactgaactatagcctgggtgacagagtgagactctgtccttctcccctttcatagcctctgcctttgtgtttttatttagggatggtgcctactttgttttttgctgcatccctaacacccaacaccatatcttgtgtatactgctgaattgaagaaatcacaagggtctgaaagaggacttagagcaaagttggtatggataggaatcttctgctcctcagtgcctcaggggcagtggacacaatctgagggcagccactagggaagcatagatagcaaggagagagagagaagagcttatcacaaggcagtatgatgtggcttcaccagtgtatcaccagccagaacataatttggggaaagggattaaagaacatcttggtctcatctatttgtgatcacttgtacctacagacaaattgaatgtactgatcagccatgtcagccgagtggcttatagaacagaaagtttcctcattctaag

SEQ ID NO: 336 - DNA, 4902 bp, Homo sapiens
accagatattttaattcacttgtaaatgtaatttcaggttcatcctactagtatgccagataataatgaatcttatacttggagaatatttaagctcagtacagagcaaagtgtttttaaagcaaatattcattgctttctccaactgccatatttatctattgtatttttaatactttttttaatttggagaaaattagagatcggcatgcatttgtaagaaataatacagagagatcattgtatgctttacccagtttccccaaaggtaacatcttgcaaaacttgaggacaataatccaacacaagggtccctcatgttattccttgatagccacactcaattccctccattcttacccccagtttgaaccatggcaataacaaatctgttctctttgcaagaatgttgtatcaatggaatcatgtagcacataaccttttggaattggctgtttttatttttttcattgagcatggttatctggacatcccaccaggacgttgcatggatcggcagtttgctctattattgccaagtagtgcaccatggtatagatgtacccatcagttttttgtcatttacctgttcaaagacacaagggtagtttccagttttttactattatgaataaagctgtcataaacatttatgtatattagtatgaacataaatttttatttctctgggacaccttcctaagagtgctatggctaggttaaatggaagttgcaggtttagttttataggaaattgccaggccagttgaggtggctcacgcctgcaatccccagcactttgggagaccaaggagggtggatcacttgaggtcaggagtttgagaccaggctgcccaatgtggtgaaactccatctctacaaaatacaaaaattagctggtcgtggtggtgggttcctgtaatcctagctacttgggaggctgaggcagtagaactgcttgaacccaggaggcagaggttgcagtgagccgagatagtgccattgccttccagcctgggaggcagagtgagattctgtctcaaaaaaaaaaaaagaaaagaaagaaagaaggaaggaaggaaggaaggaaggaaggagagagaaaggaagaaagaaagagaaagaaagaaagaaagaaagaaagaaagaaagaaagaaagaaagaaagaaagaaaggaaggaaggaaaagaaaagaaaagaaagagaaagaaagaaagaaagagaaagaaagaaagaaagagagagaaagagaaagaaagaaagaaagaaaaagaaagaaagaaagagagaaagaaagagaaagagagggagggggagagagagagagaaagaaaggaaagaaagaaaggaaggaaggaaggaagagaaagaaagaaggaaagaaagaaagaaagaaagaaagaaagaaagaaagaaagaaagaaagaaagaaactgccaaattattgtccagaatagctgtgccattttttattcccgcttataatgtatgactggttaaattttttgcatcctcactggtatttggcattgtcattgttttttaattttagtcattttggtaagtgtttagtgatacctcattgtggttttaattcattttcctagtgaccaataatattgaatttttgtgtgtgatgttaattctttaatttaatttttttttttttttttgagatggagtctcaccctgtcacccgggctagagtgcagtggtgcgatcttggctcactgcaacctctgcttcccgggttcaattgattctcttgcctcagcctccggagtagctgggactataggcgccagccaccacgactggctaatttttgtatttttagtaggaatggggtttcaccatgctgcccaagctggtctcgaactcctgagctcaagtgatttgcccagcttggcctcccaaagtgctgggattacaggcacgagccactttattttattttattttaagttctgggatacatgtgcaggatatgcaggtttgttacataggtaaatgtgttccatggtggtttgttgcacctatcgacctgtcacctaggtattaagcccaacatgcattagctatttttcccagtgctctccctccccctgcaccacccccaacaggccccagtgtgtggtgttcccctccctgtatccatgaatattgaacattttaaaaatgtacttatttgtcatctgtatatcctccttggtgaaaattctcttcatgtttttgcccaagtactaatggtaatgtctattttatttttttaccattgagtaagaaaatttatatattctagatactattcctttgtaaaatatgtggttttaaatattttttcccagactgtgggaaaaacagactttgtctctttaatggggtcttttgcagagcaaaagtttttaatttttatgtcacctaatttgttaatatcctttatgaattatgcttttggtgtcaaatctaagaactttgctctagatctcaaagattttctcccatttttttcctaaaagtttaatcatttcatgttttactgggatccattgtaaattaacttgtatataaaatgtgagatttaggttaaggttcctgcttttgcctataggtgtctgattgttccaagcactatttattgaaaatgctatttttcctctgttggatttcttttatatctttgtcaaaaatcagttggtgatatatgtgtaggtccatttctagattccatattcttttccattatctctgtgtctactcttggccgataccacccagtcttgattactatagatgtataataagtcttgaaattgtgtggactgattcttctcatgttattcttcatcgaaactgttttggctattctagttcctttgcctgtccttataaattttagaacaatcttgtctatgtctacaaacaatcttgctggaacttttacagaaattttgttaaaactgtatgtcaatctggaaataactgccatctttactatgctgactctcccaatccaccaatgtggtatatctttcagtttatttagatctttgatttctttcaccagcatcttgtagttttcagcatatagttttgtacattgtattaggtttacacataactatttcattgatttgagtgactgtaagaggtaataatgttagtctcagctccctggtgttcattacatgtatgtagaaatacaactgagttttttatgttatcatacatcttgcaattttgctgaattggcttactagttctaggagggttgttgttatttgtagattctttgggattttctatgtagacaatcatgtcatctgcaaatagggacaaagttttttgtagatactccttatcaagctgaggaagtacttctttattcttacttttctgaggtattttttaaaatcataaatgaatgtagaattttgtcaaatgctttttatgaataatttgatatgatcatgtgattcttccttcatggcctattaaggtggattacattgattttcaaatattgaaacaaacttgcatctctgacataaaccccatttgttatggtatataatttttatatgtattgcttaattctatttgtgaatattttgttaaagattctttagtctatattcatgagggatgttggcctatagtttttccttttgtgctgtgtctgtctagttttgacattagggtaatactagctttataaaatgaactgggaagggttctcttctatattttggaagagtgtatagagtttatgttaattattcaaaccaagccaataaaaccatttagacctggagatttttgcggggagagtctttaaattatgaattcaatttttcttaaagttataggggtattcaagttatctatttcatatgggtgagttatagtggtttgtgtttttttaagtagtttgtttcatcttagttgtcagatttatatgtacagaattgttcataccattctcttttatggatttgatgtctgtggggtctgtagtcatgtcacctgtttcattctggatactggtaatgtgtgttctctctttttttacccaaacttgataaagattggccaattttattaatcttttcaaaaaacaagcaattggttgctctattttactgttttttaatttcattgatttctgctctaatctttattatttccttccttctacttgctttgaattcatttacctctttctttctaggttctagaggtaggggcatgaattgttaatttgagactcttcttttctaatgtgagtgtttagttctactaattttcctctcagtactgtgttaactatgtgtcataaatttggaaatattgtattttcattttcattcagttttgtatatattttttaatttcttttgaaacttcctctttggtccatgggttacttagcagtgtgttgtttggtgtccatgtgtttggaggtttccctgtctttctgttatagggttctagctgattctattacattcagaggacatactcattagtgttgccaactgccattttttccattgtattttaaaatccatatagtttggccaggtgcggtggctcacacctctaatcccagcattgtaggaagccgaggcaggcagatcacctgaggtcaggagtttgagaccagcctgctcaacatggtgaaacaccatctctactaaaaatacaaaaattagctgggagtgatggtgggtgcctgtaattccagctacttgggaggctgaggcaggagaatcacttgaacccaagaggcaaaggttgcagtgagccgagattgcagctccagcctgggtgacaagagtgaaactccatctcaaaaaataaaataaagtaaaataaaatccatatagtttaatataagc

SEQ ID NO: 337 - DNA, 14165 bp, Homo sapiens
tgggattctgaccttgatacttctctgttgttcatatatgtgtgaaattagttcctctgaacttttaaaagaaggtttggttcagaatagcttttcttttttcacagagtctccgcttttcagttaacatttaaaaacatggcatccgggcacggtggctcacgcctgtaatcccagcactttgggaggccgaggcaggcagatcacgaggtcaggagatcgagatcatcctggctaacatggtgaaaccccgtctctactaaaaatacaaaaaaaaagctgggtgtggtggcacgcgccggtagtcccagctacttgggaggctgaggcaggagaattgcttgaacccaggaggcagaggttacagtgagccaagattgtgccactgcgctcccgcctgggcgacagagcgagactccttttcaaaaaaacaaaacaaaacaaaaaaacatggcacgccaggtttggtggctttttcctgtaatcccagtcacttggaaggctgaggcaggaggatcatgtgaggtcaagagttctagaccagcctgggcaacatggcaacccatctctgaaacaaaaacaaaaaaatggcacctgtctttctgagatttcttgttctgcttccctccctcattttatttggaccatctctgtttcatatctttagttcctttcttgctcaatgttaatttcaaccccagggttttttgttttgttttgagacagagtctcactctgtcgcccaggctggagtgcagtggcgtgatcttggctccctgcagcctctgcctcccaggttcaagcgattttcctgcctcagcctccccagtagctgggattacaggtgcacaccaccacgcccggctgatttttgtgtttttactggggatggggtttcaccatgttggccaggctagtatcaaactcctgacatcaagtgatctgcccgccttggcctcccaaagtattgggattacaggcctgagccactgcacctggccagttttttttgttttatcacggcttgctcctgtcctgcaagagtcctggctggtccattttcagagttcacagaggctcaactgtgggccccttcacttctgactgtgggctccttgtactcaccttgtattcaatattgggttggagaaaatccctcacagcgttagctgcagttctcaagttgactctgctgtacttgccagtgggtaacctattcgctatatggaaatttttttttgttctcatgtccattacttccttttggcccatccacataaatattgataaatattgataatgctgttgccatacatgtcttaaagcttttggtagtttgttcctaccttcttgaatgttcctagggataccttatcacttgtaaatgttttccatgggtttatggttttgccatttagttgctctgtttttatatggggaaatgaagattaaaaatctatgtggtggctgagcacagtggctcatgcctgtaatcccaacactttgggaggctgaggtgggaggatcgattgaggtcaggagctcaagaccagcctgaacctggaaggtcaaggcttcaatgagcagggtgattgcaccactgcactccagcctgggcaacagagtgagaccctttctcaaaaacaacaataacaacaactatacagctgtcttcccagaatttgcctctggaccagtttaaatgggttggagtttctttttcttttttttttttttttttttgagacagtctccctctgtcacccaggctagagtgcagtggcactatcttgactcactgcaacctccgcctcctgggttcaagtggttcttatgcctcagccttctgagtagcatgttccaccatgtgcagctaatttttgtatttttaatggagacggggtttcaccaccttggccaggatggtctcaaagtcctgacctcaagtgatcttcccgcctcagcctctcaaagtgctatagtcatgagccactgagcctagctgagtttctttttcttttcttttttttttttttttgagatggggtctcgctgtgtcacccaggatagagtgcagttgcacgatctcggcttactgcaacctctgcctcccagattcaagcgattctcctgcctcagcctcccaagtagctgggactacaggcgcatgccaccgcgcccggctaatttttgtatttttagtagagatggggtttcaccatcttggccaggctggtctcaaactcctaacctcgtgatccacccacctcagcctcccaaagtgctgggattacaggcgtgagccactgcgcctggcctgagtttatttttcttaaaggtaatttctctgtcaggttacaaattcttctggagtcatttttgataatttacgtattcctgaaaaattacttcctcctgggcctcaaatttattaaaagtgagcaaagcatttttgtttgatttttgatttcttctatatctgttgttactgttccattttcatttattattttgtgtctgttctcccttatttcttgattcattataggttattctactttctcccccccaaaaccagctcttaacttaccaattctaatttcttgagttgttagatgcttaatttttttctttttattctttcttgaccattcatataaataacagcctttgaattttcttcttagagctactttagctgattaaaattctgacataagttctgatttgtcatttttattgttttctgaatactttgaaattttaggtttgatttactctttaacccaagaattctttgagagagatttaaaatttcccccagcaggtagggattattgttttctagttttattactgacctccagttttttgtggatttattgagattttcttggctacctaatataagattacaatttttaatgttctgcgggagttttaaaagaagatgtattttctgttttataataagattcccacatatcgactaggtatttttaataaagttttttcctttttttttttggtgtggcagtccatttactctgtgtagaactgagaaaagttcccagtaatgtatttcagtttcatctcatattttctgtgtttttgcttctgaatgtcaggatgtttgaatagtatttattagtactaaatctgcattatgaactacagtttttatcatcacgaagtacacttcttgtctggtattatcacgaatgcagctttcttattatatttgtttggtattgtttctaatcttattatttatatttgtttggtattcctttgtctactcttttattttcaatccttctgaatcattttattttattttattttatttatttatttttgagacggagtctcgctctgtaccccaggctggagtgcagtggctcgatctcggctcaccttatgctccgcctcccgggctcacaccattctcctgcctcagccgccggagtagctgggactacaggtgcccgccaccatgcccggcgaattttttgtatttttagtggagatggggtttcaccatgttagccaggatggtctcgatctcctgacctcgtgatccacccgcctcggcctcccatagtgctgggattacaggcgtgagccaccgtgcccggcctctgaatcattttatattagttacatcttttttttttttttttttttttttttttgagacggagtctcgctctattgcccaggctggagtgcagtggcgcgatctcggctcactgcaaactccacctcccgggttcaagcgattctcctgcctcagcctcccgagtagctgggactacaggcacctgccactgcgcccggctaattttttgtatttttagtagagacgaggtttcaccgtgtcagccaggatggtcttgatctcctgacctcgtgatccaccagcctcggcctcccaaagtgctgggattacaggcatgagccaccgcgcccggccagttacatctttttaaaacattttagccaggtgcagtggcttacagctataatctcaacattttgggagaccaaggcaggaggatcacttgagcccaagagttcgaagccagcttgggcaacataaggagaccccatttctagaaaaaaaatacaaaaagttagccaggcatggtgatgcgagcctgtaatcccagcttctcaggagactgaggcgagaggatcgcttttgcccaggagatggaggctgcagtgagccaagatcgtgccattgtactccagcctgagtgacagacctcatctcaaaaaaaaaaaaaaaaaaaatacacacacacaaaacattttagttaaattaaaatgtaacttaattttaattcagatatcagaaaattttttcttagatttttttgtttgtttgttttttgtttttgagacagagtctcgctctgtcgcccagactggagtgtaatggagtgatctcagttcactgcacctctgcctcccaggttcaagcgattctcctgcctcagcctcctgagtagctgggattacaggcacatgccaccacgcctggctaatttttgtattttagtagagacggggtttcaccatgttgttcaggctggcctcaaactcctgaccttgtgatccacccacctcggcctcccagagtgctgggattacaggcgtgagccaccacgctcggcctagatttttttatgtagcatgtatttggattttttttgttatttattctggaggttgtactttaataggtgagtttagctcatttttaaaaaaattgatctatgtttggttttagtgctgtcatcaaaagatctgctagagtttgtttatgtggccttttttttgcctttacatgatccattatggtttcacttttgtttgtatcctctgataattttcaaagctttgtgtttttaccttgtggattggcttttaactgtaacataaaatgtatacttattttgtctgtcaacttttcatttaagattttaatcctatagaaaaggagaaagaattgtacgatgaacatatatgtttcgttcaactggatttaccagttgttttcactgttctttaaaattcattgctttttttttttttagaaaccagtctcgctctgtcacccaggctggaatgcagtggtgctatcatagctcactgcagcctccaactcctggactcaagtgatctttcagcaccaactcccaagtagctaggactacagatgtgcgccaccatgtccagctaatttatttatttttatttttatttttatttttatttttgaaatggagtctcactctgtctcccaggctggagtgcagtggcgtgatcttggctcactgcaacctctgcctagcagatttaaatgattctcctgcctcagctgactcccaagtcactggtcgtacaccaccatgcctggctaatgtttttgcatttttagtagagacagggtttcaccatgttggccaggctggtctcaaactcctgaccccaagtgatccgcccaccttggccacccaaagtgctgggattacgggcatgagccagctcacgtggccagcagcaaacttatttttatgtttgtagagacgggttcttgctgtgttgcccaggctaagctcaagtgatccttccgcctcagcttcccaaagcactgggattataggcatgagccaccccacccagccctcaccagttgttaatattttgctacatttgctttatttctacctctatctacatgtgtattttggacagggaatatttgaaaataactcgtaaaaatcatgattctttgtctctaactattttagcctgtattgcttgaaaacaaggacattctcttagccacaacgccagtgtcacatcctagtgcttcaacattgatataatatctaatatggaatccattttcccagttgtctcaataatgtccattatagcatttttttgtgtgtgtgatccagtcgaggatcatgcattgcatttagtcatatctcttcttttgttttctttagtctacatcagtctccccatcttattttatttttatgaaaaatccaggtcttgtaaaatgtctcaacatttggatttatctgtttcctcatgactaaatgcagttagattttctggtaagaatacatcatacaaccttttcattccatcagtcaagaggcacataatatcagattgtctcattatttgtcatgctaagtttgatcacatggttaagcttgtatatatgtatacacacacacacacacacacacacacacacacacacttttttttgtttgtttttggagacggagtcttgctctgtcaccctggctggagtgcagtagtgcaatctcagctcactgcaacctctgcctcctaggttcaagtggttctcctatctcagcctcctaagtagctggcattacaggtgcctgccaccatgcccagctaatttttgtatttttagtaaaggcagggtttcaacttgttggccaggctggtctcaaactcctgacctgtgctctgcccacttcggcctcctaaagtgctgagatgacaggcctgagccaccatgcccggccagtattttttatgatatcttttgacttcttcctatgagcaatgacaaatatatttctttttttttttttttttgagatggagtttcactcttgttgcccaggctggagtgcggtggcacaatcttgactcattgcagtctctgcctcctgggttcaagcaattttcctgcctcagcctcctgagtagctgggattacaggtacccgccaccatgcccagctaattttttgtatttttcgtagagacaggatttcaccatgttggccaggctggtctcaaactcctgacctcaggtgatctgcctgccttggcctcccaaagcgttggtattacaggcgtgagccactgcgcccagccgacaaattctttttcctttccctcccctcccctcccctcccctcccctcccctcccctcccctccccccctcccctcccctcccctccccctcccctccccctcccctccctctttcctccccctcccctccctctttcctccccctcccctccctctttcctccccctccccctccccctccccctccccctccccctcccctcccgttcctttcctttttttttttttgaggcagagtttcactcttgttgcccaggctggggtgcagtggcatgatcttggctggccccaacctccaccccccgggttcaagcagttctcctgcgtcagcctcccgagtagctgggattatagacatgtgccaccacacctgggtaattttgtgttttcagtagagacagggtttctccatgttggtcaggctggtcttgaacttccgacctcaggtgatctgccgacctcaggtgatccgccaacctcaggtgatccgcctgcctcagcctcccaaagtgctaggattacaggcctgagccaccgtgcctagctgacaaatatatttctatttccatcctttttatttttcttaatacttaaaaaaatgtacttatacctctgttatttgatttagtgattttatcttttggtcttactatggaagatgaggaagatgagaaaatctacatacttatgctgctcccacctttctccctcttctcttccaacatttcttattcgttcattcacttttttaaatgaagaaaaggaaacttaaactgtatccagtaattataaaaatgacccaaaacatccttcaggtctatattttcagtttcatgggtgaaacctacccatggaacttggtgagtttagagtaattggaagagactggctgagagaacagggaaaaaccagggcgtgggaagcagtgcctgtcggcagcctttgggtttgggtttggactgttatttggactgttacacttgtcatctacctcactttaaatgttggtttatgatttttcatggctatccttggtttgacttttctaatcttaaaattttagacagtaatatgaagggtagcattgttttctgagctgcaataacaagtgccagggaattcatttgggaccagtatcaagctgagggccacacctgaacctcagtttttaccagctccttcccttcccttcatggccttccatttttgtgtctagatgtgccttttattcttctcttcaggtctaccagttgctgggcaaacctcagaatttgttaaccaagtgttagagaagactgcagaagggaatcccactggaggccttgtaggattaaggataccaacatcaaaggtgtaatcagcctcattggaccactggtcagaaatgtctgcgttttgtcacgttatccattgtaaattttcattctgttttgcatgtcagttagcattatgtaaacatttacaattaggttacattgttttaagaactaagtagcataagtgaagcatgatccaaaatacttgattattgcattttcagagcataaaccatgattaaaactgctactggcatcagaattgaaaatcatatgtttaagtaaatgttaggtacagattacaaaaatctgttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatacacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaaaaaaaattgcattttatatgattcctgccatttgctgctaaatctgggctggtcagaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaaatgtcaagaatggatgtgcttttctttattccacacatttaaaaaaatttagctgctaagatttaatgttataagaaatgaattcaagttgccttcagcaagaattaacaaaaacttatgttccctttctttatatagtttcctaaaattctgttcaagtattttctagttaattatgtaacagaatgttagcatctctccatatcttgaaacttgaattttgagaatgcattgaattatgctttcagtgttaaagtaaaaggtttcaattatccttctagtgaagtctgttgtggaataccatttcccatggaactgaggccatttccacaactttgcacagaactgcagtcttgttcttcccttggatcatgacaaataagtctcacacagtgccgtaatacttgtggattcttttgtaatctttgtaatcttaataagggcattatgagaagacgactccatgtttttttaatacttcaaacacattgggatgtaacaatgaatgtcaactgtaggaatggtggtttcgttttaaggaataagcatgttggggaaagatgatgaaaatgtactactgaaagttatacacttccataggcaaatgggattatgtgttgaagcatagtcctcatgcttaataaactgactgaaatcgtagaaattacacctaggaactgagctaggccaaattgccatttttgtttagagagttttggaggtagtagtgaggggacagagccttaaaactacttccaaacagtattttggaattgaagacttggtaactagtgaagaacatcaaagttgggtatttcaatgtgccaagtttgggtgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaagaaaacgttctgaattgtttgcctcatgttttcgcccttcctttctgtacttatatcttgcttacctaggtaaccatccgctcctcaagataacctattccaaagaaattccaaatcacagagagtggtgaactgctggtctgctgcccctctcgtggtaataatcaaagagctaacatttttttgacactataggttgatttttcaatattttagtgacatttagctattatatagaattatttgttgatgtaagcatttgcattcttcacagcttagaggatattcttatttctcctcttttaatctttgggcaagtgttctg

SEQ ID NO: 338 - DNA, 87096 bp, Homo sapiens
gagtccgtttagcgatcattcagagttgagaacctcataatcgaaaaatggtatattgagcactaaagtcaacacatcctagtaaacagaatgtttctgtctttattttgtgctgctgtaacagaacaccctgggactgcataatttataatgaacagaaattcattggcttatggtttaggaggctggaaagtcaaaacttatattgaattctttcagcacctgggagcagctaagtagaacaggctttagaattagacttaattttgaaaccaggtgctagcactgaccagctaatggtgagcataagatgccaatgttatctctcagagtctctgtgacctttgttgtaaaacagaaattagattttataacagcaccaatcctacccatacgatggagcactcctggcctaatcacctctcaaaggcccacctcttaatactgttacaatgtcagttatatttcaacatgagttttggtgaggacaaatattcaaaccatagcagtttctaactaaagatatctactttaactcaaggtatttattttaagatgatatatcttaagatttaagattatatctagtggcagagtagcattcactggatcgggataaaagaacaattctgaaatcctctctttccatgattttcccaatcccatactttgactgagacctacaaattaaaagaaatatattttatatcaacactatgagtacacacacatacaccccccacagactcctgaaacaaaattttaaaattatatggtatgatttctattgctgcatactaagccagcccaaaacttggttgcttgaaaacgaaacaaaaattgctcacaaatgtgggattcaggcaggacttataggtggtagggatagtatatctgatctctcctaccccacttggcattagctgaggcagctcagcagggactggaggatccatcctcaagatagctgatctacattgctggcagtttaatgttggctatcatttggtagctaagccagggctgtgggtcaaggtcctctccatggacttcttggtttcaaaagcaaaccttctaagaagagaaggtggaagtatgggcattttttatgatccaacctaagagaacacttcgtgtcacttttgccattgttatggactgaatgtttatgtctctccaaaatttgtatgtggaaatcctaacccttaatgtgatggtcttaggaggcagggccttagggaggtgattaggtcatgagagtaaaaccctcatgaatggtactagtgctcttataaaagggatcccagagagctttctcactctcttcctgccatataaagatataagaagacagtggtctgaaacctggccttgggtttcagaacccaaccatactggcaccctgatctcagacttccaacctccagaattgtgagaaatgcatttctgttgtttataagctacccaatctatggtactttattacagcagcccatgtcagccatattctattggttgaagtagtcacaaaggtccacccaagttttcagggaagagacaaagaccccccactcaataggtagagcatcaacatcacattgcaagaagaatacattgaatgggagaaactatcttgggtattcatagaaaatataatttgccacactctgcttaccttgtaccatactacactataccacactggtactatactacgggacaagcagtatattctgatatattgtagtctactgttttttatgctgatgattaccactgaactgtgttaacaatctagtggctccccatcctcagtttgaaaaacactgtcctgtacaattgtaaattgagacaatagtaaaaaatttcccttctacactggcagaatgctttaagaaaataaatacagggattactgaaatagatcagaaagattaaagtaaaaataactgagcaaaatgaagtttgccacttttactttctaatacctgtttataagagcaatgtttggcaatctcagatgagttcattttataactgagtcaaaatcttaacatacatcattgcttaggccaaaataaaacctctaattattatggcaaaccatgatacctctatacttttttttatatataaaatgcctttttcaagtcaattgtagaaaatgtgcataaccaactgattgtaacacaatcctttaacttgattcattctttacttattcatacaaactatttaggtatggaatttaagagttccttgaagtcatcatctttgtgacaagatctctaagcaagcaagtggctggcgccgtaaaggctaaaggaagagtgatctaaatcttgttcctctgaatgggtcctggggaccaatagtctgggtatcacctgagagcttgtagaaaagctcctgacaagtcagaatctgcattttaacaagataccccaggagattcctgaacccattcaggtttgaatagtactgaccgaaatcgatgttttccgaagtgtttagtttgtgcaacctatgagtaaaatatgtggcatgagtatatgtctatgtgtatctttgcataatacacatacactgctataatattttataaaccatatgatgcatcaaatagaaatttttaacagatgaggtaaacagatatcagtaggagttctaatccttctctctcactccctcactgtttcatcttaataagttccagaggtacaagcaccctgttttggagcccactggcctaaatcacaccacgagctcaaatagctttctcttgactaagtcacattgcccagaaacacatgaatactcttgtgacacgctgcagtaaaatgaacaatttataaagttccatgcatttaaaattccttcccctctttaaaagcaaatatgtgttgatatacttaacagatcattaaattttggcttcttagaaattaatcgcttattttaaggaactctgatccccagtattgcttgcaggaaatgagtaaacatatgtttgcatgtgagatgatacactggcataaacttttaatagcacactttaaaaatgatgcaaggtttctaaaaattataatctagccattaaaaattatacagtaggccaggcgctgtggctcacgcctgtaatccctgcactttgggaggcaggtggatcacctgaggtcaggagttcaagaccagcctgccaacatgaagaaaccctgtctctactaaaaatacaaaaaattagccaggcatggtggcaggcacctgtaatcccagctattcaggaggctgaggcaggagaatcacttgaacccgggaggcggaggttgcagtgagccgagatcatgccactgcacttcagcatgggcaacaagagtgaaactccatctcaaaaaatatatatatataaatatatatataaatatgtataaatataaatatatataaatatatatatagagagagagagcacctgtgtatatttttttgacacagaaaatacggtatatttttaagtgaaatctaaatgctagtggtaaccacagattattggggactgtgtttcaatggttctcattatgtttttgttttatttgtgttttctaattcttctgcaattaccatgttttatttgtgtaatgaattagtcactaacggtgacatcactggcatgccctgagcctggggtgcctaatgggttgaatcaattcttcacgtagttactggagtctgccagtcagttttcttttcttttttaattgtttttaattttttgtgggtacagatatttatggggtacatgagatgttgtgatacaggcatgcaatgtgaaataagcacatcatggagaatgggatatccatcccctcgagtatttatcctttgagttacaaacaatccaattacatttttaaaagtatttgaaaatgtacaactaagttattattgactatagtcaccctcttgtgctatcaaatattaggtcttattcatactttctaatttttttgtacccattaacaatccccatctctcgctcacattccatccccaactacccttcccagcccctgataaccatccttctatgctctgtctgtgagttcaattgttttgatttttagatcccacaaataagtgagaacatgtgatgtctgtctttctgtgcctggcttatttcacttaacataacgatctccagttccatctaagttgttgcaaattactgcatctcattcttttatggctgaatagtattcccttgtgtatatgtaccacattttcattatccattcatctgttgaaacttagattgatggccacttaggttgcttctaaatattagttattgtaaacagtgctgcaacaaacaggggtgcagatatctctttatatactgatttactttcttttgggtatgtacccagcagtgggattgctagatcgtatggtagctcaatttgtagttcattgaggaacctccaaaccattgtccatagtcgttgcactaatttacattcccaccaacagtgtatgcaggttcccttttctcaacatccacaccagcatttcttatcgcctgtcttttttatacaagccattttaactggggtgagatagtatctcattgtaattttgatttgcatttctctgatgatcagcgatgttaagcacctcttcatatgcctatttgccatttgtatgtcttcttttgagaaatgtctattcaaatcttttgcccgtttttgatcagattattagattttttcctatagagttgtttgaggtccttatatattctgattatgaatcccttgtcaaatgggtagtttgcaaatattttctcccattctgtgggttgtgtcttcactttgttcgttgtttcctttgctgtgcagagcattttaacttgatgtgatccaatttgtccatttttgtgttggttgcctgtgcttaggagtattgctcaaaacatttttgtccagaccaatgtgctgaaaattttccccaacgttttcctgtagtagtttcatagtttgaggtcttagatttaagtccttaatccattttgattgatttttgtatatggcaagagataaggatttagtttcactcttctgtatatggatatccagtcttcccaggaccatttattgaagggactgtcttttccccagtgtatgttcttggcacctttgtcaaaaatgagttcactgtaggtgtgtggatttgtttctgggttcttgattctgatccattggtctatctgtttgtttttatgccagtgtcatgttttggttactatggctctgtagtataacttgaagacagggaatatgatttctccagttttgttctttttgcttaggatagctctcgctattctgggtcttttgtggttccatataaatttttaggatttttttttttctgcttctgtgaagaatgtcattggtatttcgatacagattacattgaatctgtagattgctttgggtagtatggacattttaataatattcttccaatccacaaatatggaatatctttcctttttatatgtactcttcaatttctttcaccaatgttttatagttttcatttgagagatctttcacttctttggttaagctaatccctaggtatttacttgtttttgtagttattgtaaacaatattactttttgatttctttctcagattgttcactgttggcgtatgaaaatgctactaatttttgtatgctgattttgtatcctgctgcaactttactgaatttatcagttctgatagtttccttgtggagtccttaggtttttctaaatataacatcacaacatctgcaaacaaggataatttgacttcttacattccaatttggatgccctttatatctttctcttatttaatggctctagctaggacttccagtacttttttgagtaagtggtgaaagtgggcacccttgttgtattccagttcttagaagaaaggctttcacttttcgccattcaatatgatactagctgtgggtctgtcatatatggcttttattatgttgaggtataatccttctacccccagtatttttagggattttcatcattaagtgatgttgaatttcatcaaatgctttttcagtatcaattgacatgatcatatggtttttatccttcattctgttgatgtgatgtatcacattggttgatttgcatatgttgaaccatccttgcatcccagggataaatgccatgtgatcatgatgaatgatctttctaaggtattgttgaattcagtttgctagtattttgttgaggatttttgcctcaatatttatcagggatattggcttgtagttttctttttattgatgtgtctttggttttggtatcaaggtaatactggcctcataggatgagtttggaagtattcccttctgtattttttggaatagcttgagtagcgttggtattagttcttctttaaacatttggtagaattacagtagtgaagccatcaggtccctggcttttctttgctgggagactttttattacaactttgatctcgttacttgttattgttctgttcaggttttggatttcttcatggttcactcttggtagattgtatatatttgtctaggaatttatctgtttcctccaaattttccaattgattgacatatagttgctcatagtagccactattgaacctttgaatttttacagtatcagttgtaacatttatttttttttcatttttttattttttgagacggagtctcactctgttgcccaggctggagtgcaatggcctgatctcggctcactgcaagctctgcatcctggcttcccgccattctcctgcttcagcctcccgagtagctgggactacaggcacccaccaccatgcctggctaaatttttgtatttttagtagagacaggatttcagcatattagccaggatggtctcaatctcctgacctcgcaatccgcccgcctcagcctcccaaagtgctgggattacaggcgtgagccactgcgcccagcccttttttctcttttattttatttatttgggtattctcttttttatagttagtctggctaaaggtttgcaaattttgtttaacttttcaaaaacccaactttttgttttattgatattttgtatttttttatttcaatttcatttttttctcctctgatcttcattatttattttcttctactaattttggatttggtttgctcttgcttttctagctttttaagatgtatcattagattatttatttgaagtttctccattttttgctgcagggacttacagctataaacgtccctcttagtattgcttttgctggatcccataggtttttgtctcttgtggtctaggtgccacctcagccacagtgcagtagaacaccaggtagacatctaaggcttttgattctagtccttaactcccagatggcacctttgaacccacccagggcctgggagacctcactgcccttccattatcatttgtttcaagaaatttttcaatattcttctgaatcacttcattgacccactagtcattcaggagcatattgtttaatttccatgtatctgtatagtttccaaaattgctcttgttattcatttctatagttttattctattgtggtcacagaaggcttgatattatttctatttttttaaatgttttaagactcgtttcatgacctaacgtatggtctatccttaagaatgatccatgtgctggtgaaaataatgtgtattctgaagctgttggatgaaatgttctgtaaatatctgttagatccatttggtctagagtgcagaataagtctgatatttctttattgattttctgtctaaaagatctgtccaatgctgaaagcgggatgttgaagtctccagctattattgtattgggacctattcttctctttagcgctaataatatttgttttgtagatctggataccccagtgttaggtgcatatatatttaaaattgttatatcctgttatcaaattgacccctttatctttatgtagtgaccttctttgtctcttcttatagtttttgtcttaaactctgttttgtttgtatgagtatagtgactcctgcttttcttggattccattggtatctcatcccaagattccattgggtctcacccaaggcctatggccttggctcctgcatatgttcactcaaggccctggagctctacaatcagctggtggcaaagccagtcaggccagtgtccttttgttcagggcagcaaggtctttcaggccctgggtgggttcaaaggtgccatctggaagttaaggactagggtcaaaagccttagatatctacctggtgttctattgtactgtggctgaggtggcacctagaccacaagatatggttcttcccactcttccctcacctttccaaaggcagaggagcctcaccccatagccaccaccatctcagaccacaaagaatactgccagactaccgcccatgtttccttaagacccaagggctcttaagtcagcttgtggtgaatgctacctgtcctggaactcatccttcgggaaagtggactctggtatggccccgcacaggatcagaaatgccatctaacagtcaattcctggaatctgggaccccaagagcttcctgagtactctaccctctatggccatgctagtacctgaagcgagcaaatctcagaggctcacccaaggccctcaacatagtatctgggtatcactactgatcattcaggggccaggggctcttcagttagcaggtgatgaatgctgccaagactgggtgggtcctttccttcaagtcagcagtttcccttctgacctgggatgtctctagaaatgtcatctgggagcaaggacctggaacaggggcctcaggactctgacagctgccctatcatactgtggctgagctggtatccaaaatccaagactaagtcctttcaacccttctctctcctctcctcaagcagaaggaaagggtctgttttggagccaggagccatgcagcctgtagttaggggaagggtgatgccagcactcccttagtcaccccagcggatgtctcagtatgtcaggtgccccccaagtcctccatctctaattcaccattaggacttgcctaagagtttcagtccttatggcctagcctgcctttcaagtttactgggagacacagagcactttggccctcagtggcaaggtttatgagaactcaagttctgaccacaggggtcagtaattcccctctggctagggctggtttaaatgctccctctgtgggtaaaaactatcagctgagtttggtcctgttttcctttctgccctaacaaaatgcactgagttcagtgactcacagttgttgtgttctccttccccagatgcccagagatgctctctgcaccacgctgccattgctatggggagtgagagaagggtggtgttggtgattcaggacttttttttttttcctgtttcttcattgcctctttcagcaatggaagttaaaaccaggtactatgagggcacactgatttttggttcttatggtgttttttctgtgtaaatagttgttaaattggtgtccctgtagggagggatgactgttggagcctcctattctgccatcttgctccacctccagtttgccagtcagttttcatataaaccagagggaaggttatacgctgtctgttttttcctctgtaagtaatcagaaattacaccatctgtatgttatatacacatgtacataacattcctgtcttagtttgttcagtcggctatagcaagttaccatagactaggtggcttagaccacaaatattcatttctcacagttctggaggctgaaatccaagatcagggtgcgggccatcttcccagttatgtcctcacatggccttccttggtggtgcatacaagcagagagagcagaaatgatcttgtgtctcttcttctttctataagggcattaatccatcatgggaacttcactgtcatgacctaatcctctccagggcttcagctcctaataccattacactggggttagggcttcatcatatgaattggagagatacaaatctgtccatagcatttctttcacagctaaattggcatttacatttcaagaagagaaagtgtccaagagtaacaattgaagtataaagtgggttctttcttttaaacactttgtattatgttatctccatcatgaagccgtttaagaaaaggaactgcattctcagtgtattagttatctattgctgtataatctgtataagttaccccaaaactcagtgatttaaaacaatagtaaatatgtatcagcattgatagtttgtatggatcaggaatttgggagtgccctggttgggccttagtggcttggggactctcacaaggttgcagtcagattagactgtggccttagtcatggaggcttgattggggctgaggatatacttccaaggtgactcaagttggatactccccaccagggcctcaccacagggctcctcatgcatctccacagcatggcagctggcttcccccagggggagcaacgggagagacccttaacagaacctgcaatgcctttcctaacctgccttgagaatatcactccatctctctgccatattctattcgtctcaccacaaccctgattcactatgggaaggggattatacagggatctgatactagaggacaggaattattggggcccacttggggtacttaataaccaagagtggttattaggtgataatttcttatgtgatagtttcttatggtgtactgcttagtaaagacagtgcttttaaaatgaagtgtaggttaaatagacaccctcatcccaagtgcctctaaagcaaataactgaggtgatgttgagaaaggccaaagcggtaatcacttacggagagttcaagaagtgtaatgcgcacagtgggttctgggaggaccctgggtactagaaaagggaagggaagggaagggaaaaaccaaaggatttcagcttctctgacgattcagggtgtccagatttaagatggagttattttaggcactgaattgacaattccaaaatttgtgcagtccgaagaaactaaaactgaaaattagagacaaagcagttctttatttcaaccctgcaaacgtgtgtatgtttcctctgggataggaaagggacatcaatgggtcagtaatgcagaggaggagaactgaaaatgaaggagtggctacctgggctatgtacataattgtttttcatttttatagcaacctggtaagtaggtattgttatccttatttagtgtggaaaaattgaacctaaaggatttacagtcagctacatagccaatgtgtgagggccaaaattgcacttaacttcaaaataggtctttacaccatttaaaaatcaaactaaattggatcaagtgtagataacagtagctacagggaagcatgaggtgggtgagaattagccactctccaacgtagtccctgccaggatataatgaaagcaagtttcagactaaattctccacacacatacttttaaactgtattagcaaggaggccctaagcaattcatcagtccgttctgtaaacattcatgaagtctcaagtctttattcttttaggttcttctaccaccactctgcagaaaatatattgcagtcagcttaactatattccccaataggattctactacccttaaattcagcatcaggcaccagaaatcatataatccaccagcaggatacaggaccaatccagcctcaggcagcacaccaaaggcttcactcgatgactattccctgttcatacagggtcagggaagcctatttataccttgaatctcataagtagtgtctgtttttagaatttatttttctgatcaataagccattaatttcatcaatgaaaactcatttctgccattcattaattcatatcttaatcaatggacagtggagttgcatttattaaccagtactatgtctgaccttcctgattagatactagctgttcactcctaaagtgtatatttctgactaccccaagggtttaataaacaaaaatctacatttgtatcatactgtttatgatgtagtaaattatacatgtcaaagcaaaggacacaagcaaatccttagcccagacactagatgtagcgggagctcagctgaagactgaattactatcgcactagaattcagcaccatcttgttttgtgctttagttatctaattgcttcgtgtgttggatttggcttcttaatcagattatgaaattcttggaaagagagagttatatactgtttattcttctacaatagctagcacagtgctagatacatataggtctagaatcaatcatttttaattattaaaattcatagtaataccttacaaacacttggcccgtaggattctatagttgctttgagattctaaagtacctcagtggactacaaaccttaagaaattgcctgactgacttgagtgatggaaatggtatattttgtgtagattttctcatatcaattcacagctttgttctaacaattattaaacttcattgggataagcataaagtatgaaccataataaacaatcatgcacctcataacgatgttttggtcagctatggactgtatatgtgacagggatctcataaaattatactggagctgagaaattactactgcctagtgacatcatagcacaccaccttactcacgtgtttgtgatgatgctgttgtaaacatacctgccgcacttctggtcttataagagtatagcacatacaatcatgtatagtacatacttgacaatgatcataaatgtctgtgttacaagtttatgtatttactatgctatactttttattatttgagagagtacatcttccacttatttaaaaaaaaagttgattgtaaaacagcctcaggcaggtccttcaggaggtattccagaagaagacattgttatcatacaagatgatagctccatgcatgttattgaacctgaaaaccttccaataggacaagatgtggaggtgggacagtgatactgacaatcctggccgtgcgtaggcctaagctaatgtgtgagtttatgtcttaccttttaacaaaaaggtttttttaattaaaaaaaattaattaaaaaaggaaaaagtatatataataagactataaagaaagaaaatcattttatacagccacacaatgtatttgtgttttaagctaagtgttactacgaaagagtcaaaacgttttagtaattaaaaagtttataaagtaaaaaagttacagtcagctaaggttaatttgctatcaaagaaagaaaaatattttaaaataaatgtagtctaagtgtgcagtgtttatgaagtctccagtagtgtccagtaatagcctaggcttcatattcactcaaactcactcactgactcacccagagcaacttcagtcctgtaagctccattcatggtaagtgccctatctaggtgaaccatctcttaacttttataccgcatttttactgtaccttttctctatttatgtttagatacataaatacttttatgagccgggcattgtggctcacgcctgtaatcccagcactttgggaggccgaggtgggcagatcatgaggtcaggagattgagaccatcctggctaacacagtgaaaccccgtctctactaaaaaatacaaaaaaaaaaaaaaaattaactgggcgtggtggcgggcgcctgtagtcccagctacttgggaggctgaggcaggagaatggcaggaacccaggaggcggagcttgcagtgagccgagatcgcaccactgcgctccagcctggcgacagagcaagactccgtctcaaaaaaaaaaaaatacttttatgttacaattgcctaaagtattcagtacagtaacgcaccatacagatgtgtatcctaggggcaataggctataccaggcagtctaggtgtgtggtaggctacaccatctagatttgggtagtacgctctgtgatgttcacacgacaaaatcacctaatgttgcctttctcagaatgtgtctttgtagtgtgaccgtacaaacataaatactgatatctggcttcatttcaaaattttttaaattgagtttgtccatttccactgaatttaattatttcgagcaccaactccaggagcaggaagttagcactgggcttgtttttattctgagtactgcttgaatactaatagttgaaaagtattgtaatatttgaccctgaagagctttgactcagggattttgtgttgtcattcacatcctcggcaaggaaaggtatccagctcctactatttaatatgtaatcacgacatctagtgctcactgtttggttttgttaagcaatagctgtgagccacagagccaacctgcagccgcatctcacccaagaaggcccagggctgtgttttcagttttgcttttaatgattgcataactgtgtgaagttctaagacactgttgggattttagccttgggatgacaagcctttggggcacctctttggggtaaagaaagaagaactaacagaagagcttcagtttaagtctgatgaggacaaacgcctggcactaggtgggttttaaaaatccttgaaaattttttaaaaactaaaaaaaaagccagctcttttgcaattgcccagagagaggaggacacccatattgattgatgcattgttctcctaggcaggaatcgtcccactatagtctgcggtagcaagagttcaagggttaaagtaggaagactgatcccataaatgtaatttgcattccttccaaattcacatacaattgtatagcagtgagtatttaaatttaaaaacattatagtttaaggaacttttctcatgaacagttctcctagtgtacattatgtaaattctaccaccagagaaaaattcctgctttgttccggcttaagcttggtacatatatacaaacccatactattacttcagaaaattcaacttaggtaatctggctcaatactcatggttagagattttaactttaacaacttaacaatatttggtttatcatatttgtgcttttatttcaatttagaatgttttccagccagaaatctagctttaagttttataaagcatgatgacacagcagctagaactcaaatctctaaatggaattatgctaaatttaacaatatgttacctaaagtccttatgccttaaaatgtttctaggctaaattctgcaatttccctggaaacatattgaattgtcttcaataatacattgcataaatatatttatcctacatctaggtacttcaaattataagctagtaaatcttgtaatatttctagctttaagactcgtatgtatttcttcctttgtattttctccccaatcatatgattatgtactattgatgctataaatatcttatattttaaggttaggctaattcccagtggctctattatcccacctgtgcttgcaactcagtatgtgatgaaattgcctatgacttatcaattaacccttggtgtccctagaatccaaaataaagaataaatgtatgtaaaaggataattggagacttagaatctcttcctcaagattttatctggttaatgactatcacaggtgggctgttctttttattcttggaagaacatactctattccggaggggaaaatatcaaattagttcagcctgctacctgctcccatagaagatgggggaagctggctctttcatcggtgttttcgtctgtagccgcccccttccccaaccttgagttgatttaaaaggatggaagaaagtaccgtgctacctccaatgctgtcattcagtgttcaccccaggcagtgtgctagacacattcctggactaaatcctttagttcctttaagacaacaaacctataagataggtattattatctcgattttacatattaaaaaataatgtaagcctttttgtatttgcattgttttgctttgttctttaaatgtctgctttaaaaaaagaagtggggtaggtaaaggatcaaaaaaggcctggaatcccaaaagtaatgataaatgttctaaaaactctttaaaactttttatcttccatctaaacaggatgcatctgttacccatgctaattacacagaaggcatctgagtcttcctaacttctagcacgtaatagacaacctgtgattcctaacatttactgttggaatttacccattggatcttttctattataaatttatcttcacttttttgttgttgtttttccaagaagaggtgaaaatagcaatgccggctgggcatggtggctcacacctgtaatctcaggactttgggaggccaaggccggtgaatcatttgaggtcaggagttcgtgaccagcctggccaacatggtgaaaccctgtctctaccaaaagaatataaaaatgagccatgcatggtggcgcacgcctgtagttccaggtacttgtgaggctgaggcacaagaatcgcttgaacccagaagacagaggttgcagtgagctgagatcatgcccctgcactccagcctggatgacaaagtgaaactatgtctcaaaaaaaaaaaaaaaaaaaaaaaaatgcttgggagccaggtaatactcaaagaagaatgattgccactgggcttttctcaaacccactcatctgtcagtcacgtttgaaaattatttctcaggtcagatacggtggctcacgcctgtaagcccagcactttgggagacctaagcgggcggttcacttgaggtcaggagttcaaaaccagcctggccaacgtgatgaagccccccgtctccactaaaaatacaaaaaattagccgggtgtggtgtggtggtgggcacctgtaatctcagctacttgggaggccaaggcaggggaatggtttgaacccgggaggcagaggttgcagtgagccgagagagtgccactgcactccagcctgggcgacagaacgagactctgtctcaaaagcaaagaaaagggaaaaaaaaactgtttctctgttaaaggaaaggaagtagctcacctgactgacatatatgtgtccagaaatgaaatctttacagtgacctgttactgtcttaatgataaacattgaattattgacatctactttatctgaggcgttatcctaggaactttatatgcgttgtctgtaatccttatagcatccctcagaaccacattcttccccttctacatccttccttctcaggtaaggaaactgaggattgcctcaaagtcacatgactatggtaaagacatttttttcccacatgcttatgactaaatgttagtactcgctggaaacttcataccagacatcccataccctttggactgattaactcatagcaggggaacttgggccttagagtcactgttaattggaggttagtggtatgtggctgagagaaaattgtctgggaaatgcatttgcccttcaagctcagaacccagaaagcttttgtcagagccagccaggactggctgcaggattttggaatttcagaaattttgtgagatttttataatattaaaaattaaaatatattaaagtataattaaataaatcatattaaggatgaagtaggtcgggcatggtggctcacgcctgtaatcccagcactttgggaggccgaggcgggcggatcacgaggtcaggagatcgagaccatcctggctaacatggtgaaaccccatctctactaaaaatacaaaaaattagccgggcgtggtggtgggtgcctgtaatcccagctactcgggaggctgaggcaggagaatgacgtgaacccgggaggcagagcttgcagtgagccaagatagcgccactgcagtccagcctgggcgaaagagctagaatctgtctcaaaaaaaaaaaaaaaaaaaaagaatgaagtaaagaaatactcaacactcgtcacttcctaaatattttactattgtccatgctttggaggtaattgacatctattatatctgtgttgtggaaatactatgtaatggggtgctaccatacatcctttccaactttatgttcagtgacttaacattgctagcttgaaattagctatggcaggagcatttacaccatggaaatcagcaaatatgataaatcaatgcttgatttatcattttgttgcttgtctacaattaagaatgaagaaattattaatgcaaattaaacttaaaagtgtgttaagtctacagctgctacatgggaaaaaggaaatttttcttccaatattcaaaagctattatctgattcaccaaagaatttgctcatgtcattaacaaatgagtgtaattccaacatatatgttctttgtttcactttcttctaaattgttaaacaaaaatgtgaaccagcattcatgtgggaactatacctgctcatcagttgaaactataggttaactatggatagaaaaggctggcagaactcattgaaagcattctgtgaaatcagtcctctaaatggaatttattatttttaaaaatactattatttgtaaactatgtggtacacatcctttatttacagtaagcattttttttccatagaaccagttgtaaaacatttgccagaccactagctgtaaggtataactggtctgcaaactttgcacctgccagaaccacagagtaaaatcataccttccccaaaacaaaggcaccattttgaacacagttggaataggaacatagcttttaatcctgttgtttaaaaagagaagctaaaaagtatgctgactgcttttaatatttttcccattcgtccactagcaggagtgaatactgtcaagaagtcttcaaactacccaaaagcaagttgaagataagcttctatgaaatgtcatgcatttttgtagtgtgtgtatgtactatgttttgctaaagaagattatagaatccatctcctggactttggggacttggggggaacagtgggaggggggcgagggataaaagactacaaatgtggtgcagtgtgtactgctttgatgatgggtgcaccaaaaatctcacaaatcatctggtatgtaaccagataccacctgtacacccaatagcttatggaaaaatagaaatttaaaaattaaaacattaataaaatatgtataattatttaaaaaaatagtatctatttccaagtatctttggcttaagcagtaggattttttttccccaaagaacagtaagttaatgcactttacatgttaatatttccagctaagaaaacattaaggattgaaaattaggaatttaagctggtctcatatttatttagttgagtgaattaaaggggggttaagagtttatcagtttctggtgttcttttacttctaccctgtaccactctctagaaatacacttgtgatctgtgaattgtcacgcatatcgttatatgatcatttacttaagtctactttaattggttttggatcgtttccacaaactatgtttctgcattacattccacattgcagaaggtggggctgctctgttgagtttcgcttataaataagcaaacattctttgacctgcaaaattccaagaacagccctccttcctacctgacccttatatatttctaacacttgttaatagaaaaattgaatgaaaaaaacaacaactaaagatccttccaatattttctggaaaattgatttccttttgtgggagttggagtgtctaactggaagggataaaaataatacctgagcaagttatatttgactcatatttgaacagtcatctaatggaagacaaatctatgttcgcaaagtctttgtttcccttagggaagtaagtggattgccaaataatggtgggaaatgcttacagtgcatattttctttgtgattatcaggcagaattttgttctggttttgggattcaaaatatgccaggttctttattttcttaggatgtccattttacctagttcattgtaaatgacactgaaaggaaaccccgatcaaagtttttggcttcctggaattttgctgttgcttgggggaaaagcaatgcttttttttctgtttggatttttcagtggcatttaaggaagcaagatgaaataggtaatccatacagaaataatcatcttgtttttctttttgaaaatcactggtccaagaaagatacaatttaaatccaaggtcattggcattgatcagaatagatagctgatacttttcctgaaagatgaaccataatattttagcatcatgaagcccaggaatgtgagccacaagaacctgggtccaggaaagtcatgtaaatccattctggcttggccacagctggggccttgactagagttaccgttttcttaaccttaaagccacgccttggactctgcttcctttaatctgaccagactgtcttgaatctaatagtatgaggccatgtatttagggtcagttagctgattattgagtacccactatgtgcttgctactgggttaaacatgatagcttccttatggaatttacatttgtcttagtccttttgggttgctataacaaaataccttagactggccaatttataaataatagaaatttatttcacataattctggatgctgggatgtccaagatcaaggcatcacagatttggtgtctggcgagggcttgctgtcacccataaatggtgccttgtgactgtgtccttacagggcagaaggggagggcagctcccttcaacctcttttgtaaggacactaatcccatttgtgaagtcagagcccttgtgatgtaatcaacttctaagggcctcacctcttaacatttccacacttgggtttatgtttcaacatatggattttggagggacactagtgttcaggccatagcaacatttagcctagaacagcctagaaatgggtgagaattatttcctttattcaactagaattgattgaatgcctatcatatactaggtgctcttccgcatactgaggattcaaatgcgacaaattccaactcttgtctaagaggtgcaagagagtgccatgagagttcagaactaggacaactaatccagctagaggcatccagggtactttccggaagaggccaacactgagtgggaagtcagagtcagccagatgctataaggagggctttccggagagaaggctgtccatggacacggccagtaaaaactcccaaagtgtgacagcgtgacgtgtttttgaaagaatcgagggctgggcgtggtggctcacacctgtaatcccagtgcttggtcggccaaggcgggaggattgctttaaagcaaggagttcagggttacagtgagctatggtcccatcactgcactgcaaactgggtgacagagtgagaccctgtttcaaaaaacagaatattttttctctatatccacaccttgttggatatgcccacaatttggggccatttacagatggagtggggggccacagtgatcctaagagccagggagggaggagcaggaagtgggaaaggggtttaagtagacagcttccagagccccacttcgctccacctctacctggatttctgttcattcaggtctcccacaaccaagaggtgtctggtgagaagatcagtaaatcacctcattttgattccacattcgtaaagaactgaaaatcgctatttcatgacctgcgcttttcctcgcagtaaccctgagagtttggaaaggggcattaccaccaccacattatggatgaggaaattgacatcctcagtgtgagcgatgttgctgggtccacagttcaacatggcagcgctgggactggagctgtgtttcctgggcctttgggcccaggcagtagagtataggtttaaatcttggctctaccagttgctagctagaggatataaagcaagttccttaacctgtttaaccttgcttcctcctctgttagatgagcttcaaaatagtacctcctaagtggttgtgaggattaaatgagatcatgcacataaagtgcttggcacatagtaagcactcaataaatatttattccattaataggcactgaatcagattctgtggttgcaaaactgggtgtgacacgagtacaaaacagagacagacaactacataactggccatatagccaggggataggctctgagtaagcacttagcacagcactttgatggttctatttgggataggggcacagcgggccaaaagctttcacagagaagatcctattaggactttgacccagaaggtagaatttcactccccttgaaagggcaagtccaactaaagagatgcaattctattagttacctattactgtacaacaaattaccccaatatttagcagcttaaaacaacaaacttttttttttatctgacagtttctgtaggccaggaatctgggcgcaggataatggggtgcctctagtttaaggtctgtcagtcaagctgtcagtcagggctgcagtgatctccaggctggactggggcatggagaatccgctttcaagctcactcaggtgtctcttggcgggtctgaaaaggtacacttccaagctcactcgtgtgactgctagcatgcctaggtttctcatcaggtactttctttatcctgtagagatggagtcagcaaactttttatgtagagaaccagatagtaaatattttggactttgccagttatggtatctattgcaactactcaactctgctgtgtagctcaaaagcagccacagacaatgcataaatgaatgggcctagttgtgttccaatagacatgtatttgttctctctcttgctctctactaaaactgatagcttaaccaggatatcaaaatacattacaaacctcatgtagaatgggaaagatttaggggacgacaacttaactgacagttcaggttctttttggtaatacatgtagtcttagtcactggtggcatggctggccagctttggggcagagtgacggactcatggcagcagggcccttgcctgccataagaaaagacaggcccggaagctgaagggccagtggcatcataattacatctttccagtaattgattgcttgacctgtgccaatgtaacatatgtaacccataagattgttcttaaggctcataagatatagatacttaaggactcacagagagtgcagtgtctacacaggtatgttctgccctccagaatttcccttaaataattgcacagaaatctgtccctaatatttccttttgcattacatgtatggtgtacctagaatctggcttttctaaaacaactagaacatcagcaaggtgtctcagaggttgaaaagaggcctggatgattctttgtgcttgtgtttgaggctgtcaatatgttaaagtagtaaaataatgacaaagcagcattataaacattgaagaatattttaaatgcttacatgtacaaatttgcaatattatacacatgcataaaagtggtagaattttcctagtctagaaataacataaggaacagcaagtgatttgttatagaaaaaaaatgaggctgaggtttaaagatacatgaagaacattacctttcttcagtcctgtcagtgcggctctgggcatgtatttggagatagtgtcaggagcctacatttgagttctctctttgacaggaagtccaagttattcaacttcctgtgtctcacattccctgcctagctctgcagtgataggctttgttgcatgcatccaccatactgaagactccatgatatataataaatgaagaagcttaaactctgaattctttctccaaaatatattagttgtgtaaccttatgcaagttatttaggcttgctaaaccaatttccattatcgtaaaatgaagctaggacactggaatgcttatttcacacagagttgctgggaaaagaacaagatagtgagtgtaaagtatcaaacacatagtgaatgctcaagtgtcagataccatcaccatcttcaccgtcatcaccatcaccaccacttccactgtcaccaccatcaccaccatcatcattaccaccacaaccctgtcacacacacacacacacacgcacacccatgcatcagaaccagagcctcaaatcttggtttgaaaatctgttgagtgtaacaactgggactggatccagtgaagagtcttatggttataacctccctgagccctcctgcatgtgtgaactgttagcaccacagccgcagtgacttggccctgggttctgcttcattccaccctcacctgtccttggtaaataaacatgtatgtgcaagacagtttgtacatctcagacaaatctcttctgccacatgtgtgagaaaattgagacagaataaggactttataactagaaaagataaaatccaaagggcattggggcatctgcagattcacagaatgactgtcagtcatcattcttgggcccctgatgctaaaagagacacaccttgccatctccacctgggaagagcttgtgctgcaaagagagagaacatgatgaacttaacaggagttaagaatttggctctgattccctggagtctgttaggtggggtctttagctgtttggaaaagaagggtttctgcctgggacaggtaataattgctgaacagactttccttgcactttccctggaggtgtgaatttgatagcagtgatgccttgcagattatcatttcctggtttatgatggaggaacttaatctcctgtttaggtttctaactgccaggtcccataggttacttacttcacaacagaaaaatagaaaagaatggaaagataaaatcaaattcatctcacacattaaaatcatggcctgttatagtcagcactgtagacactgaacttggaagctgcaaggagggtgatattaccaaaaatgttaagttccaaaaatgttaaactctagagagaatggttaattaactgtcaggggtcactgtagggtagatgcatgtcgcaatgataatctatgcataccctaagaatgacccccacatagcactcgcacctgaatgtgtgtttggagttccaagctaaggaatctgggagtggccaagccagagattcactccttatctatgaggaacatctgagcccccagccgaccctgtgaaaaacagaccatacatgggattaaggcccttggttttcagttaaatgaaggttaagtagaagctgttaaaaggaggatgttacgtgaaaaatgttatataaacgacatgcttctcttgagtggctgtggttatcgcgttctgctgccactggtcctgtggttctcctgttcagcctgctgccactggtctgtcctgatatgtaagttcccctctaaaccctgtggcagccgggcgcggtggctcacacctgtaatcccagcactttgggaggccaaggtgggcaaatcacctgaggtcaggagtttgagaccagcctggccaacatggcaaaaccccgtccctactaaaaatacaaaaattagccagatgtggcgcacacctgtaatcccagctactccagaggctgaggcaggagaatggcttgaacctgggaggcagaggttgcattgagctgagattatgccactgcactccagcctgggcgacagagcaagactccgtctcaaaataagaataaacataaaccctgtgtcgcattcactggctccaggtctcttcttcagcctctcggacctgctgccatcctcactggaattaatggggaattggcatgacaatcactcttggaataatttgcaagaatttaaaacaattattatgaacattgtgtattttcatggaaaaggccagagacgtgatgctaagtgaaaaaaatgggacatgttgtaaaatgatcaaaacagggtatttagcatatgcaacagcacgcatttatcatttctttatcataagaacattcaaaagcctctcttctaaatattttataagatactacaccttactgttactaaatgtgaaaaaaataaaaattaaaaaccacacaagaaaaagaagtgggacacgaagttgtatgtgtattgtatagaatttgtatgcagatggacataaacccttgaaaaaatttgcatacataacacacggttcagctgcactgattatggttgaccttttttcctctctttttccaagttttgtgcacttatatgtatttgtgcatgcgtgcataattatatatgttttaatgtagagtgtataaatcacattatgtatatgcaaacatatataacatttttaatgaacaaaggtctttaagcatttggaaaagaccagatctgagcagagcgagtgcaaaaagaaagtttttgtactttaaaaactacttagaatttggcataaactaaggactaagctttaacgttaatcgataaatgagtgaatcttacattctatcccgaatatgattgtgctttagtgaagtaactaggatttttcttttttctgtggagattctagatataaatcacggttttgtttctttggtttaaattacattcctctttgatcattacttcacacaatgaaaagatatttccttgtgcaaagtagtggttaacttctcataacctctgacaacaaagagcccctgtgtgaggacacaggaattcctcttgggatacagggaaggcccccagctgaatcgtatccaaggaagatgttgcaaagcttgcaaagcttgttcagaaaaaggagcccagcttgagctctttgctttctattcagatattggccccatgtagaggtgggggtgggagttggggggaacccatcaaagagaaatgggaaacaaacctgactgcatttacagattacaaggaaaagttaattcttgcaaccagtgttagagccaactcaggcttattatatttagaatttaactccacttggaaaaaaaccccttttttttttttcctttcatggaagttaaagaaggtaacacaaacagcccgtccactctgtggtgtaaactctgaagtaaaaaacacctgtctgcagagaagtcccaggctggctgagttcaccttgactagctctatttttccccaccagtgagtccagcatgttcccaccagttattattatgaactgaaatctcgcagagtcaggcatttggcatggtattcacggcctctccccacctaaccccagcccatcctagtggatttatctcccatcatgcttccttttccaccacccacaaaccttcccttcctcccatgctttaactccccacccccaaccttgttgggaggacttatagaacgatataaagcacccacaagtgggtctggcatgtccaggctttcagtaaatgctggtgcccttttcccttcttctctttccctttgcacaaaaagtcttcctattagaggtacttaagtcttgggacaatgatagaccctttaacagggtggtgatgagcagaaatgagcgaggaggagagtctgccctctccgccctctaccagcccctcttaggggcctccctctaccagcctactcatcaaatgctgcacattaataacaattagccacatggccgctgccatttttgtgcttctgccaccagcttttcctggttcatgcattatgtgtacacctcatgtgaaggaacgaaggaacagagaggttttgagatttttcttgaggccacacagcttataagtagtggagccgattcaaattcaggagtttctggctctagagctcacccctcttttccacttgtgctgaactcctattaacctcaatagggaaggcaccaagttcaagaggccgaaaaagacatctagagccaggaaatgagacatggggcttatttggggcctacatacagaggagagagtccagtggcggcaggctggacaatataaccacattgcccagtggtagcggactaggcaacttgcaaacagcatgcactctatacagcattttcacttaccctccccttaataacctccacctggcaaccttcatttaacccaaaactcaggtctcaatcccctgtacagcgcatcttccattggacaggccgggtctcagatgtttatcatagataaggaaggaatctctgaggtggtcactcctggattccctagctcagaacacacattcaggtgcatctgtcattcagggtcattctaagggcatacttaaattattaccaccaggtgcatttaccctgcaccactatgcaaaagtgtcttcccaaagactcaccgacttttggtcaccagcagcatttgtccccaacacctgtgggtgctcaaaccgtatcaggagaagaaataccccctcctagttcaggggtggctccacttgaaaaataacattctacaaagtaaaaattccattccatgtacagataaattgcacggataaatatcaagcaagaatctatttgctaacagaccacggaatgttgtccttcgggtgtttaatgttgtacttgaatatgctgtaaaaaacgccatttaagaacgtgtagatcagcactatccaatagaactttctgtaatgaggaacatgttctatgtccatactgtacaatacagtagccactagccacatgtggcttttgagcacttgaagtatggctcattagtgtaaccaaggagctgaaattttaatgtatttaattttaagtaatttaggtagccatatgtcgttagtatttaccattttgactgtgcagctccagaatattcagaaagattggttgtaggacaccaccccaactccattttcatagtgttttgcctataatctctattatatcattgcatctaattgcttaggtgcacccaccccactaaattataagcttgatgtcttattcatctgggctgtgatccctactagcatatggtctggcccgcagcactagatgtttaataattaatgcaagttaaataaatggatgtgaactggctcattcagaagccagattcctactgcttgctatcatctaattcactctttctcatgactttctcttatgactagactggtccccaaatctccaggtcaagcccagtctgctcacctgtaagcacatttttcttttctcaaacgaaatcgctcttttaagtgattgttttggtatttgcctctttctctctaaatgcatacttctattactatttctttggtgggtttttttccataataggcatcatcttccacagtggaagaagctaccacctccagccctaccatacataaggaatgccaccattctccactgaaccccctgcctttaatttgggttagaggaattttataactgtgtaaatacttttgaaagctaaaccagggagtggattaccattatatttccttttctgtacagtgtttttctgcaggtagcaaagggcttgtttctcatttattgaatgttctgtatacctaccactgattcaacctcaaattatttccatgttgtataaatctttatctttgggacactttagttattctgttcatttcatctcttgaaagaaggctgcctggctgggcgcggtggctcacacctataatcccagcactttgggaggccgaggcaggcggatcacgaggtcaggagattgagaccacggtgaaacccatctctactgaaaaaaaaaatacaaaaaattagccgggcgtggtggcgggcgcctgtagtcccagctactcgggaggctgaggcaggagaatggcgtgaacccaggaggcagagcttgcagtgagccgagatagcgccactgcactccagcctgggcgacagagcaagactccgtctcaaaaaaaaaaaagaaggctgctagagccttcttagcttctccaatctgaacaagctgtgccctctcttgtatacactggaggcattctgggatctcccatcaccatcatccttggtaatacttttgcctctcttctgtgtttaatgccctattttatctatcccttgtcattccctcttggtttactccctcacttgttttttacatcttctagtaacttctgatagcctgagaaaagatatatggatgataaacgttttgagacctttcatatctgaaaatgtctttatcctaccctctcacttaattggtagtttggccagatttagaattatttgtgtgtatatatgtttaagaagtccaaaatcatgctgatgcccagctctttgtatatcattgagttttttttgttttatgtttccctgggaggctactggatctttacttttatcctacttctgaaatatctcagtgatgtatgttgattttgattctatttttaaccatttcactgggcagttggtgagtcctttcaatccagaaactcatgtccttcaattacgtaaaattttctcaaattattttgtgacgaattccttcccttcttttgtttattctctcttcctgcaactcctattatttggatactggatgtcctggattggtcttctaatttttttttatcttttttattcaattttaaatgactttatctcttttgctaatttatgtgagatttcttcacctttttcttctagattctctgttgaaatagttatttttgctcttttgttttaatttcaaggagctgttttttttgttctctgattaaaaaaaaacatagctttcagtttgggggaacaagtaacatgatgaggatgttattgtcagtggcttggggtttgggttgggggttggttttttgtttgtttgttgttttggattttcttttttctattctttgtttcctccaagtgctttttgttggttgcttggttcttttttgtttttttttctgttttttgtttttttgttttttttgagatggagttttgctcttgttgcgcaggctggagtgcaatggtatgatcttgggggcacaacctctgccccccgggttcaagtgattctcctgcctcagcctcccaagtagctggaattacaggcatgtaccaccacacctggctaatttttgtattttcagtagagatggggtttctccatgttggtctggctggtctcgaactcctgacctcaagtgatccacgcaccttggcctccccaagtgctgggattataggcctgagccaccgcgcctggccaggttgcttggttttaatctctatctttatggtagagacttttgttggtagaaggtagctgccaggcattctcacagaaacaaggaggggagcaggctgcagtccccaacatttcctgtgcatgtgttcacttaatccccctgtttttggtatgaaacccctgccctccactgtgtgtcctctactgttgtttccagtccagaaaccctgtttcaccctttcctgacactcaacctgcattctttggctgagacggaaagtagaaaccactctaaggagtgcaggaagagatttggtaacctgacttcttaaaaaccttccaaactattcttattttagtcctccataattcactcttactttccttgggactttaaggattctaccatctaaattgggctaatcctttgttttccagagtgctgatttaagaggtcagtgactttactttctgtttttacctcctctattgctctccctttgggtttctgcctttgtttcaatgggaggtagttggacgtgtttgtcctgtccatcacctttctgttgtcatccccccattcattgtttcagctcagtaggttaactgataacttcaggatctctgaaactctgtatattgtcctcctgccaactgtctcatttatggaaccactgttcttccattctgtcagcctccaaaaataataattctaataattccttcttttatcatacaaattccttcttccatggaaatctggaactttttcccttaaaatatagtacatatttacagaagtcctactttgtatttctttttgaagaaataaagataatgagacctgatccttagattcaaggaacttccattgtagtggctgggagaaaaactgcaaactaatagatgatgagaaggaggatggggatgatgatgataacagtgatgaatcaagcaacagccaacactgttgaaattatactttgtaccgactgtgctccataccttactgtgttctttcacttaatcctaactactgtctgaaaaaggtactgagggaacagaaagaccctctcatattgttttatattgttttatactcagtacctgttttaagaaaaaaaacaaggaagtgaaatcaaagacaggcagcctggcgccaggcctaaaaccaggactgggcctgcctggcctaaacctggtagttaaaagtcaactcatgacttagaacccaatgttacccatagatttcaggcattgtatggaagaacattgtgaaactccctgctctgttctgtttcactctgactaccagtgcatgaaacacctgtcacatgtcccctagattgctcaatcaatcacgaccctttcacgtacaatctttagtgttgcaagcccttaaaagggatagaaattgtgcagtcagggagctcggattttaagacagtagcttgctgatgctcccagctgaataaagcccttccttctaaaacttggtgtctgagaggttttccctgcggctcatcctgctacatttcttggttccctgaccgggaagcgaggtgactgacagatggccgaggcagccccttaggtggcctaggcctgccctgtggagcatccctgcaggggactccagccagcctgagtgacgcgatccaaagaccgctcccaggtaggcaattgccccggtggaacgcctcgccacagcagcacgtagcaggcccctgcagtggctgagcaccaggaaggaactggcatttagagtctggacatctgaaactaggtaagaccagtctttggaacttgcccactccatttgagtggaagtgtggcctgatcacccacggcatgccttaatcggcactttgatgttgattttgggtttgacttggtttgaattgcttgacaggactggtcttgggaacttgcccactccatttgagtggtagtgtggcctgatcacccatggcgtgcctttatcggcactttggttttggttttgacttggtttaaattccttgacaagactggtcttgggaacttgccttctccattcgagtggaagcatggcctgatcacccacggtgtgcctctaccggcactttggtttttgtttttgacttgacttagattgcttgatactttggttttggttttgacctggcttggatttctggatactctgattttggtttggtgtgaactgcaaaagtgtgtgtgtgccctttttaagtgttttttgttttgtggtgtgcatgtggtgtgagtgtggtattttgtctcaaagaagcataggtcaggcacaaataagcccaccccactaggaactatgttgaaaaatttcaagaaaggatttaagggagattatagtgttacatgacaccagaaaaacttagaactttgtgtgaaatagactggccagcattagaggtaggttggccaccagaaggaagcctggacaggtcccttgtttcaaaggtatgacccaaggtaacctgtaagccaaggcacccagaccagtttccacacatagacaattacacctggttttagacccccttccccacccaacagtagttaagagaacagcagcataagtggctggcagaggcaaggaaagaccagcagggagaaaaagaggccatctataccaattctaagttaatttagactaaacaaggtcttattaatagcaaaggataattgaaatcccaaacttacaaggttttcaacagaagtgaagtttgctaaaatttaacagcgtaacatgtattatggtaacttctaatcttgtggccttacacagtctagtccaaagacacaaagaaagttctctttaaaaaaaaaaaaaatggttatcttcaaaaaaaaaaggaaaaaaaaagggggggaggcagaatttatatcaaaagagtgttatatggtaaattcttgtcctgaaataaattaactggttgtttaaagaaaaaactacttgtaataagtcagaaagttgagacacgttgaaaaattgtctgtgaaagtcgtgaaagaaaaaaagttataaaaaaaagttatgcaaaaaatgttgtataatttaaaagtaataaggcctcctgagtactactgaagaaacagtttatgtgcaaggtgtataaagtaaaatatatctttggtaaaaatattataaggaggcataagaatgtggatttttacctacattaaaaggttaaaaaaaagttattgttttaaaagtttaagcaagttttaaaatgttaattgtaaagaaaattctgtgtataaacatattagctaaagttaaaaaggtatcatccagtttttctgtgaactggatattaaaggaaaaatgcaacaggtttttcttaaagcatcaacctgctctttaacaaaaattataaaaggttaaaaaaaaagagtctataaaatcttaccttatggtcaaacatgaaaaattggataaatatgtctacaaggttttattaaaattaagtttaacattaataacacactaatataaaggtaaaatttagtttatctggtataaaaatcatacaagaaacattattaaacataaaatggtgtttagctttctttggtctaaaaactaataaaaataggtgctaaaagaaacattcattttactagaggatcataaaagttaaagacttaaactttggcaattaaaacagcataccaagatgcaaatgtctggttgaaatggatcaaatattccatctgcatgttaaacaaaagcaattgtgatgcttgtgcacatggcagaggccctgtttatctcccttccactaaggtggtcctccagtcgaccaggcatgggctgcatggtagctcttttccaggattctacagcctggagtaataagtcatgccaagctctctctgctatatcccggagtccctgcaggtcagacccgagggccatccagcctccatgccccaacactaagttcacttcgtgtctctcaccacagggaggaaacttagcattccttggagacctgaagtgatgcgatgagcttaagaattttcaagagcttatcaattagtcagcccttgttcatccccaagcggatgcgtggtagtattgtggtggacctttactgggcactctgccaaataactggagtggaacttatactttagtccaattgcctatccctttcaccctggcatttcatcaaccagaagaaaaaaaaaatggcatttggagttttaacccagactgtagggccctggccaaggccagtggcctatctctcaaaaacaactagctggggtttccaaaggctgacccccatgtctaaggtccctggcagcaacggccctgttagcacaagaagcagataagctaactcttaggcaaaacctaaacataaagtccccccatgctgtggtgactttaataaataccaaaggacatcattagctaataaatgctagactaactagataccaaagcttgctctgtgaaaatccccgcataaccattgaagtttgcaacaccctaaccccgccaccttactcctggtatcagagagcccagataaacataactgtttagaggtgttggactcagtttattctagtaggcccaacctccgagactacccttaaacatcagtagactgggggctgtacatggatgggagcagcttcgccaacccctgcaaagtgactctgaagaagacagcaagccctgctccagtcacacccagaagctgactggtccacacaggccgaagcatgaggaaactcatcgtgggacttattttccttaaaatttagacttgtacagtaaggacttcaactgaccttcctcagactgagggctgttcctagtatatacatcaagtcactgaggtaggacaaaagattgctacagtcctattgttttacagttattgtgaatgcctaggaactccaaaaggaacctgtttgtataataacactcagtaccaagtatgtaatccaggaagtgaccagcccgatgtgtgctatgacccctctgaacctcccatgatcacagtctttgaagtaagactaaggactggtccttttcctggtgacacaagtaaagtaatagctagaacagaagaaagaggggtccccaaacatgtaaccttaaaatttgatgcttgtgcttctattaatagtaatcagcaaggaatagggtgcagttctctagactggaaaaaaaagttacacagtaaaaaaaaaaattaagtatatctgtcaagaatcatatttatgtgagatgtgtcaatactggtcttgtgtcatttggacttacttggaaacaggattaaaaaggtcctgtttggctccagaaaggaaaagcagccccactgtgggagctgcagccctttagaactggtaatcacaaacccctcacacccaaaatgaaataaaggaaaatatgtatcattgagcattgatggaaaaggactagatcctagtgtaaacatcttaataaaaggagaggttcaaagacgctctccagaacccgtatttcagactttctatgatgaactaaatgtgccagtacctgagattccaggaaagactaaaaatttgtttttgcaattagccgagcatgtagcccagtctctaaaagtcacttcgtgttatgtttgtggaggaactataacaggagatcaatggccatgggaatcccgagaattaattcctacagacccagttcctgatgaattaccggcccaaaagaaccaccctgacaatttttaggttctaaaggcctcaattattggacaatattgcatagctagaaaaagaaaaaattcactcattctgcaggatgatttagttgcctaggacaaaaactgtaataatagtaccataaaaaaaaaacagttacatgatagagttccagttacatagacagagatccattcagtaaatttccaaggttgcagactgtctgggcccacccagaagtccactgggactggactgcccccagtgggttatactggatatgtggacatagagcctatgctaagctgcctgatcagtggacaggtagctgtgtaattgacaccattaaaccatctttctttttactgcccgtaaaagcaggcaaattcctgggtttccctgtctatgcttcccacaaaaaacgaagcgtagccataggtaattaaaaagatgataaatggccccctaaaaaaattatacaatactataggcctgccagctagacacaagatggctcatggggatactggacccccaattacatgctcaacagaatcatatggttgcaagctgttttagaaatcatcactaataaaaccagtcaaaccttgactattctggcccggcaaaaaaaccctcagataagaaatgctatctatcaaaatagattggctctcgactacttgctagcagctgaaagagaggtctataagaaatttaaccttactaattactgtctacacatagataatcaaaggcaagtactcaaagacatagttagaaatatgacaaaactggcacatgtgcccgtaaaagtgtagcacagattcaaccctgaagccatgtttagaaggtggttcccagcactagaaaaatttaaaactcttataataggagttataatagtaatagaaacctgcttactgctcccttgtttactacctgtacttcttcaaatgataaaaagcttcatcgctaccttagttcaccaaaatgcttcagcacaagtgtactatataaatcactatcaatctattgcacaaaaagacataagtagcaaaaataagagtgagaactcccactaataaaaagtgagagtctcaaaggggggaaatgagggaagagataaaccctctcatattgttttatattgttttatactcagtacctgtcttaagaaaaaaaacaaggaagtgaaatcaaagacaggcagcccggggccaggcccaaaaccagacctgggcctgcctggcctaaacctagtagttaaaaatcaactcatgacttagaacccaatgttacccatagatttcaggcattgtatggaagaacattgtgaaactgcctgctgtgttgtgtttcactctgactaccagtgcatgaaacccctatcatgtatcccctagattgctcaatcaatcacgaccctttcatgtaaaatctttagtgttgtgagcccttaaaagggacagaaattgtgcacttggggagctcagattttaagacagtagcttgccgatgctcccagctgaataaaacccttccttctacaactcagtgtctgagaggttttgcctgtggctcatcctgctacagtactattatcattgtcattttatgcataaggaaggagctagtgaggctatgtaactcttgtacaatactatgtgtaataaacatataaaccaatgtgctaagagaaaccaggggcagtagaaattaactcaaaaatccaagaagtcttgaaataaaatcacttccaaatttgctccttcctctggattccctttgatgccaccacacgccaggcttttttttatctcatcattaaattgaaagggtaaactcttagcaagtctttctgtacccaacccttttcattttctctgcttaccactggtaggtcatgctttgtaatatattgcttccatcttgtcattcaccacttcagaacctaatttgtttgcctatcatgccatatttggtcttctggacctactttcagtaacctggccatataggccatatccatcttgtaaccccaaaatccaacatgggtctctccattgtctttcacacaagtcctgttcttttctacctttttgcttttactaaaactgtcctctccgcctaattaatttctacctatctctcatggcctcatttttccataaagcctttcctggcagcttcgttgcagtgggattacattttctcccaaactcccataacgcttagtgctgactggctgtaccaggcatcaggtcttccccatgtacaagcaatagcttgcccaacaaatgagttatttatacttgtatccctgtatagaaacacatattttccaggcaccagcagtataccaaaaaatatttatttttgaaaagatttatcacttcaaaaagtcattctgggaaaaattataacttctttgatgcatcttatttcatggttattgttattttgacacctgatctttatagttcttggagctgataaacttcttactttacccctggatgttgttagtttcatcttagaaggacttctttgtataactgtgcacaacgtagacacttgtttgatatagggtattgtttgtaaaatttttgcataatatattgctgaaataaactataatatgggattaatgccacatttcattaaatattagatgccattgattgtaacatgtaccattatcttacgtaacacaaagatagaaaataatgctgccaatgtaaccatgatgtgccaatgattgctagatacattccaattccagatatgttaaaaggtaaatgaatacacgtacatcttagaatcgataaaatgtgagcgttgttgtgttataatattatgcattggtattaggcatctttaaattgccaatgatatttttaagtcaaattttttaaaacatgcaaggtaccacctatatgcaagtcactgtgccaagggacacaatgtgcagataaacactgatgaaaccatggctttctctactgagggtttatagtctgatagagggaacattgtataaatgaattatgtactataatccaagacggaaagtgatcagagctatccaccttgatacagtgatatagtttggctgtgtccccacccaaatctcatcttgaattgtagctaccataatccccacgtgttgtgggaggtaattgaatcatgggggtgggtttttcccgtggtattctcatgatactgaataaatctcatgagatctgatggttttataaagggcagttcccctgcacacgctgccttgcctcctgacatgtaagatgtgcctttgcatctgcttcaccatccgccatgattgtgaggcctccccagccacgtggaactgtgagtccattaaacctctttttctttataaattacccagtctcaggaatttcttcatagcagtatgaaaatggactaatacaaagagcttaaagatcctttagaaatatttatttatttatttatttagaggcagagtcttgctctgtcacccaagctggagtgcagtggtgcaatgagctcgctgcaccctccgcctccaggttcaagcaattctgctcctcagcctcctgagtagctgggactacaggcatgtgccaccacgcctggctaatttttgtacttttagtagagacaaggtttcaccatgttggtcaggctagtctcgaacttctgacctcaggtgatccacctgcctcagcctcccaaagtgctgggattacaggtgtgagccaccacacccggcctagaaatattttaaatagagtaattacctttattttggaatttttcaaagtcttcctggagaaagtggtgtgtgaaatgagttttgaaggatgaatagaattttgcaaactattgattggtaaggaggtatgccaattggggaaaataatatgtgcaaaggtatagaagcattggcattaaagaataatgaaaagtctagtttggctggaaatagaaagtagctggaggagttccccagataaactaggaaggccatggatgtcgtattgtagaaggccttgaatgcatagctgaggatatttaagatttggtaggcaatacggaaccacttaaggtcttttaacagtgcagtggtttaatgagagcttttcattacatagctggctccatctcatcttttagatcccagtttaaatgctaccctctcagagggtccaaccctcactctaagtgaattctcacctataactccaaattgccacatccagttggtttcctaggaagcacttaccactggttttgatctgtctaccaaccacctggtaagttgcatggtagggcaagtagggcgttctgttcccctttcatactctcagtgcttagcactctacatggcacttcttaggcactcagtaacagcttactaagtgtgcagacatctgagagtagcttctaacagacagttggatactttgttcaaaacaaaaacaagaattatgtgacgttatcaattcatagaggacactctgagacaggaggccaggaaacaagtcctggctcctccctaccgattccttgcatggccctggataagtcactaagactcatgccctctggtttgtttatctttccgaaaatggttgtggaggaactgactgctgaggtcttctcttcagaaatgctgcatcatccacatgcaaaatatgggtctggtgcttaggagacaaagggtgtggctcgagaggtggattttggatttgttctacagggaatacagtataatcaaagtcaagataaggatccagtttttaaaatggtctcgatcctctgcacagcatttgatgctgttggactggtagctgttctctttatctgaggcactgtagagccctgtacctcaaaccttttctactgctgcttgtctgtttctttcacccagaacccttcaccccacagatgtagatgttcaaatcatatggttctgccttcttccctcttcacatctcactccctagggtgactcttaacactccatggaaatccttgttccccctgagtctcctccttaaacatcaagcaatccagaatatttactgctcccatcaggctgttattctataggatgcaccacctggcatcccaccctattctttccacgtttcattaaattttctaacagtctttcactacagtttttgttacctaaaatctgcagtttcctgtgcatagcatagggcttgtcacacagtaggaattcagaattctttgttgactaaatgatactccattctttctgcctcatctctgtcacattccccttgcctaaaacgccctcccgacacacctggtcactattagtttttcttttttattttctttttcttttttttgttttgttttgtttttttgtttttttgagacagagtttcgctcttgttgcccaggcaggagtgcagtggcaccatctcggctcactgcaacctctgtccccggggttcaagcgattctcctgcctccgcctcctgtgtagctgggattacaggcacctgccaccacaccaggttaattttttgtatttttagtagagacggggtttcaccatgttggccaggctggtctcgaactcctgacctcaggtgatccacctgtctcagccccgctgagtgctgggattacaagcatgaccacgcccagcccctttattagtttttcatccgatatgattcctctctgtttcagtgcctggctcaggtactgtcagcttctggaagcctcccagttacactctcttccctacctgaaccacctcaggattttgttggtgtccccttgatggcattgtttgtactctgaatgatattgtagttcattgtaagctcttctcacctctttgcttttccctgctagagggttatctccctgcaggcatggacttgtgtttctcatggcttccttatcaagtaatatttaaatgaattgtgaatactatgataaaaaataagaataatagaataatcatgggacaatgtttgagcagtgtatcagagcttaaggagttactgaacaatttaaagaaataaccaagtgagaagatttcgctgacgagaatataaaattaaatcactgaaagggtgtaaaaccattccaatatcataagacagagctcattatctcgatatacagtctacttgggagtggaataagagcctttcttgaaaatgatgtgtccatgtgtagtaaattattctaataatcatggagaagtgaatacaaatctgaacacttgttttactttcttaagttctatacatcataaacaaagatattttctaaatcatgtattttattgaaataccacacatttattcattcaattttgcttgtttttgttgttgttttgtttttttgtgggatttttcgcttagtcaaaactttgtccatcagagaagaggcacattgtcatgtaatgtttatcaatagtaataacaactagaatgtcttagtccattcagactgctataagaaaataccagaaagtgggtggtttataaacaacagaaatttctcagagttgtggaggctggaaagttcaagatcaaggtgccagcagatttggcgtctggtgaggacctgcttcatagataaccatcgttcgctataacttcataaggcagatggggcgaggcagctctctgggatctctttaataatggcactgattttatccccagagggtcctgcctcctaataccatcacactggggattggtttcaacatatgaatttgcagggggcacagacattcagtccatagtagatggcttttggttattggacaactccaacatttccagtgtgtgatcaacagtttatatgatgttccatttaaatctcactataatattattttacagactgaaattgtggttaactgtgagttgattgctgagtgtcaggagctgggctgcaaaccccagcctgataaatgtgaaaccccttgccttcctgggcaaactgttccaagccaggaactccttccccacattactgcccagtgccctttaggaaatgcttcctgcagtcacactcacgataatacctgactgtgaaaagaaggcaacccacagatctcaatgttcaacttttttgttgttgcaggaagagaagttaaacttctagagaaacctaacagacaatatccacaacaggtaagctattttatctttccatgctttggtgagaaaatctattctcttcactttctgttaaattttctatcatttggtcttctgctacagtttttattacctaaaaccttaaagccagtagacacagaagtccccaaagtctccttctttctgactcactcaggtttgagtagaattgctgtttcctttttacgtttgttttttggacatacaattctaaaacgagtgtgataatgcatggttcaaccaagtctccacactgaaaagatttccagttaatctatccccccgtccccaggcaatttcaagcttctcccgtaatgtccatgcctcagaacagtggctctcagcgtgtggtcccgggacctacggcatcagcctcacctgggtacttgttagaaattcagtttctccctggaagaaaacctaggcattaccattcaggacataggtatgggcaaggacttcatgtctaaaacaccaaaagcaatggcaacaaaagatgaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaccaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaatcacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaagatgagttcatgccctttgtagggacatggatgaaattggaaatcatcattctcagtaaactatcgcaagaacaaaaaaccaaacaccgcatattctcactcatagatgggaattgaacaatgagaacacatggacacaggaaggggaacatcacactctggggactgttgtggggtggggggagggggaagggatagcattaggagatatacctaatgctaaatgacaagttaatgggtgcagcacaccagcatggcacatgtatacatatgtaactaacctgcacattgtgcacatgtaccctaaaacttaaagtataataataataagataaaataaaataaattcagtttctcaggccccatcccagacccactaaatcagagggtccaggataacgactagtcctcgagatgattccagtatactctcctgtttaggacccaggtactgtgaatacagaccttccttctctttatttctctctgagtctccttcccaagccctttaccatttccatctttgtccgaacttgcattataatcttctatatatttttactccagtggaaccagcctggtcccctcactctgtgtctcctgaaagtggtgcatgcattattcttgttcccctttgcaaattctagatggtcaagctgcctcctatctgcaaaccttatcttcctttaaggttcatgccattggcctattctgtccttttccctacttgttgcctttatctggggacttcccagtggctctagatcattcaataccataggcccaaagcctttctgactttctgcactctagtcatcctcacttccactacatttcactttccatggccacatcctggaccatgtccttcattgtagacactaatatgccaatgccaccatctcttatggctccaaattctcatgctcaaggatgccaggtcactggtcttgcttttgttccccctaacctcattaggatcctcaccctgcaggactctttcttcttccttagccaacctcttggccacacagccctaaccttttagtgcaggctccaggtccattgcttcagccatgcttgccagcactctcaagacccaagccctgttgccttatacctcaacctgggaccagggtagtaacccacattctataggcctttacctggattgccgggcactgctgggagagggaaagaatgccagaactacatgcattggcatcactcagatttttggtggccagctgaggccaaccctcagcactgctcagctgcctttcagtcgttgctcttcccctccaccacacaccattccaaaccttgtcactttgagctttcacatctagccctttcagcagacaccttgcccctacatcaagaaactcacagcttacagtcttccagcttccctccctgcatctagaactgtctccacttaaaatcacccttgcctctttccctctaggctccaaaggaaaagtgtatatctgtacatctttctaaggtgtatttcttcattagtgatcttgacttgatcctagattttcccccattgtttctactattctcagtttctttcaactatctttttcctccttggcttataaaaggtatttatctttcacctgctacgaaaccatcctataatcctatatctttgttcactgtgactgttcccttcatcttttccatctcagccaagctccctaagagttctctctcctccttttcatatgccccatgcattccttaacctgctgcagcccagcatgcacctccactgctctacaaccttcctgcatttcccaccaacaacctccttgatatgaaattcaggtgcactgttccatcctttccttatctctgaggcacctgacactctttgatggaagactgtctcctctcctgcttcttgataataaagcccaattccctccttcctctctgagcattcttcccaatcctccttatatgctcatcctcctctgcctaagagcaaacaagcagagttaagacttgcaggcaactcgcaagccccaccctcatgagttgaatagttgagaaggcaggaaagacgtcaaaaaatgaattaaataaaactgtaagttgtgctaagaatgtaaagtgaaaggtgatatgaggtggaataacagggtttaaaactggctggtttagattgggtggggtgagaaggcaaaggaaatagtctatgacaaggtccttgagatcaggagcaaaacataaattttaaagacttgaaagaaggccaatgtggccagggaaagaaaggggggacaatacaccagaaagctgtgtatgagatagaaaagacttcatctattattgtataagtttcttattaattttaagtgagttactgcagtcgacaatcataattcactgtagttatgttctataaagtcacttcaaacaaggagttagtgaatactgcacaattgctctcaggggaaatatggggttaggttcctagaagcctctggtcacaatattttcatcaactgatcaatatataacttgttttatgtgtgtttcagttgttaaagcactttatttgcatatgtattgttaattcattaacattgagctcagggctaacagcactatgactcatttctgaacaaagcttatctaacacacacattttctctgtaaggcacatcacagcattcttgcacctaggaccactagacaacacgtcagcactatgcctggggctatttttaacagtgacatcaccaacaaaaagcacaaaatgcaaacaatgggtccatgagaagaaacccatttacagtatggcacagtgccatcttgtttgagctcagctagaaacataagcatctaatgactcaaaatattttgcccactctgcacatgtccaggaatggccacacaagcaccatgagtattgatttgggggttacaaattaacgttagtaagtcagtgaattcacaaatacagaatccacaaataatgagaaccaagtgtatatgtaaagcatatcgatgaacaccaggtacataagaaggaatatgtacatttgatattttaatcatcttcattattgcatgctactaaatatcctgacagcatgagatacctctgaaaagttttaggcaggggaagtgataatgatccagattcatggcctaaaaagatcgtgactcctttgtggcaaatatgttagccagagacactagcaggtataggtgatagtaaggcgatgttgcagtcagtaatccaggtacaaaagagatgatgctgtttgaggacagggcagtgggagtgcacatagttctcctggaatgtgctctggaaatctaccagaaccactgtctgcccacctttgcccacaagccttttctaatcttcctacggttactccggagctccttgtcctatatagcatattatatgacatatttgaatctagtacttatgacactatattagtcatgtatctatatacttgtctcctttcctggacagtaaactctttctacatccctggaatcaagttcggtacttggcacataataggtgctcaggaaatatctgttgcctgaatggttggtgagtcatttaacaaacagcagagatcttctacctcttagtgtcttagcaattagcagagtgtcttacccctagtaggggggtgtttaaggcctctaaaccgtgctcagtctttccaagtgcaaaacctatttttactgtactttaaaggaatattgggttccaactctgcacacgtaggttcatctacaattaggggacaaattgtaggttttttcttgtcttccgaccagttcttgcttccagtcttgagtccggaaaaacatttataaaataaaatagttgggtgggataacttctaagattctttcaaatcagagccctatatcactctgctaaggctaccataacaaaatactctagactgggtggcttaaacaaaagaaatttattttctcagagtcctggaggccgggaggtccaagatcaagaagtcggcaaattcgattcccgggagagctctttccagcttgcagatgccgccttctcactgtgtcctcacgtgccctctcctcagtgtgctctggacccaccagcaccattcgctttcgctcacaagccttttctaatcttcccgaggttgctcaggagggagtgctctctctcctcttaaggccaccaatcctcttatgttaggaccccaccctgatgacctcatttaaccttaattacctccagaaagccctatctctaattacactcacaatgagttagggtttcaacatgtgaatttgggggaagacacaattcagtccacagcgggtactgtaagactctgggaattaccctgaactagtttattccaagcaggtggccctgagctgtgcttcctttaaaatctatttgtagccttaccagactatattatataaactcctctccacatggccacctctaaaacttcctcagcatttttagaacttaattttgtccaaatgcttcaagtttcttccagatgtctgccatctcccagatacagctacttagcaaaatcagagacattccctgtcatggagacacggcccagttcccatgtggttccagggaagatttggtcaaaacattgcccatttctacacagtgtctaaatggaactagcacccaatggttaaagaatattctcagccagggacagtggctcacctctgtaatcccagcgttttgggaggctgggacgggtggatcaccggagatcaggaggtcgagacccgcctggccaacatagtgaaaccctgtctctactaaaaatacaaaaaattagctgggcgtggtggcaggcacctgtaatcccagctattcaggaggctgaggcaggagaatcacttggacccgggagtcggaggttgcagtgagccaagatggcaccactgcactccagcctgggtgacaagagtgagactctgtctcaaaaaaaaaaaaaaaagaaagaaaaaaaaccgaatattctcgcagacaattgccatgaacatgcaaacggccaacatttcctaagcacctactatttgcaagacacatattgccagccctgtcacatgcttaagtcatgtgatcctcataggaccctgaccagtacttctggtaatgcagccataaaaatgaaagttaccatgcactgatgccaggggtgtctgacttttttatttatttattttttttgagatggagtctcactcttactgcccaggctgcagtgcagtggcgcgatcttggctcactgtaacctccgcctcttggattcaagtgattctcctgcctcagcctcccaagtagctgagattacaggtgtctgccaccatgaccagctattttttgtatttttagtagagatggggtttcaccaagttggccaggctggtctcgaactcctgacctcaggtgatccacctgcctcggcctcccaaagtgctgggattaaaggtgcgagccactgtgcccagcccggtgtctgacatttttcagcagatcctttagtaatgattgatgctgagcttgttagaaacacaggctgtcaggccccactcagagccaggtggattcctcatgacccagtgccctgtgctcctatctgtctacaagattccaccccgtacacacacacacgtacacacacacacacagacacacacactagtctttattcattaacaaactacatcttgtctgctccaaacaggagcctacttccaggaatttacagtccagagaatagggacatagcttctcaaacttttcccttaaactgtccccacgagggtacaggaggatctgggaggctggggagtgtggagaggatgaccacaagctactggcagaacttgacatctctgtgtgccttccgtttcattctagtcattcacacaaatgttgccttttcacccatgatattctgagttaattttatataacaaataatgggcttctccccccaaaaccttcgcatggggccatatttattttgtggcttacctttccctcccagctcatggccatgtatcctcatgtagaagggggggctctgagattggctcacaacacgggcagcctctggatctgggagaagtgcaaggtcagccatggaggaggagcagcaccgggtctaatctgggggaaggaacaggacccccttgactccacagacaccttcctcccccaggctcttccacagagttattgtccaaatgtacagtgggcagagaccaacccagatggagttctgatgtgcagtgattgtgtgaagaggcctctgtagaatttcaggagccttttgaccccaccattgcttggccagaccagaataaacccaatgtctagccagtgctagaggaagccctggtctcatcaggcttaaaggtgacagtaactgtgatggttaatattgagtgtcaacttgatgggattgaaggatgcaaagtgttggtcctgggtgtgtctgtgagggtgctgccaaaggagattaacatttgagtcagtgggctggggaaggcagacccacccttaatctgggtaggcaccatttaatcagctcccagcgaatataaagcaggcagaaaaacgtcaaaaggtgagactagcctagcctcccagcctacatccttctcccgtgctggacacttcctgcctcaaacatcggactccacgttcttcagttttgggactcggactggctctccttgctcctcagcttgcagatgagctattgtgggaccttgtgattgtgtgagttaacacttaatattacctcccctttacatatatgtctatcctgttagttctgtccctctggagaaccctgactaatacagtaaccatctaaaataccacatcacctacttcataaccttgccgcatagcacaacacctacactacttgggccataatttttgtttctttttttgttcttttttttttattttatttttttttgctttttgagacacagtcttactccatcacccaggctggagtgcagtggcctgatcttggctcactgccacctccacctcccgggttcaagtaattctcccacctcagcttcctgagtagctgcgattacaggcgcacatcaccacacctggctaatttttgcattttcagaagagataaggtttcaccatgttggccaggctggtctcgaactcccgacctcaagtgacccacccatatcggcctcccaaagtgctgggcttataggcacccaaaattcttgtttctgaggctttttattttattttttgagacagagccttgctccattggccaggctggagtgcaatggcacaatcttggctcactgcaacctctgcctcctgggttcaagtgattctcctgcctcagcctcccaagtagttggactacaggtgcaccaccacacccagctaatatttgtatttttagtagagatagggttccaccatgttgggtcaggctgctctagaactcctgacctcaagtgatccgcccaccttggcctcccaaagtgctgggattacaggtgtgagccaccgcgcctggtcctgaggcctttcttgtaccaagtccttctcttgagatgagtaaaataaccgctatatcctgccatctgctggtgaattgatgcaactgcacctataaaattcagcccaaatctagagaatccagttctctcttgcaaaagctattggagcacaaactgcttcttgcataatccagcggacaaaaaaaaataaaataaaataaaataaaataaacttactaggatggatgccagaaatattatagtaataaaaacaataacaacattaataataccttcactatcctactttcaacttttacaaccttgggcaagcaagttatataacctcccatttagttatctataaaatactggttcccaccttaaagggttgttttaaagttgaaatgagttaatacatgaaagatgaaagtccccaaaacagtccttggcacatagaaaacactcagtggctaactgcttattgtgattaagtactggctgtatgccagacattatagcaagcgctatgcatacttatcttagtgttcaaaacaatcctcataaactgtaactatcatcattcgcgtgttgcagattaggccactgaaactcacggaggggaagaaacttggctagaagtcacaaagctagtaagcagtggaggtggaattgctgactactctgatcctaagtcactcgcttaaccactctgctgaactgctggtgtggtgtgatcaatcttcctgaatgttcgtctaaatgccatccggcttcaccagaatcaatctctctctctctctttctctctcacacacacacacacgactatacgctctcccagggagcacccgggtgccatcatatccccagaacctagcacagtgcctggtgcataccaagacccagtggagccatcgtgaagtcagcgatgttgcacacagctgtgagcattcgtcacacacctgtcttaaggatagcaggctaattactagatggggggaaaaaatagtatcagatcttgaataaagggccacatgaaatgtttttcaatctatgaaaatgtctgtgatatgctatcgtaaagactacaggagggacaaaaggagtgacatcatcactatgttgtaataacaacaaaaaaaaccacattgaatgtgtttccacattcaacatggatatcaaagatcctgtgaacccagcagcaagaaagtcctaggaccaggccctggcctgttcctcagcattcctacagtggaagcacctctcaggtgcacagggccggcaaggccagccttggtaaaggctagagaggcagcccttctagtggtatgattccagagggttcagggccacctgtcactgagaaacaccaatttcaacccagacattctaccctcagaggctgatttctttggctcctgggaacttatttttttacatagttttctttaaaatgcaggaacaccaggaggcccagggttgccaccagtgctctgaaaaccactctgccctcctgcctggcagcatgcacctctcagcccattcccagtggagaaggggggtcactttctccatcaggagtctccctggtctgagagcctcgtccctctcagggactttgctgttacacacattctgtcccaatctcacagttcctcctggcagaggctgaagaggcatttccaaaagagctgcagagttcagggaataagacagagaacttggccttttatcattcagtcaagatcatggcctggggtgagtgtggacgtaggacccagagggcagtattgcgaagagctagttcacaaaccactgggcgtggtgccccacgtgcagcacggaagtactgaagcatgccttcagcataattctcaggatttgatgtgataacaacaaggaaatcaagtcaatgagttgaagttccccttttttcccactttatcgtttagattgttaaatttcaaagagagctttgattcacaaactcgttttgcagataaagaaactgaggactcaagagattacagcctgggcaacaagacaaaatcccatctctaccaaaaaaattaataaataaaaatagctggacacggtggcgtgtgcatgtagttgcagctactcaggaggctgaggtgggaggattgcttgagcctgggaggcagaggttgcagtgagccgagatgatgccactgtgctccagcctgggtgacagagtgagaccctgtctcaaaaaaaaagggggggagagattaaacaacttcaccatgtccatgccattggtgatggcgttatggctaggaggtaagaagtgaatttctttatttttattttattttattttattttgagatggagttttgctcttgttgcccaggctggagtgcaatggcaagatctcggctcactgcaacctccgcctcccaggttcaagcaattctcctgcctcagcctcttgagtagctgagattacaagcacctgccaccacgcccagctaattttttgtattttcagtagagatggggtttcaccatgttagccaggctggtcttgaactcctgacttcaggtgatctgcctgcttcggcctcccaaagcgctggggttacaggtgtgagccaccacgcccggccccgaggaggtggatttcttatacctgggcacagactttgcctggctaagttcacccaaacaccatatagcttaattagtttgaggagtaaaactccagtgataattaggactgtcattttgatagcagatttttcagaagtattctacaaaacatgagatctgttggttgttaataagtttgttatgagaaaaaaagttctgtagcccaataatgtagggaaataatcgggttaaacagagtgaaacagttccttctcataaccatgaatttcttcatctttaatttctgttgttcccaaacctgttttgaccagggagccttttccagggagaaaacccatgagcacttccctgcacacaaatatcccgtcaaagccagcgctagaccatgctaacacttctatcccagcacactggctattgagaatgcatgaaatggactatttgatggtgctgataacaaaagtctgcatataatccttttttttttttttttttgagacggagtctcgctctgtcgccccggctggagtacagtggcgccatctcggctcactgcaagctccgcctcccaggttcacgccattctcctgcctcagcctcccgagtagctgggactacaggcgcccgccaccacgcctggctaatttttttttttttttttttttttttgtatttttagtagagacagagtttcaccgtgttagccaggatggtctcgatctcctgaccttttgagccgccgacctcggcctcccaaagtgctgggattacaggcatgagccaccgcgcccggctgtctgcatataatctttcaagttctctaaaataacagaagcttagcctctgtaggagaaaagtaaacacatcagaaaaatttgtcccgtgagttttcaaagactgcccaaaagagtaggaaatgtttctgccaaaaaaaaaaaaaaaaaaagattgagctgtcaaagagtttatcttctagtcctttttcaactatagattcattactgtctataatgttgggcaagcagtctctagtttcttctataaaggcagcacagctcctggtagttatttttattcattcttcttgggtcaggacctcagtccctagtagcggctcactaaatatttgtctacttcgccttctggccaggttatgtgaaatctcaagctgtgttttctaaacattagcaaattgttggaaatttacatgttccattctattgtatctcctcccttccaaatactccaacttctataaacgcaaaccacctcccagcagccactttaaaagtttgttgaatagaacccttggagccggacgtccttgacccttggaattgcataatagaggttttgctgtctcccaagatgggaagggggaacaacagtctctcccatttctccgagctcctgcctccggcttgtagtttggaccactgggtagtatgagatttgattgtggaaaagggtatagaccctctgttagaatagtttatcatatctcatacccatcatgccttcattcccacgtgtcattcagcgccattccttcatttaaatagtaagaatgaagtgccccatacaagctagatgctggttggattaggcattgcctgtggggagctcatgtgtagtagggaaggcagacagccaacaagcaccaaagtccccctctaagatgcaacaacagcctgaagacaggaaccataccctttatttgcctctagagttctcatcctgggactatatatggtcttcagtatatacacaggatgatgtgtaggttggtagacttttgatgagctgccttccaagatctctctccatggtctaatttatagagactattatccttttttttttttttttttttttttttgagacagacctcactctatcatccaggctggagtgcagtggcacgatcttggctcactgcaacctccacctcccgggttcaaacgattctcctgcctcaccctcccgagtggctgggattacaggtgcctgccaccgtgcccagctaatttttgtatttttatttttattttttgagacagagtctcgctctgtcgcccaggctggagtgcaatggcgtgatctcagctcactgcaagctccacctcccaggttcacaccattctcctgcctcagcctcccaagtagctgggactacaaatgcccgccaccacgcctggctaattttttgtatttttagtagagacggggtttcaccgtgttagccaggatggtctcgatctcctgacctcgtgatctgcccgcctcagcctcccaaattttgtatttttagtagaaacagggtttcaccatgttggccagactggtctcgaacttctgacctcaagcgatcctcccacctcggcctcccaaagtgctgggattactgacgtgagccgccacacacagccatatagggaatatcttaataacatggatttcctggaggtgtcaagtcccagcccaggttgtgacaggcagagtaagaactgaccttagattcacacgtttgtttttaacttcacaccttttttttttttttctttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttttttagtagagatggggtttcaccgttttagccgggatggtctcgatctcctgacctcgtgatccgcccgcctcggcctcccaaagtgctgggattacaggcgtgagccaacgtgcccggccacacctttttagaacattttattttgacattatttcagactaacagaaaagttgcaagaaaaatgcaaagaatccccataaatcctctacccagagtccctaaacatgaacatctaccacatttgctttgttgttctctctgtctttatatacacacaattttttttctgaatcattttaagcagttatataaaccatggtcctttagctctcaaatcagtttgattatcctctatccaaaatgcttgagaacagaaatgttttagagtttggatttttttaaaattttggaatatttgcatgtatatcatgaaatatcttaggaatgggaactgagtctaaatatgacattcaaatgtttcatatataccttttacacatacctgaagataattttatatttttaataatttgtgcatgaaacaaaatttttacttcgttttcactgtggcctgtcacatgaagtcaagtgtggtatcatgtaggtgctccaaaagtttcagaaatgggagcattttggattttggatttttggatttcagatgctcaacttttactttactgtgtatttcctaaaaacaagggcattctctttttttctgccttcttcccaacattgtattgtattttcaaacatatagcaaagttgaaagaattttgtagtaaatttctgtatacccaccaccaatccatcttatattttgctgcatttcaaagtaagttgtggacctcatgtatttcccttctctgctttcacttaagcatgtatatcattaatgagaattctgtacgtgtttgcattttttgaaatgactttcattacaaaagtaatgtgttcattgtagaaaattggtaattgcagatttaaaaatctacaaatctatcagttagtagtcatttgtaccagatattgtgctatgtattttatcaacatcatctctagtcatcctttcacaaaccctaagaagaagcattatccccattttacagacaaggactctgtgagcaagttgctgcagttcccacagtggcagaatcaggatatgcatccaagtctgtcccatcccctgactctcagctgcatgccatcctgctagccttgtgtctactccaccccactctgagataaccactgttaacccttctctctcaattcttttccaggtgtgtagatttccacaaaactgtgattatattatacaagtcattttgtaactggcttttttgcacatatgcaaacctctttctccagcaccttgttaatggctgcagggtattctgttgagtaaagataccatatttaagagctaccttattgttatttatttttcaagttttcactattatgaaatcttcttgcatactactaattttatccttagggtcacaagtagaattgctgagtcagagattatgcatagtttccactgttaatacagattctcaaatttgctttcaacatctcctaccagtagtaaatgactagcagatttccctacatcctacactgacatcaagtatacattttaacaactcatttttatctgggtgcagtggctcatgcctataattccagcaccttgggaggccaaggtgggtggatcacgaggtcaggagttcaagaccagcctggccaagatggtgaaaccccatctctactaaaaacacaaaaatttgctgggtgtggtggcacgtgcctgtaatcccagctactcaggaggctgagacaggagaatcgcttgaacctgggaggcggaggtagcagtgagccaagatcatgccactatactccagcctgggtgacagagcaagactccatctcaaaaaaaaaaaagaaaaaactcatttctagttagataagcaaaaacatgtatgttttgtttagcatacctttgattgttaatcaagttgaacatattttcacatataaggctttccctttcatatactacttgttcaggtccacacggttctttttttaagttggtctcttgaataattccaacccatttcacattaaagccaatgttaagagtgaaatttttatttttcaagcagattttacttcatttatttttattttaagtttttaaaattatttttaatttttgtgggtacatggtatatatatttatggggtatgtgaaatattttgatacaggcttgcaatgcataataatcatatccaggtaaatgggatacacattgcctcaagcatttatcctttgtgttataaacaaacaagtgatattctttaattatttttaaatgtacaattaaatacttattgactgtagtcacctgttaagctatcaaataccaggccttattctttctttgtaacttttgctttgcccccattagccatccccacttctctttcacccccacccccaactatccttaacagcttctggtaaccatctatctactctctatctcctgaagttcaattgttttaatttttggctcccacagataagtgagaacatgagaaatttgtctttctgtgcctggcttatttcacttaacataacaacctcctgttctatccatgttgttgcaaagtaaaggagctcattctttttcatggctgaatagttctccattgtgagaactctataccacattttctttattcattcttctgttgcttccaaatcttggctattgtcaatagtgctgcaataaacatgggagtgcaggtatctcttcaatacagtgatttcctttctcatggatatatactcagcaatgggattgctggatcatatggtagctctgtttttagtttctgagaaacctcaaaactattctccatagtggttgtactaatttacattcccaccaactgtgtatgagagttctcttctccacatcctcaccagtatttgttgttgcgcatcttttggataaaagccattctaacagggttgaaatgatatctcattgtagttttgatgtgcatttctctgatgatcattgatgttgagcaccttttcctatactgtttgccatttgtatgtcttcttttgagaaatatctattcagatattttgcccatttttaattggattcttagattttttttttcctgtagagttgtttaagctccttacatattttggttattaatctcttgtcagatggatagtttgcaaatgttctctcccattctgtgggttgtctcttcactccgttgattgttttctttgctgtgcagaagctttttaacttgatgtgatctttgttgtccattgttgctttgggtgcctttgtttcttgggtattactcaataaatctttaatcagtccaatgtcctggagactttcccttgtcttcttgtagtagtttcatagtgtgaggtcttagatttatgtctttaatccattttgacttgatttttatatacagcaagagagagggatccagtttcattcttctgcatatgaatatctagttttcccagcaccatttactgaggaaactgtcctttccccagtgtatgttcttggttcctttgttgaaaatgagaacactataagtgtattgatttgtttctgacttctgtcttctattggtctatatgtctatgtttttatgccaaaaccatgctgtaccgattactatatctctgtagtgtaatttaaagtcaggtaatgtgattcttccattttgtttttttcgctcaggatggctttggctagtctgagtcttttgtggttccacatacattttagaattgttttttctatttctgtgaagaaatgttgatagagattgcatgggatctacagattgcgttgggtagtatggacattttaacgatattgattcttccaatccataatcatgaaatatctttctaatttttgtgtcctttttaatttctttcaccaacattttatagtcttcatagtagagatctttcacttttttggttaattgctaggtatttaattttatttgtatctattagaaatgtgatttttttcttgatttcttttttggattgttcactcttggcatatagaaatgctacaggtttttgtatgttgattttgtatcctgtgactttacttaatttgcttatcagttctaatagttctttggtggagtctttagatttccccaaatataaggttgtctcatcagcagacaaaggtaatttgacttcttcctttccaatttgcatgccccttatttctttatgttgtctgattgctctagctaggacttctagtactatgttggataactgtgatgaaaatgggcatccttatcatgttttagatttagagaaaaggctttcagtttttccccattcagtatgatactagctatggatctgtcatatatggcttttattatgtcgaggtatgttccctactatacccagtgtttttagggtttttatgaagggatgttgaactttatcaaatgccttttcagcatcagttgaaatgatcatatggtttttgctcttcattctgttgatatgatatatcacattgatttgcatatgttgaaccatccttccatccctgggataaatcccacttggtcaacttggtcataatgaatgatctttttaatgtgttgttgaatttggtttgctagtattttatttaggatttttgcattgacactcatcagggatattggcctgtagttttcttttttttgatgtgtctttgtctggttttggtatcagggtaatactagcctcatagaatgagtttgaaaatattccctcctcctctatttttgagaagagtttgagtaggattggtattagttcttctttaaatatttggtagaattcagcagtgaagctgtcaggtcccaagtttttctttgctgggagactttattacaactttgatcttgttattggtcagttcaaattttggatttcttcatcttcaatcttgataggtggtatgtgtctagtaatttatccctgttttctagattttccagtttattgacatataattgttcatagtagccactaatgatttattgaatttctgcagtatcagtcgtaatgtcttccttttcatctgattttatttatttggatcttctctcttttttcttagtctggctaaaggtttgccagttttgttatcttttcaaaaaaaaccaatcttttgttgatcttttgtattgttttcttcatttcaacttcatttctgctgtgatctttattatttcttttcttctgggtttggtttactgttgcttctctagttctttaaagtgcattttaggttatttattccaagtttttctttgtttatgtaggcctgtatagggataaacttccctctaagtactgcttttgctggatcccatagattttggtctcgtgtttccatgatcatgtgtttcaagaatttttttcagtttccttctgaatctcttcattgacccagtgtttatttaagagcttattgttgaatttccatatgttcatatcatttccaaaattcctcttggtattgatttctagttttactccattgtggtcagagaagatgtttgatatcatttcaatttttttgaatgttttaagacttgttttgtgacctaacatatggtctatccttgagaatagtccatgtgctgaggaaaagaatgtacattctacagcagttggatgaaatgttgtgtaaatatctattaggtccgtttgatctacagtacagttaagtgcaatgtttctttgctgatattctgtgtggaagatctgtccaatgctgaaagtggggtgttgaagtctccagctattgttgtattggggtctatccctctctttcgctccagtaatatttgctttatatatctgaatgctccagtgttgggcgcatatatatttacaattgttatatcctcttgctgaattgaacccttcatcattatgtaatgaccttctttgtctcatcttaaaggttttgtcttgaaatctattttgtctgacataagtatagttattcctgcccttttttggtttccattggcatggagcatctttttctatgtctttattttcagtctatgtgtgtctttataggtgaaatgtgtttctaataggcaacagatcattaggtcttttgaaaaatctattcagccactctatgtcttttgagtagacagcttagtccgtttacatttgatgttatgattaataagtaaggacttactcctgccattttatttgttttctggttgttttgtggtcttcctttccttcatttcttcttttctgtcttccttctaatgtaggtgatattctctggtgatataatttaatttcttgattttaatacttttctgtattcattgtatgtttttttaatttgaagttgccatgaggcctgcaaatactatcctaaaacccattattctggcctggtgcggtggcctgtaatcctagctctctgggagacagaggcaggtggatcacctgaagtcaggagtttgagaccagcctgaccaacatggtgaaaccccatctctactaaatacaaaaaaaattagcgaggcatggtggtgcacacctgtaatcccagctattcgggaggctgaggcaggagaattgcttgaacctgggaggcggaggttgcagtgagccgagattgcgccattgcactccagcctgggcaacagagcaaaactccgtctcaaaacataaataaataaataaccattattttaatttgataacaacttagcattgcttgcataaacaaaccaacaagaaaaaaaaccaaaaacaaaaaaacaaagattctaacttcatcccctcactttttaactttttgttgtatctatttacatattatcgtacagtctatgtcttgaaaaatttttgttattatttatgattggttcatcttttagtctttctattcaagagacatttacataccacagttacaatgttataatattctgtgtttatctgtttgcttatgattaccagtgagttttgtacctttagattatttctcattgctcattaacatccctttctttctgattgaagtactccctttagcatttcttgtaagatagaactggtgttgatgaaatctctcagcttctgtttgtctaggaaagtttacttcttcatgtttgaagactatttttgccacaaacactattccagtgtaaaagttattttccttcagcactttaaatatgttatgccactgacatgtcatatctctcctggactgtaagatttccactgaaaagtctgctgccagatgtattggagcttcattgtatgttatttgtttcttttctctgctgctttcaggatcctttctttatccttgacctttgggagtttgattactaattgccttgaggtagtcttctttgggttaaatctgcttggtgttctgtaaccttcttgtgcttggatattgatatatttctctaggtttgggaagttctctgttattatctctttgaataagctttctacccctatttttctacttctccttatggccaataactcttagatttgcccttttgaggctattttctagatcttgtaggtgtgcatcattgttttttattctttttttcttctgtgtcctctgaatatatttttaaatagcatgtcttcaaggtcactaattctttattctgtttgattaattctgctgttaagagactctgatgcattcttcagtatgtcacttgtatttttcaactccagaatttctgcttgattattttgtttcaatctctttgttaaatttatctgatagaattttgaattccttctctgtggtatcttgaatttctttgagtttcctcaatacagctattttaagttttctgtcagaaaagtcatatatctctgtttctctaggattggtccctggagctttagttagttctttcggtgaggtcattttttttttttttttggatggtcttcatgtttgtggatgctcactggtgtctgggcattgaacaattaggtattcctcatagtctttccagtttgggcttgtttgtacctgttcttgggaaggcttttcaggtattcgaagggacttgtgtgttgtgatctgagccatatctacattagaggcaccccaagcccagtaatgctatggttcttgcagactcatagaggtatcaccttggtggtcttggataagatctgaaagagttcactggattaccgggcagactcttgttccccaaacaaaagtttctctctctgtactgagccacctgaagctggggatagggtgacacaagcacccttgtggccatgatcactaggactgtgctgggtcagacctgaagccaacacagcactggatcttacccagggccctctgtaaccactagctagctagctccaatgtttgctcaaggccctaaggctctacaatcaacaggtgcaaagccagccaggcttgtgtccttcccttcagggtgacaagataccccaggccctaagtgggagctagggactgaagtcaaaatccttagagatctacctggtgctctattctactggggctgagctgtcactcaaaccataagacaaggccatttccattcttccctccccttttcccaggcaaaggatcctcttcctatcaccattactaccacaggcccacagagagtattgccaggctactgccgatgttcacttaaggcccaagggctcctcagacagtttatagtaagttctgccaggcctaggacacatccttcagggcagtggacttgcctgtggtcaagtgcaaatccagaaatgccatccaagagccaaggccttgaattagggactccaagagctcgcttggtgctctaccccactgtggctgagctggtacctaaagtgcaagacaaagtccactttacttttccctctgcttttctcaagtagaagtagtctctccccatagccaccacagctaggaatgtgctgggtctcacctgaaaccagcacatctcagagtctcacccaaggcccatagcgtactacctgggtattcctgctggttattcagggcccaagggctctccactcagcaggtgatgggtcttgccaggacttggtccttcctttcaaggaagtgcagtcccttctggcccagggtgtgtctataaatgtcatctaggagctggggcctggaatgggggcctcatgactctgcctggtgccctatgctaatgtggctgagctggtatcctatggtgtaagacaaagtcctctttactcttccctgtcttttcctcaagcacaaggaaggggtcactttcattgctgtgagctgtgctgcctgggttttgggacacgtgacacaggttctcccttagccactctggtgtctcagtagatcaggtgcccccccaggtccactggctctggccccagcacagtactgatatcttgcctaggaaccacagttcttgtggcctaggctacccttcaagtgtattaggattgcagagcactttagtccatggtggtgcggcttgccaaaactcaagttccaacaactggaatatataatttccctctggctagatctggtccaaatgctccctctgtgtgtgggtaggctggggggtcgtggcttagctgatttcagcctggttttgctttctgctctgatagggcagcactgagttcaaacgcaaagtccccaaatcactgtactctccctcccccaaacacacagatgctctctccacgacatgcagccactgccaaggaatgggcagcggcagttcaagattgtctttcctactaccctctttagtgcctctttcagcaatatgaagttaaaaccaggtacactgattgtgtacctgatttttggttcttataaaggtgcttgttggtgtagatgatagttgttaaatttggtgttcctgtggggcaatgaagtgaacatcagtggaggcttctatctggccatcttgttctgcccttccccaagagcattctcttatataaccccagtacaatgttcaaaagcaggtaattcacatcaatttaatacgattacctaatctacagaccttattcagattttaccaattatgtcaataacgaccttttagcaagaaggacatgcagtgcatcggctgtcatgtctcttaaatctccttgaatttggaagcattcttctgtctttctttgctttttcataacattacattattttaagagtacaggccagttgctttgcagactatccctcgttgtttcaactcagagtatgctcttttgtcaggaaatcacagaagtgaggctaagttctcagtgcatcctatcaggagccacatgccattgattagtctcattatggcactattacctttgattacttggttaaggcgctgtatgccgggtttctccaacgtaaggataatattttgtccttaatcatatgggggggagctactttaagactaaatatcctgtcctcctcaaaatttcacccactagtcctaccatccattgatacttcttactgacatcaattattattatgatggctatcaaatggtttttctattattatgatggctatcaaatgatttttctagttccagtatttctcgtatgtttgttagctggtttcctacttgtaaggtagagtgttccctttccctttatgtatcttagtgtggactcataagtccttgttttattcaattggctacaaatgctgtagattagtaattattttaatattccagttgttccacatttggccagtaaaacttctacaagtggattcctgtgtccttttaaaatgtccctgtcattcttcaaagctatcactatttaaaggcagcttccagatgggttgagtcttttcctatatgcccttgacttcctaatgaatactcagttaatttctctgcctggctggagaactcctgggcttccctggacttcgcccttcccctacctccattgctaccctcccagcaaggaggcttcaccaatgactgacatggcattagcatggccttctttttttattgtttgtttgtttttgtttttgtttttttttttttgagacggaatctcgctctgtcgcccaggctggagtgcagtggtgcgatctcggctcactgcaagctccgcctcccaggttcacgccattctcctgcctcagcctcccgagtagctgggactacaggcgcccaccaccacgcccagctaatttttttttatttttagtggagacggggtttcaccgtattagccaggatggtctcgatctcctgacctcgtgatagcctggccttgtttaaacacaaaacagagtcagcccccaacacagggctgcagaagcaggcggcagcagcattgggtggacacagccatcctaatggtgtttgtttttcccctgtgtaaactaagaagtggttgtgaaggattttccctttgttgcctgttgcttttttatgctccaaagaggaagcaaattttgattttgctcagtaataaagggtacccaacaactgaattcttacctttaagctagctgttgccaaaagggaggcaaggaagacagctgatagactgctcattttgaacccaatcttacgtcaaaagagcatatttttttcattgctgtgtgtcacatgctagacccggagcatttccttgttgcccctgggcttaggagaagtccttgctaaatgcaagatgtagaagtgggagtgacatatgaaaaaagaaatgaattaaatttgatatgacacatcatataaggaagaataattgtagacacaggcatgcaggggttgggtgtgagtacattagtccccacccttttcgtcagcagtcacacaaccttggacattagagcctgtccgtctgatctagagaaggaatgttgctggggaaggaaaactcagggcgaggtgagagaggacagaacctctaaccaggaagaggctgtccccgccaagctccggagaggcgcggaagcatgaccctcaggtatgggaccaggtctataggaaacccatgtggtgtgccctaatgggaggcaagccggggaggacccaaactggaaacctgattctgaaagaggaaaaccaccacaacatcctttgtaattgtgcagcttggaagaacagtatagatcctgtggttttcctggggaaggaggggagcctaaaagccgcaaatgatgtatatttccttcagaagcagggaaggggcagttttcgagtacggctgttaaatctcagcactcacttcattcggtgcaggctgctcctgtggtcttggctatagcagcagaaggcggggatggagggtgccccagggtcaatcttggtcagcctccgaggagctgggagtgcaaggtgtcactctggatgtgcctgcctgcttttcctcgccttcttgccctccttcgcctttcctccctcttttctttcctcctttctttcgccttcccctgtacacctcttgaattcaccatcataaagttgacctgagatgtttcaatgagtaatgttttatgattgcttcagttacattattacaatccagtctgccttccttgtttctcaaacagttctaagctcttttctccttttctttgacttgtttttttttttttttttactacctatcctcctgactagttgttgttgtttgttggttggtttgcttttaaagagtccaggataaacaaagtattgcaggcatgaaaagggtcaggatttcagagcgaattgtggagggggagggtcaggaggggaggggagaggaggggagaggagaggggagggtggaggagaggtattgagggaggggaggggagaggagaggtattgagggaggggaggggagaggagaggtattgagggaggggaggggagaggagaggtgttgagggagaggaggggagatcagaggtgttgagggagaggaggggagaggagaggtgttgagggaggggaggggagaggagaggtgttgagggaggggaggggagaggagaggtgttgagggaggggagggtagaggagaggtattgagggaggggaggggagaggagaggtgttgagggaggggagggtagaggagaggtattgagggaggggaggggagaggagaaatgttgagggaggggaggggagaggagaggtgttgaggaaggagaggggagaggagaggtgttgagggaggggaggggagaggagaggtgttgaggaaggagaggggtgaggagaggtgttgagggaggggaggaggtgcacgtgcttcttctcgcctgtcctatttatccagctcatctatgaattatcagcagaaaaggaaagtaaaggaggagtagaggctgggaataaaatcctgggctttagaaatggggtagtttaagagtattctgaaaggtacaatgttacacatgtgtacacagttccatagcaaaagcgatttttctgtctacgggactgttgttgtacttggggttttctatctttcaattggtgtcacagttgatagaaatataccatgtagcccttattccagaaacaagtcctacttgacattgttaatactcttgtttgtatgcataggttctggcaactagattatatctttcttggatactagacctccatctttttctttttggggggtgtgttttaatatgctgtatccaaatggggtggttaagacacccctggtctatgtttattatgaatgtttgctcatatgacccccagcaacactatatagtaggaatattattatccccatctacaggccaagtgactgaggcccaaagtcccacagtagcagggttttctgtctcctgagcccaccctcataacacctgggcgacacggctggcacaaactggaaatgtcttgattggttgcagacacacaacaggttcactgatagtgctctcgtttttaatccatagccattaaatcattcattcattccacatttattgactgcctgctctgtaccaggtgctgtcctaagtgctgagaattagacttgaagaagggtggagcacggtaaggaaagagggtggcaagagatgcacggctggtccgagggactcttctacattccatgagtcctcccaggaagagttggaaggacaaggggtttggtcctcaagcatgaagtgatttggggatgttactagttttctgtgctgctgcagcaaattactacgaacttagaggtttaaaaaaatggaagcagccgggcatggtggctcacgcctgtaatcccagcactttcagaggccaaggtggatggatcacctgaggtcaggagttcaagaccagcctggccagcatggtgaaacctcatctctactaaaaatataaaagttagctgggcgtgttggcaggcacctgtaatcccagctactggggaggctgaggcaggagaatcacttgaaccagggaggcagaggttgcagcgagccgagattgtgccattgcactccagcctgggcaacagagtgaggctctgtctcaaaaaaacaaacaaaacaaaacaaaacaatggaagtttattctctcccagttctagagaccagaagtctgaaattggtatcagtgggcttgatccaggggtgggtatcagggatcaaggtgtcaccggggccacactctttccagaggctccaggggtgaatctgttccttccctcttccagcttggggggctgccagtactcttggtttgtgacctccttgctccaatctctgcctttttggtcacattgcctcttcctcttctgtctataatcaaatgtccctccacctccttctcataagcatttatttaattgtatttagagtccacccagataaactaggcaaattgtaccatctgaaaatcctacacttaatcacatctgcaaatacctttaatttgggggctggggtggcatataaggtattatttataggttccagggattaggatgtggatatctttgggggccatttttcagcctaccatagggagttatttgtggattttatttttttaatgtaaatctagtcccttttaactaagcaaccaatctgtacttcttaaaaagcaccagtcatattcactgtggacaaaagcttatgaagcagcatccctggaaattcacctatgattgaaagaaggaaggagggacaacatgggagacagagacacagccagcaatgaatgatgtctctttctggtgcatgtgcttcatggagacagggagactggggatgcagattctgttttggcttgtctttttaaaggctgtaggcccgtcacagtggctcatgcctgtaatcccagacctttgagaggccaaggcaggcagatcacttgaggtcaggagtttgagaccagcatggccaacgtggcaaaaccctgtctctactaaaaatacaaagattagccaggcatggtggcacccgcctgtaaacccagctacttgggaggctgaggcaggagaatcgcttgaacctgggaggcagaggttgcagtgagccgagattgcgccactgcactccagcctgggcgacagagtgagactgtgtctcaaaaaaaaataataaataaaaataaaggctgtagatattagaaatgaataatatctaagagatgcttccatactcatttttaggatgttctgaggaaggaagaggccaacatggtcagttttatatgaagagaagattttgttccaaaggaaatgatggggaaaagcccagcttggggaggggtcagggaacagtgggcaagtgggaaatgagtccaccttctgccaggaagcccaagggggcatgtctttgagctgcaaaagaacaggtccacaaatcatagctgagattggcccagcggtaggaaaagcaacacagaatcaatttagtgtggttgaagcttgtgcgatgactcgggctatcacgctcctcagggcctgaatcatgggacacaatggatccgccagcttattccggcatcctttaactcttgaggagcaaatgccctggcaaggaatccgtcagaatctccttcccctcctgctgctgcgtgcagtgggccgtgccctggtgaggttcctgtgtcctctgtagaaggtaacagattagaaaagcagaagtcccttctctgtctagcatccttccaccttcttctcctcatctgcaaaatggggatgaaacacataaccccagggttgggagaaaggtctgacacagaggcaagtgtcagtgaacgtttgagaactctgaagcggtgatggaaatggggtattcctggtaaccagcaccctctctgacccacgtggtagttatccttttgccaaaatgtgtgactctcttaatacattttgagtctctagggaaaaaaaaaggcaaacttaattcctactaatatatcactcactgtgttctctaccttttacgctttcttttccaggtggtaacagaaaacaatccagatggggtgcaggtgctgtaaaataatacaaaggtaaagctggagaaatactacttctaaatggaggaatttgtgatgagcgtggggtcacttttaaagaccatgcgtgtattcagtgcatttatccagcttggggcatgatcaacattgccaacacattaagagtttggaattgttataatatcatttaaaagaacatgtgccctagatttttttaactttttttgctcacttctcaaagcatgttgggaacaccatcattttctgaggctgaatttggtctgggtttctgaggatgcctgaaatggcatcgctgaaaataaatcaccccaatcacatatgtgcttttaattttgtccacattgcatttcagaaaattgtgagtaacgtgaacataaacttctaactaagaaaaagggtaactgatgatcttgctttcttaacaaatatactgtctttttaatcatagttctattctagacctatatataaataagctgtattccactgtaatcatactgtgatgtttggctttattcaaaaactatgtattgtaagtatcattcctgtgactacagacttcatatttatcattttagtgactgcataatattccactgagaggatatactccttatggccctgttagtggacatttgttttatttgttttttattttaaaattctatgaaccactttgtattttacttcaccccttacccctccttcctccttttggctctcttcttaagagtatttcaggcagaaccttgtttatctttttcaagactgtctcgctctgtcatccaggctggagtgcaggggcgtgatctcagctcactgcagcctccgcctcccaggttcaagcgattctcctatctcagcctcccgagtagctgggattacaggtgcctaccacctcacccagctaatttttgtatttttagtaaagatggggtttcaccatgtcggtcaggctggtctcgaactcctgacctcaagtgatccacccgccttggccacccaaattgctgagattacaggcgtgagccaccaaacatttttataccaactatatctatttgatttagacatacttatctaggttgaaaagtaatcacagaaattaaattagcaggaatcgtagaaagaagcagggcctgtggtaaaaagcattaatgatggagcagacctgactggttttcattgtctttcctgaagctatctctttgatccagttcaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacgtatgtgtctttctagaagtcttaactcaaaggtggttctaattttctcagaatatcagtgaccctggatgttactttcaatgtaaagaactaatctagatggccgggcgtggtggctcatgcctgtaatcccagcactttgggaggccgaggcgggtggatcacaaggtcaggagttcaagatcagcctggccaacatagtgaaaccctgtctctactaaaaatacaaaaaattatccgggcacggtggcgggcgcctgtaatcccagctacttgggaggctgaggcaaggagaatcacttgaacctgggaggtggaggttgcagtgagctgagatcgtgccactgcactccagcctgggtgacagtgcaagactccatctcaaaaaaaaaaaaaaaaaaaagagctaagctaggcacagtggctcatgtctgtaatctgagcactttggaaggctgaggtgagaggattgccagggccaggaattcgagaccaacctgggcaatttagcgagaccccatctctatgaaaaaaaaaaaaaaaaaaagagctagactacaaaattatactcaaggaagggaccgagctggtttgcagagccatagctttggctttctctctgtcaaacttgatgccataactaaatgtcctgatcttacctcaaagatgaacaagccctctctggatttcagccttctaattcactgaaacaaggacaaccattctaacgtaactcaatggagaatttaaaggcattaaggatgctcaaaactatctagaaaaaaataaacatggaagatgctttagtttggtgttttgtaacacagaattgaaatctgactgaacttcatttgatttccagctttgccatgtgaccttggacaagttatgtatccctttacccatctgtaaagtgagaagaataattgtatgtgcttgtaaaggttaaatgagatgatgtaagtgtttagcacagtgcttggcacactaggcactcaaaaatgatgttttactagttgaaaacaattcctttaacaaacatttttacatccccacaactgaaaactctaaaactgggaagtatgtataatgtcattatttgactttggcaattatttagtataaaacatgatttctgagccttccagcacctttaaggacggcacccttacaaatgcttaatgagcctatgggtttgtttggtactgtaatgacaagccatcgcaagtgacctctatatacagggtcactcagagcccttaaaaagataaagtcttggcattgttaattgcattagaggtatgtctccttttgtatttagtacaccaaatacttaatatttcagaatgcttattccttcaatgatttcctaagtgtatcagttgagattatgttcagttgtatgggacgagtgttttatacaaatagaggcttatttacctcttatgtaaaagaagtctggagttagtgatccagggtggtagagaatgtatcactggcccgtgtatcaatgacccacatatcaatgacccacgtatcaatgacccgcatatgaatgacccatgctgcttcaatcattttggtttccttctcaagatcactttgtagtccataatggctgctgtggcttcagtcattacatttgcattccatgttggaaaaagaataaaggaataaaaaccccactcactctctattaaggaccccacagaagtataattcatcccttccacattactctctttggtcaaaatctggtcacttggccacatctagctgcaagagagactaggaaatcgtcttgctagtggtgtgcgtggctttgccaaataaactcagaatgcagttactaagaaggggaaatggacaatgagtttcgaggcggtcagtttacagtctctgccacaggaggtctcaaaacccaaaagcctgggatacagctggtttcaaaagattggaagatcgtgtgtacattcagtgtgacaccaaaggggcttccacctttggtccgggggaaggaggactggacagctaccgctgctccaacttcccattgataactccaaaccggacgaaaagaagaaattcagacaaagaaggggtagggtaaggtatcagggcagacaagtctctttctcttacccagacacacactttcgcatttatatatgtatataattttacatcttagaacagctgcagagttcaccataactgacagctctgtagttttaaagattctcttttatgaataactgctttgaaaaggtcgacagatggccaatactttcaagagttctttaaaagtaattctggcccctttcatctttactccagtatccaggatcccccaaaggaaatgaaagtaaaaaatctttaggttgaaaagtaattccagcttttagccttatctaccaggttgtctaacagtgagctgtctgagcacgcttatgtgtgtagtgtcttctttctgcagcctagtgccacctcttgtcagaaaagtgatgttgaaaatagccaaccttttcaaacattgtggacaatatgaaagcacaatgcactctgattggaaggcactaactgtgattaggggcagacttcacagttccccatgaaccttaggcaattgcatcacgtggatatttaccatgttaaatcctgattttgaattaagattattttatgtatatattacatataggtttcttgagctaagaagttagatttaactttttactgggggaaaatgaactatcatataaatatgaaattaaattttttcccctcattgccaaagcagatgtagtgaatagttataactggaaaaaccagatacccaaaaaaacgaagagaattttaggtttcttacatagcacatgcccatctgtccatgctcagtaagtgctggccattcgtcattttcctccctctgccccgctctgtctctctgattctcttctcttcctacctctcccatccgtacctccaagcaggaggccttagaaagaatgaatgagacaccagatgcaagtgcaagtgcaaagatctcctgacttccctggtttggtcgtctgtgtgcaaccatgcagcagatagagcacagtcactactgcagcacaggatatagcctcctttcctggacttggacttaactcttcatcaagggcactgcttttcacacaaccaggctttatgacgaaaacgtagaaattaattgctttctggtcttgtttcattttttttctctagattaaacctcatgcatttttaaatcctctattttggagttggtgacaaacacagacaagctgacatctgtttttcatggtaaatcctttccctgttaactaatagaacaataagtcattcatttatagatttactaaatttgtaagtttctcatatgtatcaggttatacaaaccacacctaagtggtctgctaacttctgaagcactcccagccactttaagaaacattttatgcaagtcaatgtgttgatcgtagatgatgcttacctgcacatttagtcacttggagtcaactattagcaatttttttcaactgaaatatctgtactaaaaaaatgcgtttggcctgagatctaagttagtgtacggcacaaggggggaactcaatacatatttgttgattgaaagaatacataaaagaagtctggagttagtgatcttttcccggtctggttggggagatatcatgcaggtagccaggattgtgctggattgtgacatggtgtaataaaggtatacatggtgtaataaaggatgtgggagcacaaatccataggaatttgagagtttaggaattgtatttattattcaggcccttcactctcagactaccctgctctatttgaataatgaggcttgtggtggtctgtggaaaagtggacagagtagaatttgggcagctgctgaaggtttggtctctagaatgagtccacgttaccctaaggacggtaatcccaaattgagacaaaaactttaagaaaaccaatgtttggggccaagcaatggggagcttggccgacctcgttttttagtgattttgaactcaatctttaaaatcctggaagagaaggaaaaaaagggtgtatattcgtgtaatgacatccagatctcaccgttctcttggctcctagtgatgggggaaaaaaggtgcgcccagggttgacccttcagtaacacctgcagccatgcgtcatgacctccaggtgttcagaggccctgcccatgtgacacgtgcctggtacttcccatacatgtgcctctttaatcctaataaacctggggtgaaatccggctgtgcctcttgctcgctgtgtgaccttttgactttaagttccttaacgtttctgagcctcacttttctcatctgtgaaatggggatcattcctatttctaagaattgaaagcgcacattctcaaacttcagtgtgcccctgaggcatgtggtgtgcttgtttaaaaggcagatttctggacctacctctaggaattcagacttaggaggtcttgagtggggtcctggcatctacatcgtttttgtaagtaattctccgcacttggagaaacacataagactccagcagggattgccacaccttttttttatcttgcaccagttatcagtaaaaagtactgcacacacccttaatataagcacttttacaaccatactgtcttctaatatgttatatggtttacagtatttagcaatactaagatgaagtaacaacatatcagagcattaatatttttttcactcccctggggtatgtgaaacctactttggaaaccactggtttagaagatcaaatgaactagtatatataaaagctctctgtaaatagacaaaactgggcatatatatatatatatatatatatatatttttttttttttttttttttttttttttgagatggagattcattcttgttgcccaggctggagtgcaatggcacgatcttggctcactgcaacctctgcctcctgggttcaagcgattctcctgcctcagcctcccacgtagctggaattacaggcacgcgccaccacgcccagctaattctgtatttttactggagacagggttttgccatgttggtcaggctggtctcgaactccccacctcaggtgatctgcccaccttgacctcccaaagtgctgggattacaggcgtgagtcaccgcgcccagcccgggccaatatttttgaaagcacatagagcatacacatgagtgtggaccacgcacttataatataagcccacttgcaaatccagtcaacaccactgacctgcaactcttcctcctcacctgtgctgccctctgagccttgttcctaggagacttctgtatttactgcctttaagcattttggaatagttaatacagaactaagggaaaatatgacctagagaccaaaaggcagacaaagaattttacttatctccctaatcaaaactacacattccaaactaaaatgagtgaggcctttgaggaacaggctaattagaatacttgtttagtcagaatctggctactttgaaagcacaacaatgcaatttctcttgacataagttaccaacttaaaatcccacacaaaaaaatccatttctaggtccaactcattcttttccattctccaaaatattcctaaagctatggagaaaggtaaacctcagaatttacataaatcaggaagagttcacaggccacagaaggtccatagcctctactcatcagccgacgtgctgctctctctgtcttagatgttgatgcttagaaaggaaacaaaagctttaaattaccaatttctgaagacacaagatctaaggtccaaggttttcatggcatcagccataagccgggtgacaaaccatcaaggactgttgtggtttttaaattaaaatttacaggggctgggtgccgtggctcatgcctgtaatcccagcactttgggaggccgaggcaggcggatcacttgaggtcaggagttcaagaccagccgggccaaaatggcgaaaccctgtctctactaaaaataaaaaaattagccagggctggtggtgctcgcctgtaatcccagctacttgggaggctgaggcaggagaattgcttgaacccaggaggcagaggttgcagtgagctgagatcgtgctggtgcactccagcctacatatatatatacacatatatataaaatgatatgtaatatatatatatcataatatatatatatatataactcctcctatagctacttttctgcaaataactgcattagtcatgagttctttttgttggttttgttggttggctgcaaatgacagaaacccaaactagataacaaaagaatttccttgaatgttctgttctgggaaacaaagtgcaactctgtctcaaaaaaaaaaaaaaaaaaaaaaaaaaaaaaaagtttataggaagaaaatatatagagaaaaaatctgcaaagacattacttcaaaataatttgccaaatattaacgtagaaattgtattcagtaattaatttctgggagccaacaagttatgggttttggtattttgttgttgtttttagtatttttataggtatgactatagcttaacattttcagtactgctatgtgttaagcaccaaatgcagtcagccttgttctaagtactgcacgtgaatcatctcactgaagtctaccgtgacgccatgagctataggtatgattgtccccatttcacacatgggaaaatggaggctcaaacagctaaataactcatccagaatcacacaaccagacagtggcagaatctcaactgaacccagactgaacaacaaaccggtgcttttttttttgagatggagtctcgctctgtcacccaggctggagtgcagtggtgtgatctcagctcactataacctctgcctcccagcttcaagcgattctcctgtctcagcctcccgagtagctgggattacaagcgtgcaccaccatgcccagctagttttttgtattttagtagagacaaggtttcaccgtgttgcccaggctggtctcgaactcctgagctcaggcaatccacccacctcaccctcccaaagtgctaggattacaggcgtgagccaccgcgcctggcccaaacctgtgcttttaaaggtgacataatatgcctctctgtggcaacatccatgttgccattagacaaagataagggctgaatcaaaatgtgagacaacccaattttgtatatgtaaaattgtatgtattgtcaattgggattaaaagggggttttgttctggttctaaggaagattgtaataaagaatagaaaagttagtcaaggccttgtaaccataataggtctgctgcccaacgtgccgcaagtcaatagctgagacacggggttgccgcagagcaagaggtttaatgggagggccgctgaacgaggagatggaaggaaacctcaaatctgtctccctgaggagtttggggctaggcattttaaagggtttggagtaagcctaagtgtggtgatagttgattggtcgaagagtacagggtgaagtcatgggacagggtgatgaagaaactgtattctcatgctgatcccatttgtctgggtgggttggctgtcagctgtttcactggaatttgggggaaaacaccttaagcaattctaacaaaagctttatgattctaatgtcagaaatcctatctataggaacaatggggatgcacatggccaggatctagtgctactacaggacttttggtgacaaggaagtgggccaaagtacagcctgattaatgcttaatccagaattcttgttaaccctgtgaggacagcttcagctttatctgtaaaatctctgagactgtctactgtcaatggtatttttgcggcaatcgtaagaccatgaatttcctttccctacaaaggttgaggcagatccaggggccatatgtccccacccatgaaccacccctacatagcttaagattcctttcctcagtttcatcatctgtatagtggaggtgatggctaggcccctctctcggccataatgagatttaaatgagataaaaagtgcttagcacgtacccagcacaaagtaaacaataaatgttagatgtaattttgtccgagtacagtggctcacgcctgtaaacccagcactccgggaggccgaggcaggcgcatcacttgatgtcaggaattcaagaccagcctggccaacgtggcaaaaccctgtctctactaaaaatataaaaattagccaggcgtggtggtgcacacctgtaatcccagctactctggaggctgaggcaggagaattgctttaatccagggggcggaggttgcagtgagccaagattgcgccactgcactccagcctgggtgacagagcgagactccatctcaaaaaaaaaaaaaaaaaaaaaagttagatgtacttttattatccagcgaaggtcactggcccacttctatgagtaacactcaatgcttttttaaataactagatctttgttgctacccaccaaagctgtatgaatcacttctaataatactaatttctaaactgggtaagttctgttctacctacatcattaataatcgtctaaaggcaaaaatgcatcttgggggcacttcaattttagtgtatttttattctcattatcttcatcatttaacaattgtagaacacacgggaatttatcctttgaactttaagtcacattgcatttgaagtgaatatttatagcattaaaattgacctttcttttatctttcctcatgccccaaataagattttataaaataaaatgcatttttaatacaaaacagaaaccatggaagatttgggagggttgattggttattttggagaggttgtgtctggcttgggttttatttagtatggatttgtgcgtgtgtgtgtgtgtgtgtgtgtgtgtagtttttgtttgatttggtcaacactaatattcatctgtaataagtaaacccatatattttttcaatttgggtataatgttatgatttcaagagtattttgtctatgatttctcagctagattaacttaggaatgaaaataaattgagtta

SEQ ID NO: 339 - DNA, 96009 bp, Homo sapiens
ccagaagtcttgagaaatcaaagggtttcttgtcagaagatctcatgacagtgaaaagaataaaaggatggaggcaaaaattgacctaattttctggccataaacatagaaaaatacttcacaatggtctataaaaacgtaattataaagatcattttcatacagctaaggaagttaaaaaaaaaaaaacccaacctcctatttcttgaattgtagcaattaagtcttgtcctaagactcaagttcgaacgctagttctgtcttagactactacttgaataaatgatgtaatttctcagagcttgtttcctcatttgtaaaacggagatagtacttgctagcactgttgtgtgaaggagggaaatataggtgtgaaagtactttttaaaaagtaaagtgccatgctcagcgtatgcacatgagggtttgagttgtgggttatggagagagttgtcaggtgatttaaataaattcttatttaaacaaacttatttaaataagggctagaatatacctagaacgtttaacatggaaatatatttacaaatagaaaacactttataaaatttcatcttggagtatgtaaattctttctaaaagttgatttactttaaaaattttgtctgaataattcataagtcaaaacaattttttaaaagaggacacatcagaagtctctcatgcctgtccctttcacctgggttcccttgtcttgctctctgccacagttttgcttcctttcctgtcaatattctcttatccaaatatgagaaaatatgactatgtaccctctgagttttatttgcaatatcattgtacaataaattcttatcacccttttcttgctcatcagtggccaagataataaattggtcagttacacagcaaatagcaggcctaggactcaagtccaggcttgctagtaccaaggtaccacatctactttgttttgctacgttgtgaactttctgtgaaatagggtaaatctttcagaaaactgtgtatacagctgtgttcttaaaaatatctgcctttcagattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattgtaagttgaatacaacttgactattcatcacagctataaaaccaagtattcattttttattttttgccaaatcagagaacttactatctctctattgcattgctgaaaatcatggttactttgcttttctttcttactgttagtaagaattctcagctttcttggtggtctgagagcttattttaaaaatgctttggagccatacaactaaaagtttcttgggtagggcattttaaagatgttttctacctgataggcacattaaaatttatttatttattttgccaggaatactgtgttgagaggcacactaaaattggagaaccggtggtttagtttagaatatgactcatttccctctacttgaaatgtggagttaggaacacttatttctttagttctcatttgtcctgtttggtcttgggtgaccacagcacaaggacccttttcttttctgttatcaggtgcagtgcacagcctcagagttaagcagtttttattttgtagctacagatttcagaattgtgttgctgggtagacgactatcttgcaactttaattgcctagttagctttcaactatatgagatccaatttccctaatatttgattaaggtgaagcttttttccctctatcagctcctacatttgtgtgtgtgcactcatgagcaataatcaggctgaataaacgagtaggacagaattcatactcacttgtacatggcagtgttcttaaattcaccaacactgtaccatagtagaagtcgtgtaaactggcaatagcacattttgaaatcctgtattattgatttttaggaaaaagcagcagagatttcaagcatgtattaaagttcgattagtattgtctattcaaactcaaaatgttattaggtactttctagttaaaagggtgaaactggtttatgtaccgaaagttgaggccttttcatcacaaatgctaatgagtacaaacactagctaagaactatggggaattaaataattatgaagtaaatcaggaccaaagcacatttcttctaataaccaaaccactgttttccctttctggtcttttgacatagaatacccttcgctcaaagtcaccaatgcagtgggacaatagttcaaatgctggtttttctgaagctagtaacacctggttacctaccaattcagattaccacactgtgaatgttgatgtaagtatcagtgaaaattttatgttgattctagaaacaaagaaatgggtttctactgaaagtacacactcaccctgaatgtgtctaaaccttaacggatactctttaaatcaatcacagacttccttgcagttttccatttgtaaggagtttgtaaatcatgcctttgtgaaaatacaaactggtacaaatctaccaagtgaagtgaagtatcatatagaatatacaagtcttcattgcaatgacctttactaaggcctttgagctatgaaggaaattttatgaagttttttagctagcccagctgcctttcctcctctcttcccctcaaaaggcagggagagaggcgagtggataggcagccatgcaggcagtaaggagatcaatcaatcaacccagagcaaggctcaaatccacactactgttctgaagaaacagaagccatacatgatccttaaagtggttgctctggcatactaatacaactttggcttttacccttttttctgttcccatagtgatcaagcactaatgtcattcactagtgaaaacttcactggaaaacaaactaaaccaatttaggggaaatgaaattatagatgccacatggagatagttaagaaatgcatagcaccctctgccacacacacacacacaccatgcccatcccactctactgagtaatctgaggaaactccccaggatattcagatatagaaagccacacaaaccctcctgctcccacagctccctgctacaagcaccactgagaattcttggatagtataagctttgttttatatagttgtaagtcttgaagacacaaaatatatatgggttgaatgcctcttgattctcattatgtctaaaatattcccataggccaaggccaatctgaatacagtatgtaggaagtcctacataaaaatgcataccagcaaagatggagaaaatgcaaattaaaacagtgattttttttttttttttttttttttttgagatggagttttgcttttgttgcccgggctagagtgcaatggtgtggtcttggctcaccgcaacctccatctcctgggttcaagcgattctcctaccttggcctcccaagtatctgggattacaggtgcccgccaggcgcctgccaccatgtatggctaatttttgtatttttagtggagacggggtttcaccatgttgggcaggctggtttcaaactcctgatctcaagtgatccgcccacctcggcctcccaaagtgttgggattacaggcgtgagccactacgcccagccaacaatgacacttttttctaagtcataaatcccagacaatgccattttaataaaatacatccaaatgaccctggaaaggaacagaaaatttaagtaatttctaaaatacataaagtaaaattagggctgggcaccatggctcacagctgtaatcccagcattttgggaggcaaaagccagaggaatgcttgagcacaggagtttgagaccagcctaggcaatatagtgagaccttgtttctaccttccccctacccccgccaaaaaaaaaaaaaaagggaaattagctgggcctggtgacatgtgcctgtcatcccagctactcaggaggctgagcccaagagatcaaggttgcagtgagttgtgattaccccaatgcactccagcctgggtgccagagtaagaccgcctcaaaaaaaaaaaaaaaaaaaaaagcagagaatagaagtgggagtctaaaacatacaggagaaaaacagttctaacagagacagcactgtaggaatttcctgaactcctgcaatttgccatggcataatttccctaaggaaaaaaaaatctagaactgtttggtgatcacatgcatggcagaattagtagaacaaagcctgaagcttctacaagtgcatcaaagaaagaaaagaaggaaaacaagacctaactctagcactgtcccctggcgagaattcactgtggaatgctctcagaaaggagagcttttactactcagctcagagtcacagacaccaggagaaaaaaggtgggaatctagaaagcttatcaccttcaagtaggaaaagaaccctacatcccaatgtcccaaagacaagtcagacccacatccaacttggcttcccattatgagaggcaggcaaccaaagacaggcaaacaaggaaggtcaaaacacaaaagcaaacagatcaagaatcacacagcatctgagaaaaaccaaggccataaaagggagacaccattcctaacagaacactgtagaaagcagagaaaattatagcaaacataagacttaaatataagtataaatacccccagtagattgctgtttaatggagctccttgacattctttcaagaagtgattagatctctcagaagtataaaagactgtcaaacaatgaaataaaatagaacataagtgctaattagtgtgctgaaaaattgatccaggggcttgtccagaacgtactgaaaaagacaaagaattaagagcataagaaaaaatcgggatacatggaagatagatacagaattccgtacatgcagtaacaacaattgcacaggagaacagactggaggaaacatacaaagaaataaaatacataacccagagataaaggaagactttgtcttctttcagaacaggtaggataaagagaactccaaaactactcagaaagaaaccaaacctgaaaatagattgcctgagaaaagggttgagaattggactagcatcagacttctcaattggatactacaccacattagaactctatcttcaaagttgtaatggaaacggaattctgtatccattcaaagagcaaaacagagatggaaaagcaaggacccacattttaccatgtgtggccactttctgaaagaatagtcaagggactatccaacaaaacataacaattctaagagatacaatgtattaaagaaggaaaaggaaataacttgatttaaataatttttgatacacaatgtaaaacaaggtattctggaacaaaaatcttagtgatttgattctatatgggaaatgttagcagggagggtgtgtgggtgggagggggcacacaggagcaagcaaatgagagagcagtgtttgttttgcacaggaaaaagagtaactctagatttgagctgttcagtagccattaaccactgtgactattacattaaatagaattaaacatttagttcctgctgggtatggtggctcacgcctataatcccagcactttgggaggccaagactggaggatcacttgatcctaggagtttgagaccagcctaggcaacatagtaagaccctatctatctcttaagaaaaaaattagctgggcatagtggcacacacctgtagtcccaactactcaggaggctgaggtgggaggatcacttgagcccaggatgttgaggctgcagtgagccatgatcatgccactgcactccagcttgggcaacagagggagattgtgtcaaaaaaaaaaaaaaaattcagttcccatgtcatagcaacacttcaagtgctcattagctgccatattggatggctctgatatagaacatttccagcattacagaaagttctattggccagcattgttctagacattgagaaacattattttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttcatctgcaaaaatgaaatgacaccatttaccttctagggttgttgttgtaaagacaaaatgagacagcttaacattaagaccatacagtgcctggcacatagtgaccactcaataaatggcagttgctattatttacgacaggaataatctaggtatgttgcacaccgctgaatgtcattatggaagtcttccacaaaatgccccctggtatcaaaggtagaatgctgcgtcaaatttaccatagatcagatgcgctacgacgcccccgccccccttaatccctttccatgtcgcagcaaaataatgggcgattgggggtaggggagcaacactagtttactagccgacactagtaaaaaaaggggaaaaaagacccgaataacaaggacctgcaaaggtcctacatcaccacgttcccacagcctttatccatccatctttcatccccaagaagacagtatgcaaggctaggatgggggtggggtagataaatgggtgttctcaggagaacctattcgtttaccccgtgcaactctccaccccagggatgaggcgatctgaatgcaacagggagagggaccaggtgacacgcacgcagtgccgggacattagtcaaaaagcgaggacctggggactgaggggtgggtggctgggcggggggagaaaggggagaaggaaagagaccagcacaccccccatacatacgcaaattgagagaatcagtccggctctggacacaaaccagtgaaggcaggccggagaacctgaagctctcagaggggagcaggtgtcaccgcaggcaagtccagccgaagtctgcgttccgcagcccacagaacgacaacttacccagagccgcctagagctggtttgcagcacgccaatctacgtaacctcaatctagcacgagcaacaggcagatttcgccatctttgttgtggtcaaggagtcttcttgggttcctgggttctttagtctcgaaatatataagacttttcgttcttcgctagtcttctgagctcgagatgaagcacagaaggctaaaacaatgagggacagcgttccagtagccctgccacagctctctcatcctctggtccgccctcactcaagatggctaccagcaagaatggtgcaatggcgtgacagctcggccctggttgccaaggagatgcgagtaccggaaatgcggaattcggggagagcgcgcatgcctggtccggtggagggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggtaagggagaacctgctcgcctcacctttgcctctggtcactcctctctcacgtaccgggggagcgactgttcgcagttctttcctcttggcagctctgggagacccttctcagtttgccgggagccacctgcgaagctccccctcgcttcacctaagcgtcccatccaagaggaggaatcatgtggggttgggtggggagcgggacagccaaggctgagctcctgggaaactcagatcgaagtagaagaaccccttctagacatttttgtgcgtctgggggacttttccccttctcgccagtctctggtgcgcccgccgctccccactgctcttttcctgcttctgttttgcctccttccccagtttcttctagcttaactcccagcctggttcgagttaccgatattcgtctgcaccctctggccccgtcttttgcccagcgtggttgactatgccgggactgagacacggcatgcgttccctcggcatcttccgtacagcggagcgtgcaaggagtaggaaaagctgataccctctctcactgaggtctcaaagttaaatgattatcttgtagtttgtagtgatcagcgagattctccgtgtccaaggtgggctagtcaaagtgtgttcgtttttgaatgatggtatcttctggtacttcaaagtttctgctgttacttacaactccactcgtgcaagcttgacggaagttctgatttatgatcactcacattcttcgctcacttcttgaagtgaagtctggttattgtttttgcatagcagtgttatgcctctgcctgaagttttctgccgaaaactttactcaggaggacatttttccatttctgacagttgtgtttggaaaagagtttcccagctattgccactttacttgagattgtgcttttagtattttggggatcactttgtttgcagttgccttgagtcaccttttcatacagtggtcttttagtgcttttagagttatgagttaagtagatcatcagagttaattaagatttatttgctgatacattgacagtctttccagaccagtaatgatctggttttgctattgttacaaatggtattacaggataagaaaatgcatgtcctcacagatcatcataggaagtatctataataaagtaaatatctaattttttttaatagtgaccactgaaatgagatctggcgtgagctggggagagtggactcaaccccccttcccccctcctttttttttgaaatggagtttccctcttgttgcccaggctggactgcaatggctgccatctccgctcaccacaacctccgcctctagggttcaaatgattctccttcctcagtctccccagtagctgggattacaggcatgcaccaccacgcctggctaattttttttttttttaagtagagacggggtttctccatgtttgtcaagctggtctcgaactccccacctcaggtgatccacccacctcggcttcccaaagtactgggattacaggcatgagccaccgtgcccggcaacccccttcttttttttttttttttttcgatacagagccttactgtgttgcccagacgtgagtgcaatggcgcaatctcggctcactgcagcctccgcctccctggttcaagcaattctcccgtactcagccttccgaatagctgggattacaggtgctcgccattacgcccagctaatttttgtgtttttagtagagacggagtttcgccatgttggccaggctggtctcaaactcctgacctcaggtgattcacttgcctcgcctcccgaagtgctgggattacaggtatcagccaccatgcctgccacgcccaccgcccccacccttccttttttttttttttttttttttaaataagatagagtcttgcttgttgcccaggcaggtaactcctgggctcaagcaatcctcccacctcagcctcctgagtagttggaattacaggggtatgccatgatacctggctttcagtgattctcagtatagtaaaaactacagcacttatgttcattctaaattgcggtctaaatgaaaacagtgacaagtttcagctgtggctgttacatgaagtccccacacgttctgacatcgaaacttttggtatatatctgcctgcttatagtctttttatcttctctacttggtgaatgattgttcattcttcacacttccatttcaaactactcttctgtgaagccacccctaatgcctctgggctaagttagaccctcagccaactctaccaatgagccctttatattattttatgatcatgtgatcagggtctctttttcttactagaatgggcattcaccctgggaaaaggtgatgttttattaatttacatcctctgcacctagcacagggcctggttaattgatttttagtagatgttgttcagtgtctgtggaaagcctgagagtaaggacagtctttaagtggcgcatagcacctagtccttagtgtattttatcagtaagctattgctaagtaagaaccgcaacatcacagtggcatacaacagttagtatttattttgttggtgcatctgggggccacctgggagctgaccgacataggctgtagtcatctgggtatctctatgatgcacatgtggtccatatgtctctaatctttggactagtgggctgaagtcctcatggtgatagcagaggtataagagcaagcccaaccacagagacacattttaaacccctgctcacatcatgtgtttatttcctattggccaaagtaagatatttggcaaaggccaaattcaaggggcagggaaatacaactccttccttggaggtgacaaagaggaagtgaatatttttctattacaatttaatcgatcacatatattaaacatttacaagctcttagtaaatgtatttcaaatgaatgaaccattcctatcctatatgcatctagtactggaaaactataaggaatctaagcagtgctagagatatgtgactccttttctcgctcgtgggacatctgaagaacatctgctctgtctacttgttttttcctttaaaattctgtctttccattaccctatagagctccaaggctgtctcatggccttttactttatgttaactattcagtattttctgtgttttgtaattaacaaaacataggttttgagagaaaacctggttgacctagtgcatcatttggttccaggttacatggtaagttgccaagatttgagtcaagcgagtacttaaattagatgaggtctggaagatgatgaatcaatatcagtagaggttatggatgttgttctgttttcctctttgttgagtctcattacatgttgacgaagatggccactggcaactccgggctttcatatccatccagctagtaatccagaagaaataactcttttccccaacatccaaatcatttcctccaaaggactctgataggccaaggttagaccaattgctgtgtccagaatggggcactttggctaacctgggttatcagcctaccctgtggcaggtaaggtaacaacctcactagaattacatagagtgagagaggggcagttcctaaaaggaggcaatgtagggcagatgaaaaagtagcaatgactgttacacacgtatttacaaaccacctaccgaatgaaaaatgttgcctagaggtatgaatacttggctgaagaatctgattatggaatatttcacagttcagtttatatcaaagcaggatgctttttcctggattggctaattgaaaaagttggttaagaggtgaattgtaataacgatacatattccaagtgaagttattttctgagtgtcaaatctttctaggtatttgtaattcttcaaatgtttatagttggcttccaacacctaaactgatagtaaacttttaagcaacttacctttatctttctcaaacattcaacttggcttttagggtaacgttaactccctttcagctctatgttattagttttgtaatatttaattaatgacaagttaaatatttaattgatgacaaatttaatttgttattttgaagaataagtagaataaaaaggtttgtgaagaagcacagttaacttggcaagcatacaacttgacactggcgtcagatgcatctaagtcttgatccagtcctaggtctactaccacgtactggatgctcttcactgatctatatcaagtatttagattgttttggaatgtatttttgtttcacctttattcttgactttgttttatatgcttacttttgctttctctttttcttcataaatgttatcttgttgtattgttcatctttttaagccatcttgaatccttttggtaatagttgtcatataagtcttccataagttgttggaatttggacaactttttactttctaacctcagttttctcttcacttaatgggagtgataacacatactttggaaggttgttttgagtatttgagataatatttgtaaaatgtttagcttggaatctgccacatcatagactcaaaataaatagcagctattgttattattattattattatttgagacaaagtctcactccatcatccaggctgaagtgcagcagtgtgatctcggctcactgcaacctccatgtcctgggttcaaacgattcttgtgccttagtcttctgagtagctgggactacaggtgcacaccaccacgcctggctaatttttgtattttttttggcagggatggggttttgccatgttgcccaggcaggtctcgaactcctgagctcaagcaatctgcccacctcagcctcccaaagtgctgggattacacgtgtgagccaccatgcccggcctgttgctgtgtcttaaaaacgggaaacactatagcttccgcatgtaaaggataaggttttctggtttttacttgcatccctgagcatagattcatatataaatatagggattcagaattctgttaactgtccttttaactgtagggtaactggaattggccatttttgttgagtggatcccaaatgtcagtatctacaggtctttttttcttgttccaatatccgagaaaggaaacctggttaagtatccctaatacaaaaattaaagatcttaaatgcttcaatatccgaaactttttgagagccgacatgttgccacgaatggaaaattccatgcttgacctcatgtgacaagtcgcaattaaaatacagtcaaaactttgttttatgcataaaattattttaaaaattatataaattgccttcaggctatgtgtataaggtatatatgaaaaacaaatgaatttcatgtttagacttgggtcccatcccaagccttctctttatgttttgcaaatattcccaaatccaaacaaatccaaaatctgaacaaattcaaaatccaaaacacttctggttccattttggataaggggtactcattctatattgcactctcctctctggcaggcagatataagactagctgcctattatctggaagctaagtgaaggaaagggatattgatcagaatgaagagcctgttatactactttaagctgtactcgatgtttaagatcagaactgttactcatcttctctagaaatgtatctatcaaagtaccattgtggggaagtgtagttgcctggtgttgatgatgtaatcagggcatctagctactcttctaaaagattttcaaccaatacttttgtgtttagccttactcctctacccatctggtcttcataagtgtttctgtatagttatgatcagtttagttagttctggagtaaacaaacatttcaggttaataaatgggtctttgacttccattgtgttcagttgcatacgttgtttacctaatgggtttagggaccttaggacttgatgtcttttttttcttcttctgatacttaatcttttgacatgaacttatttggtatatagcattgatatttgactaaatagctcattgacttacttaggagaatgagaaaatgccttgactattccttcaccccagataatttcatttgaatattatttaattatataacatgggtatttgaaggaggtcttctaaaagtggtagatgataaggttataacttgatgggagatttgagcatcccttcagttcattaaactaccaatattattgatggccttaaaataactgaatcttctttttaaagcaatgtcaaaagtaatttgacttgatctcctattgcaattacttttacctaacatggattatataaatgtcttatttgttctaaatatgttgcctgttactttcattgagtattagcttgttgtcgtattgtcgatcatgtagatcacgttgtcatactgtagatcatgcagatcatactaaactatgtaagccccttccagtattatacatgtggtgacttaaattattttttacattagcggtttatggtaccattaccttgacatcagagtaccttggtgccattaccttgacatcagagtaatttagactattaaaaggtatttactgtttggagtttaattgggcaagattgaagataatttataatgtctacattttatatttttaaaaatttaatactttgttttttcctaagagtaagctctgttgagtagtttgtttttcttcctgttgcccatagttgacagactataataagaccctgtattattattattatttttaaacagaatcttgctctgttgcctgcgctggagtgcagtagtgcagtctggctcaaacaattctcatgccttctgtgccttctgcctcccaggctcaagcagttctcgtgcctcagcctctcaagaacctgggattacaggtgcatgccatgcaccacctaatttttgtatttttagtagagatggggtttcatcatgttggccaggctggtatcgaactcctggcctccagtgatctacccacctttgcctctgaaagtgctgggattacaggcatgagccaccatgcctgaacaagaccctgcttttgattaagtcttttaaacaattaaaaataaagaaaaccttcaaagagagactaccttttccgatcctccatttaaaaaactaaccttctaaaacttctacatagtatataaaatttaaacatttttcctatgaaatatattcatactgatatattttcttgattattttgatctcagtttgcccttctacacataagaattatgcatctttggaataagtgttccttttttgaaaatagaaaccactctagctactttaagcagaaatgggtttagcatagtgaattaagtgcttacaaaatcactggagaaacagtctaagagtgaatcccagaacaacagagtgccagaacagtataaagctgcaactggccagccaagtgaaatactacctctaccacaataaagaacctgaagctgtctccaggattatatcactttagctgtgatctttggtgaacaggaagctgctgtgccataactatagattctagaagcaaagtatgccataactatagattctagaagcaaccaggagaagtgatgccacttgtgctccctctcactctccattaaattagagagtcaacactggaacctctgttaaagctgcttcagaaaaaccaagtatctttacaactattctaagcagcacaagttggttgtgaattatagttaacaccatctttccttgtttcaaatctcatgttagtgcatctgattagttaaaccaaaatcacatctgaaactttggctgctacggattccaggaaatacagcttctagctttccaactctataaaatagaaaggtatcttggaagctggaatggataggtgatgccggtttatcatattctctacaagcagaggtgttaagagtttagggtctgtagtcaggcagcctggattttaaccttgggtttgactcttgtgagctctctgacgttgggcaaattgcttaactgccctgtgttctagttttttctctcacgtagtaggtatctatcccatagtgttgtttgagtatttaatgaagaatgtggtaagacttgcattaattcttactcagacatgtaatgtaattttcttgtaagcaatctgggcctggagttttctttgtggtaagttttatatttatgaattcagtttttgaaatagtttagactattcggattttccgtttcttcttgtgtcagttttagtagttgtgtttttctaggaatttgtccatttcatctaaatttttaaagttagttttcataaatatccctttattattattttttaatgtctgcaggatttatagtaacctccctgtatcacattgatagttcttccttttttcttattagtcttattaaggatttatcagttttatcaatcttttcaaagaaacaacgtttagtattatcgatcctctctcctgtgtttgttttctacttcattaacctgtactcttttagggatctattttgcttatttttcaaatttttgcaatgaatgcttattaacttttggcctttctgtatttttttctgtaagcctggatttagctgcatgtcatatgttttgaaatgtatttctattgtcattcaattcaaaatactttataattttctttgttttttcagagatagagcctcactctgttccccaatttggagtgcaatggcttcatcattgctcactacaacctcaaactcctatgctcaagcaatcctcttgcctcagcttcctgagtagctaggactacaggcagacaccaccacatcctactaattatttttattttaaaatttttttgaggcagagtctcgctgttgtcaaccaggctggagtgcaatggcacaatctcggcttactgcaacctctgcctcctgggttcaagcgattctcctgcctcagcctccccatcagctgggattacaggcccccgccaccacacctggctaatttttgtatttttagtaaggatggggtttcaccatgttggccaggctggtctcaaactcctgacctctggtgatctacccacctcagcctccccaaagtgctgggattacaggcgtgagccactgtgcccagcctatttttattttttgtagatatggggtcttgccatgttgctcaggctggtctggaattcctggcctcaagcagtcctcctgcctcagccttccaaagtgttaggattacagacatgagccactgcacctggcctatagtttttattatgtgttctttttctgtttcacaggttatttataagtacattgcctagtttccaaatatatttggcttttcaaatatctttttctttatttttgtttgcttatgagtctgaagttattttatatctaagatttttctatcatgggaaatataaaacatatataaagctagagagaacaatacaataatcattcaggtactgataagcttcaacactgttaactcatgaacagctgtgtttattctcacttctcccattgccccaccaccattattttgaagcaaatctcagatgtcattttttctttaaatatttcattatgaacttataaaaatgacattaaaaaatcacaataccacatcaacccagaataattaattgatgtcatgaaatatctgatcagttttcaaattttccccattttgtcataatttttctttataatttgattattttggaggaggatccaaataaaatccaagcattattattggttgatatgccccacacttaaaaacctggcttttagcaacaccagcaaaattattcattatgctaaaacatacataccttgcatactcaatatacctccccattcctaggtaagctttgaaattcaacttttctctcctagctccataggttgttaaagaagcagcttatcttcttggttctttcttttagaattgacacatatccccaggagaaaagtggttgcaaaagtcagagtaacctttgtaggttttctccttttaaagatataagactgcaagccaagtgctgtggctcacttctgtaatcccagcactttgggaggccagggttgaagatcacttgagcccaggagtttgaatccagcctgggtaatatagggagaccccatctctacaaaaaatttaaaaaattaaccagacgtggtggtgcatacttttagttccagctgctagggagcctgaggtaggaggatcgcctgaacccagctgggtgacaggctgggtgacagtgaggctgcgtgacaaagtaagatcctgtctcaaaaaaaaaaaaaaaagatatcagacttgtaaatcttcactgtctttgctctctgatgtcttcaagtaatgctttaaaatattttgttcatcttttatagttatcttcagtaggagatatatctgaattatctaatctgtcattattagaagggaaagtccccttaccacttaaattttgaacattttgaacactaaacttactatatgtttagataacatgactgcaatatttggctttatttcaaaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggtaaccattattctagttaagattttgtaaacactagatttctcttggataagaaaaacaatctaataagaatcatcattatttattctattgagtttacgggcaatctttttcagaacttaggttttacaacttgttttaggaaatcctgctattttaactgggtcttgctgtattatcagactaaaggaaacaagttctcacaaatatagtggcatttgaagataaggtggttgcaaatcaaagggttcatttaaacattctgtcataacatttgtttatgacaaaaagccatgtttgttctgaggcaaagaaggggctgaaagtgaaaacagaatttttccaaactacccttcaagtaataatctgaaaaatcaagctttggtattttttccatttatttatttttttattactttcagaatagaatcaatcttaagactaaaggagaaaattcaactgaaaacactgatattgtaagaagcatatggactgttctgactttaaaaatcattagaaaagagacaagagagttacagactgcaataacaagataccattttactgaattaattttctctcacagttatgttctagcatgttgcaatattactgtaggtgtttgattttataaaatctgccttttctgacagtatttcacattttgaaagggagggaggagcacatttacagtaactgtaagaagagcaaaaaacattttaagtgtaaatgtgactgaataaggtttaggtgaggctaggaataattttaagaaaaaaattttcacaaagggtatctttttatagtatatgtttctcgagctattttagtttagaatatctaagctttaaaacataatagctaaaaattgggatttggataaaaattgactaggttgggcaggaaagaacaattagaatctggttttataatactattttactgaaaatgccggctgggcgcagtggctcatgcctgtaatcctagcacttcaggaggccaaggtgggtggatcacttgaccctaggagttcaagaccagcctgggcaacatggcaaaaccccacctttacaaaaaatacaaaaattaattgggcatggtggcatgtgcctatggtcttagctactccagaggctgaggtggaaagattgattgagcccgggaggttgaggctgctgtgagctgtgccattgcattctagcctggatgacagagtaagactctgcctcaaaaaaaaaaaaaaaaaaaaaaaaaatcaaagtaaagaaaatgccaaataaaatatataaacttacagattttggggtgtacctgtacattaattatgagattctcattaggataccccaactgctttgccttttgatggagataatcagttttgtccttggttagaaaggaaagaaaggtatatgcttactctgtgtcaggtacagagctaggtgttttgatgtattccatttcaagtgatccttacaataactttgtgaagcaggaatggaaatgattaaacatttagaaggaaatgaaagacaagaaaggacagagtgatccagtaggggtctttaggtataaagttctaaaacttatcttctgcatccactggtgaaaagagacaataagtataaattatagcaagaataatttcctgacatcttcaaggccctggtaagggttagccagtgagaatgtgaaatagtctcttcttgagatctttcaaagcaagtcatggttatccacttgtagagatgatcctcatgtagtactatccagagcccaagctatagagtaaactgggactcctttccaacagcattgttctttgtgatatatcttcttgtgatatatgaaagaataaatgtatatctatacaaatatgacattgagttggaaaaaagacacgtgactgagctaaagtgttggcttcattggctgccaagattttttttttcaaactagttagtatctgtccacattagtgcaaaaataacagtactttgggaggccgaagcaagacgatcacttgaggccaggagttcaagactagccttggcaacatagggaaaccctgtctctacaaaaaattttaaaaattagccaggggtggtggtatgtgcttgtagtcccaggcactcaggaggctgaggcaggagaatccttacagcccaggatttcaaggctgcagtgagccataatcatgccactgcactccagtttgggcgatagagtgagacccctttagggattacaggcttgagccaccatgcctggccagggtttctgttttttttttgttttgttttttaatattacttggaatagcccaaagcagtggtttagaagtagttttgcaatgaagtggagtactctcatcttcctctatattttttaagtttgtttaatcagcagtaatgatgattgaaaaaaaagggatgaatagtgttaaattcaaaccaataaatatttaatagcaccttctatatatatataaaaaaacagaaataaatataaatatacaatactatgcttaaggagctgaaatagataaaagttaaataataaaaataattaaataaggaaagttaactattcagtgtaagaactctcaccaggctgtgcataagtactttcaaaatgagtggaatactcacacttaatagaagtttagaggtaggagtgagttttggaaatgatttttaaaaaaactggatctggaagtacttgaaagttctgggagaaggggatgcccagatgatggcaaagatactagaaaatacacagggtaagaaagagcaagacagaatcatcagaggctactgagaagaggccattgcagtctttagctggaggaatgattatcaatatatattatatggtggatctgctccaggttcttggttttttttttctttttagagaaggagtctcaatctgtcacccaggctggagtgcagtagcccattctcagcttactgcaacctttacctccagggttcaagtgactctcctgcctcagcctcctgagtagctgggattacaggtgtgtgccatcacacctggctaatttttttgtatatttaatagagacagggtttcaccatgttgggcaggctggttttgaactcctgaaatcaagtgatccacctgccttggcctcccaaagtgctgggattacaggtgtgagccaccacgcccagcctgctccaggttctattaaggggctaagcattggagattttgggctgggcacagtggctcatgcctgtagtttcagcactttgggaggctgagaagggtggatcacttgagcctaggagtttgagaccagcctggccaacatgctgaaaccctgtctctactaaaaatacaaaaaaaattagctggacatggtggttcatgcctgtaatcccagtatcccagttactcggtggctaacacatgagaatagcttgaacgtgggaggtggaggttgcagtcagatgagattgtgccactgaactccagcctggtgacgaagtgagactctgtatcaaaaaaaaaaaaaaaaaatagacactggggatgttacaagttcctcacaaatcataattgtaaaccccattttcactttctcagttcttatcgcctaagatcacctgccacagcttaacagagataacacacacagggtgatcagcacttgttatcaatacctattagttttgtctatcttaaacttttgctacccattcatttctgtctccttaaagttttattagagttgaagtgaatacccccaagagggttaatgcctaggtatttgtgaattcaaaatacctagttgtatcttgtttatataagcagtgaccttaaaaactttgaccattattttctgtcagccttacatgataataattaaaatgaaggaataattttcccttagtgacttttcatctgaagctaaagtttaaacaatgtaaaagttaggttacaaaactcccaaggtttgttgtcgtctttgtctacctgtggatggtgactctttgtttcaaattacgtgttgagagttatgaaatgaaaatccagggtatgactcctggattttgttccttgacaaactattcttgcctttctggtactttctttcttcctcttttttgagacggtctcactctgttgcccaggctggtatgcagtggcatgatcatagctcactgaagccttgacctcccaggcttaagcaatccgcccgccttagtctcccaagtggctaggactacagttacatgccaccatgcccagctaatttttgtatattttgtagagatggggttttgctgtgttgcccaggctggtctcaaactgctggggtcaagggatctgcctgccttgacctcccaaagtgctgggattacaggcgtaagccactatgcctggactttggtactttgtttcttagaactttgtagaagaggctcttgttattagatagatgcaagtatataagctaagagacaccaggagatgtttataccaaaattctttgattaaaatttccttttccctatctcataaactataatatattgttgtataaagcttgctgtgtagatacaagaaattgttcctatctcccatatttcaacttaattccagcacagcaggaatttgcatattctggaagctttaaattgcttccattatatatggaaccatagaagtgcctgagttattcatttataagtgtatacgtgtcttaggtatagagaaagctgagaggcctgaactgtccttctttgtttgaagaagactactgttactatggtaattgctgaattagaaggctagaactcttgacttttgccttgtcctgggaacttagaatgggcaaaaagtcaagaatgactttgtctttgactgtgttgcatctttctattataacaaatgcactacaccgagatcataccttccatttctagggaaagaaaaagacaaaccaaaccctcacctcattattttagttatatagcttgtgaatgttcagtaaataaaaactagtgattagatggtttgcttatgaaattagatgtatggcagattatttttgtatgtgtagtataacctaggtacgtatatagagcttggcgaggctggcatctaagacaaatacgaatactgcatctatatttaaaagcatagttttattgttagtagtgatattaacaacagaggtgattatagcaataaaacaacgttttttaggacctttaaaatatgatccgtagtttccagaaaactgtgaattccattgtgtcacatttttatggatcttaaatcatagatatgggctagtataacttagttttctaatttgttttaaatttcattgcaattttttatgtaacgtgcttacatataaatatactgtttcagtaaattgaaatgttcccttaaacattttccaaatcccaatatagtacatgtagaaaccatctactaatttcctaaaacccatgagactggaaaacatctctttagctatttttaaaatttgtaatttttaagcacttatttttgaaagaactccaaagcatctagaattaagtttgtttgtttgtttgtttgtttgtttgtttgtttgttttgagacagagtcttgctctgtcaccaggctggagtgcagtggtgcaatcttggctcactgcaacctccgcctcccgggttcaagcgattctcctgcctcagcctcctgattagctgggactacaggcatgtgccaccacgcccagctaatttttgtatttttagtagagacggggtttcaccatgttggccaggatggtctcgatctcttgacctcatgatccacccaccttggcctcccaaagtgctggtattacaggcgtgagccaccgcgcctggcctagaattaagtttttaaaaccttctgaaaacctctcctctttgttcttctgcagccttttaggacccactccactctctggcttactttgtatttttggatcaattttcttttactcacaatacaatttacataacaaaatttgctattttaatcactttaaagtatgcaattcagtggttttaagtatatttacaatgttgtacagccttcaccactattccagaactttttcattaccctgaaaagaaaccccatatacattggctgtaactccccattctccttcttcctctagtccctggcaaccagtacttgactttctgtctctatgtgttgtctgttctggacactttatgtaaatggaatcctacaatatgtggccctgtatgtctgtcttctttcactgagcgtaatctttttaaatttaagattcagccatattgtaccacataacagtacctcatactttttttatggcatcccactgtatggctaatgtattttgtttttttcatcagttgatgaacatttggattgtttctaattttgggctattatgaataatgccactatgaatatgcatgtacaagtttttgtgtgaacatatgcttttaattctcttgggtatgtacccaggagtggaattgctgggtcatgtggtatctctatgtttaactttttgaggaatagccaactatttttcatagggctgtaccattttatattctaggaatgtatgagtgttttagtttctccccatacttatcagtgaagcacttgttaatttttcttcttttttaaaaaatattacaacccttatagtggatatgaagtgatatctcactgtggctttgatatgcatttctctattgtctaatgatgttgagtatcttttcatgtgcttattggccatttgtattttttttcttttttttgagaaatgcctattcaagttctctgcctgctttttttttaatgttttattttctttccaatgggacttttgcactcctgtctttgtgtttttaattgagctgtctctttttattgtcagagttatttttatatattctggatattagaccctatcatacatgtgatatttgcaaatattttctcctagcctgtgcattttcttttaactttcttgatatgtagtatcttttgatgcacaaaatttttaattttgatgaggtgtaacatgtctattttttcatttgttatctataattttaatgtcatatttatccatggcttgcttttcacctctagtttcaacctcttggcatgtttaggcttcagatttttcctctagcagcttttctttttccctcttcaaataattatctgccccaatgactcgttcctcagtccttactcagcaggccatttttaggaagaaactcaaagttcctcagttctaggatagctttaggtgcttgtgaaaaaaatggtttggccctggggagaagaatctggccattgttaatggtttgggataaagctttgaagtttaggacaaagatagagtgaactttttatactctgagtatgttggcaaaaaatcgtagttgtcacataacattaattacaagtataatgctaagactgaagtttttaagaatttaagtttgagcagtttcttttgttataggcattactagcgaaccacagagatcagacaggacctaggtaaatagttgaaaaactaagactagacaagagcttgtagacttgacgcttgaataaagtagatgactcagtgaaaaagaacagtccttaagtttggaacaaatgaaatggaacttgaagtaaccaaactgaatctttgtcatactatattgatagcagttttcctataattagaactaacttcttatagttttgaaaatagtgattattaacattattctttcataagatgccatcttttagggtttttaaaccctgataacttcatggataattgatttcatttttataagtatcttagaggtataggatgaggtttactgtttctccactgcctacccccttaaaaaggtcatatggtaagcattctgtttctttaagaaataatgctttcggccgggcatggtggctcacacctgtaatcccagcactttgggaggctgaggtgggtgggtcacgaggtcaggagtttgagaccagcctggccaacatagtgaaaccccatctctactaaaaatacaaaaattagccgggagtggtggcagacacctgtaatcccagctactcgggaggctgaggcaggagaatcgcttgaacccgggagacagaggttgcagtgagctaagattgcgccattgcactccaccctgggtgacagtgcaagactccatctcaaaaaagaaataatgctttccagaatgacaagttttgcttcagtgataagttgaaatcaaattttttattttgaatagtgtttttaacttttaaaacatgtacttaacttctattatctcagtttgttttttagaaattaaaaaaaattaccattattacaaaatatgtgcatgttatttctacttgtttcagatttaattacaagtatttatttcatcctgatatatgagagacagagagggagagagacagatgcaagaagaagagaatattcttattaaaattaggccataaaacaattccacttttagcaatgtatcttaagtaaacaatcagaaatagatttgatgttttccacaagaatgttcactgcagcagtgtgcacaatagtacaaaattgggcacaatcttaaaatccaacataaagttctggttcaataaattatggtgcagacatccattgaacttggcagccattaaaatcatattatgggatattacttaatgatgtgggaaactgtttataatacatactttgttataattggtgaataacaaattgcaaaacaatatggacaagtgctttcagttctttaataaaaggaatatgtgaacatagaataagatttgaaggctgcgtaccaaaattctcatgttatctctccatgttaggattatgagcagttttttcttgaaggaaccgtatattgcttttatattaaaactttttttggatttcaatactgtattgttgataattttaatagttttatcttacacttttttttttttttttttgagatggagtttcgctcttgtcacccaggctggaatgcaatggcacgatctcggctcacagcagcctctgtctcctgggttcaagcgattctcctgcctcagcctcctgagtagttgggattacagacgcctgccactacacctggctaatttttgtatttttagtagagacagggtttcaccatgttggccaggctgatcttgaactcctgaccttaggtgattctacctgcgtcaacctcctaaagtgctgggattataggcgtgagtcatcttgcattttggaggttaaatattttgctcattttcatcttttcttagtatttactgtagttttccatattagtgtaaataacctcatctctacctagaatcttataggcccagagaagacaaagaatcattatgttattatgattgttttatttgtgattggtgactttgttttttcagattatgatactttggggcctagtgcttatttggtcagtcatattgcaaataacttttttctttttctttttctttttttttttttgagacagagtctcgctctgtcacccaggctggagtacagtggcgcgatctccactcactgcaagctccgcctcccgggttcatgccgatcttctgcctcagcttcctgagtagctgggactacaggtgcctgccaccacgcccagctaatctttttgtatttttagtagatacagggtttcactgtgttagcctggatggtctcgatctcctgacctggtgatccacccgccttggcctcccaaagtgctgggattacaggcgtgagccaccacgcccggccaacttttttcatctcatttaattaccctgtcaaaggactgggcctctgtggcagaaataaagaaaagctctatttttatggaaagggtaatacagtttacacgtattctcttactatgttttagtttgcttggctgccaaaacaaaacaccacatactggggggcttaaacaagagaaatttagtttcttgcagctctgggagctagaaatctgagatcaaggtgttggcaggtttggtttcttctgaggcctcttccctttggcttgcagatggccgccctcacactgccttttcggaggccattcctctgtgcatgcatgaccctgatgtctctctgtgtcctacctcctcttttttttttcagttgataatttattttattttattttagttttattttttgaggcagaatctcgctctgtcacccaggctggagtgcagtggcgtgatctcagctcactgcatccttcacctcccaggttcaagcaattctcctgcctcagcctcccgagaggctgggactacaggcgcatgccaccacacccggctaatttttgtatttttattagagatgaggtttcaccatactggccaagctggtctcaaactcctgatcttgtgatccgcctgcctcggcctcccaaagtgctgggattacaggcatgagccactgcacctgacccctttttttaatttgtaatttcaattttcatttttttccataagttattggggtataggtggtatttggttgcataagtaagttcttttgtggtgttctgtgagattttggttcacccatcagctgagcagtatacagtgtaccatatttgtttatcccttgtacccctcccactcttccccgcaagtccccaaagtccattgtatcattcttatgcctttgcatcctcatagcttagctcccacatatcagtgagaatatatgatgtttgattttccattcccgagttacttcatttagaataatagtctccaatcccatccaggtcactgcaaatgcccttaattcattcctttgtgtagtattccattgtatatatatatataccacagtttctttatccactcgttgattgatgggcatttgggttggttccacgattttgcaattgtgaattgtgctgctataaacatgagtgtgcaagggtctttttcgaataatgacttattttcctctgggtagataccaagtagtgggattgctggaccaaatggtagttctacttttagttctttaaggaatctccacactgtttccatagtggttgtactagttttcattcccaccagcagtgtagaggtgttccctgatcacagcatccacgccagtatctattgttttttgactttttgattatagccattcttgcaggagtaaggtggtattgcattgtgcttttgatttgcttttccctgatcactagtgatgttgagcatttttttcatatatttgttggccatttgtatatcttcttttgagaattgtctattcatgtccttagtccactttttgatgggattgtttgtttttttcttactgattcgtttgagttcgttgtggattctgaatattaggcctttgtcagatgtttagattgtgaagattttctcccactctctgggttgtctgtttactctgctgactgttccttttgctgtacaaaagctccttagtttaattagatctcagctatttatcttttttttttttttttttttgcatttgcttttgggttcttggtcatgaaatccttgcctaagacaatgtctagaagagtttttccaatgttatcttctagaattttgatagtttcaggtcttagatttaagtcctcaatccatcctaagttgattttttataaggtgatatgagtatccagtttcattctctgcatatagctagccaattattccagcaccatttgttgaaaagggtgtcctttcccccactttttgttttgtttactttgtcaaagatcagttggctgtaagtatttggatttatttctggtttctctattctgttccagtggtctctgtgcttatttttatatcagtaccacgctgttttagtgactgtggctttatagtatagttgaaatcaggtagtgtgatgcctccagatttgttctttttgcttagtcttgctttggctatgcaggttcttttttggttccatataaattttagaattgttttttctaattcggtgaagaatgatggtggtattttgatggggattgaattgaatttgtagattgcttttggcagtatggtcattttcaccatattgattctacctatccatgagcatgggatgtgtttccaattgtttgtgtcgtctgtgatttctttcagctgtgttttgtagttttccttgtagaggtcttttgacgtcttggttaggtatattcctaagtattccttttttttttgcagctgttgcaaaaagggttgagttcttgatttgattctctacttggttgccgttggtgtatagaaaaactattgatttgtgtacattaaccttgtatttggaaattttgctgaattcttttatcagttctaggagctttctggaggagtctttagggttgtcgaggtaaacaatcatatcatcagcaaacagtgacagtttgacttcctctttactgatgccctttctttctttctcttgtgattgctctggctaggacttccagtactatgttgaagagcagtggtgagagtgggcatccttgtcttgttcctgttctcagagggactgctttcagcttttccccattcagtattatgttggctgtgggtttatcatagatggcttttattacattaaggaatgtcccttgtatgccagttttgctgagagttttaatcataaagcaatgctggattttgtcgaatgctttttctgcatctattgagatgatcatgtgatttttgtttttaattctgtttatgtggtgtatcacatttattgatttgcatatgttaaggcatccctgcatccctgatatgaaacccacttgatcatggtggattatctttttgatatgttgttggattcagttaactggtattttgttaaagatttcaacatctgtgttcatcaaggatatcagtctgtagttttcttttttggttatgtctgtccctggttttggtattagagtgatgctggcttcatagaatgaattagggagggtttcttatttctttagcttgtggaatagtgttaaaaggattggtaccaattcttctttcaatgtctggtagaattctgctgtgaatccatctggtcctggacttttttttgttggtaattttaaaattaccatttcagtctcgctgcttgttattgttctgttcagggtatctaattctcatgctttactgactgggctagctgggtgcctcagggtatctaatttttcctgatttaagctaggagggttatatttttccaggaatttatccatctcttctaggttttctagtttatgtgtgtaaatatagtagccttgaatgatcttttgtgtttcagtggtgtcatttgcagtatctcctgtttcctagtgaggttatttggattttctctcttcttttcttggttaatcttgctaatggtctatcaattttatttatcttttcaaagaaccagctttttctttcatttgtcttttgtattttgttgttgttgtttcaatttcatttagttctgctctgatcttggttattttctttcttctgctgtgtttaggtttggtttgttcttgtttctctagttccttgaggtgtgaccttagactgtcagtttgtgctctttcagtcattttgatgtaggcatttagggctatgaactttcctcttagcatcacctttgctgtatcccatagattttgataggttgtgtcattattgtcattcagttcgaagaattttttaatttccaccttgatttcgtttttggcccagtgcttatttagtagcaggttatttaattttcatatatttgcatggttttgaaggttccttttggagttgatttccacttttattccaccatggtctgagagggtgcttgatataattccagttttcttaaatgtatttaggctcgttttatggcctatcatatggtctgtcttggagaaagttccatgtgctgttgaataaaaagtttattctgcagttgttggacaaaatgttctgtatgtatctgttaagtccatttgttccaaggtatagtttaaatctattgtttccttgttgactttctgtcttgatgacctgtctagtgctgtcagtggagtattgaagtcctctactattattgtgttgctgtctatctcatttcttaggcattagtaattgttttataaatttgggagctccagtgttaggtacatatatgtttaggatcgtgatattttcctgttggacaaggccttttaccattatgtaatgtccctctttgtctcttttaactgctgttgctttaaggtttgttttgtctgatataagaatagctacgcctgctagtttttggtatccatttgcatgaaatgcctttttccacccctttaagttaagtgtgagtccttatgtgttagatgagtctcttgaaggcagcagatagttggttggtgagttttgatctattttacggttctgtgtcttttaagtggagcgtttaggctatttacattcattgttagtatcgaaatgtgaggtacccttgcattaattgtactctttgttgcctgagtactttgtttttttttgtttttgctttttaacttgtatttttgttttataggtcctgtgtgatttatgctttaaagaggttctactttgatgtgtttccaggatttgcttcaatatttagagctctttttagcagttcttgtggtggtggcttggtaatggtgaattctctcagtatttgtctgaaaaagactgtaatttccttcatatatgatgcctacttatatgatgccttgtttcactggatacaaaattcttggctgacaattgttttgtttgtttgagaggccccagtcccttccgcattgtagggtttctgctgagaaatctgctgttgatctgataggattttctttataggttacctggtgcttttgcctcacagctcttaagagtctttccttcatcttaacttttgataatcgatggcagtgtgcctgggtgatgatccttttgtgatgaatttcccagagcttcttgtagttggatgtctaggtctctagcaaggccgggaaaattttccttgattattcccccaaatatgttttccaagcttcttcctcaggaacaccgattattcttcagtttggtcatttaacataatcccagacttcttggaggctttgttcatattttcttattctttttctctttgttggattgggttaatttgaagatcttgttcttgagctcggaatttctttcttctacttattcaattctattgttgagactttccagagcatttcacatttctaaaagtgtgtctgaagttttctgacattttgactgttttttcttaatgctatctatttccttgaatgtttctgccttcacttcttatattgttcttttggatttgcttgcattgggctttgcctttctctggtgcctccctgattagcttaataactaacctcctgaattctttttcaggtaaatcagggatttcttcttggtccggatccgttgctggttaactagtgtgatttttttgggggtgctaaagagccttgtttagtcacattaacagggttgtttttctggttccttctcatttgggtaggctccgtcagagggaaggtctagggctgaaggctgttgttcagattcttttgtcccactgggtgttcccttgatgtagtactctccccgttttcctatggatgtggcttcctatgagcagaactgctgtgatgtctctcctgggttctagctacccagtgagtctacctggccctgggctggtactggaggttgtctgcacagagtcctgtgatgtgaactgtctatgggtctcttagctgtggatactagtgcctgttctggtggaggtggcggggtggggggtacaatggagtccgtgagggttcttagctttggtggtttaatgctctctttttgtgctggttgacctcctgctgggaggtggtgctttccagagagcatcaactgtagtaatacggagaggaactggtggtgggcggggccctagacctcccaagagtatatgccctttgtcttcagctaccaggctgggtagggaaggaccatcatgtaggggcagggctaggcctgtctgagctcagaatctccttgggtgggtcttgctgtagctgctgtgggggatgggggtgagattcccaatacctcctcttcttataaagaaaccagtcacattgcattagggcccaccctaatgaccctattttaactaaattacctttaaaagccctattgctaaatatagtcacctttcgaggtaccagggttagggcttcagcataagaatttggggaaagtgggaggcacacttcagtccgtaattctatatatcacttatgacaagttttaaatgacaaagtgaatgttgaagtaaatttttatgaattatcaatggttattacaaacttttataacattctaaagaacttcagctgtaaattatatgggagagaatgtagaggattgtagatggattagcactaattttttttttcccctgagaaactcaaactctatgacctattgcacaattgagtctatttgtatataacaaatagtatttttcataggtattaataaaatatcagtgtcaagtcaaatatttaaaagagttgttaactgaagcgggattagaattaaaggcattagaattaagattagtgggcaaaagatacaaaaactttgctccctgacattcataactgtctgtagatggaatagcagacctgaagattggctatttctttgtgactgaagttctgaattttttgtgctgttatagagtaaatttatgtattgttgagtgtggttctggaaggtgatgatttttcagcttgattctctaagtatactgtgtgggtttttggctttaaaaaggttaagaacttccctttacataatgaaaacccaacaagtaaatattatttgttagtactttaagatgtagattaatcatttaaaaagtcattatgttaaatattctgaggaccatactgttatttctttccttctccctctagtgggcagaaaatattcttaaaatatagcatggaataatttattgctattgggtataccataatatacagtctcagtctcagcttttttgaatactaaaaatgttaacatttcagaatcattaaagcaaacgctttactcctttctaggcataatagtggatccttgaatgttgaagatgtccttaccagctttgacaatacaggaaatgtttgtaagttatacattcactctatagaaatatatttagtgttttacaaagtgaatttatagttgatgttttcttctcactaatatttattatactcactaaatgtatgcatatatgtatatataatagaaagtttgactgtctttagctgcaaaataagccttgtataaggtacaccgacaaaatgggatactgcagtttctaaacttcgcaggtgtgtgtgtgtgggggggaggtgggggagggagagagagagggagatggagagagtaggtcagaaagaacactggacactgaagtactgtcccttttatttttgtttccattttgacctcagttaattcagtagtggggctgtttcttccttctttgctttgtttcgggtgctttctttgccattccctgcttctttactttcactgtagaataaacccagaacatatttttcttgatgctactatacattaataccagagtgtttttgtttgatgcagtattacaatattacagaatatattgccttttcatcaaagcttctgattaattggtgatagatttgtccactgagaaaatcacttaaatatttcttataattcttgtaattaatttcatgtgatgaaagacatcagccaagaatacctttatgtcactgagttaaacagcataccatcataggagctatggactttttatgttttttgtataggacatttctcttaagatagtgaattgtcaatgaaatatgagcattttaaatgtaaaaatagtactcatactctttttctcaaagaaaatttcagaactgttaacttttggctgaatttaggtagtgtctttggcttaacaatgcagttttatcaaataaatagatttgcatagaattgtgttcagtaatactcagacaacacttttgttcttatgtccacattatgataagcttttgattttatagaaaaatatttgtggttcactaaggaatctataaatgtccttaaattatcctaaatacctaaaataatgtaggtttcttttttatggatagtgactgatgtgccttttagtttctttctttttttttaaattttccaaacaccaacttgaacccgaatgccttttagtttttccatgttggcatttagtgaattctctcccacttaggtgtatctcatatttttattaggtctaggcaaggactgggcaaagcataccaatgatggttgaggatacatactcttttagttctggggtaatgttaaatatcattgagtcaggcttaaacatatgtaatttcagaaaatgattctagaatgttaaatgtggaatttttgattcagtaatgtaaaagtcaagtattgttcccagttggctccgtatgaaatagggccactagctgacagcattatgtaaaataaaaataatttcctaaaggcatcaattattattttaggcatgaatgactgtcttagccttctctaacattttttcccatcaacttgttccataccccgtgttgttgttgcatgaacaaacggaaatattgcatattcagggtgttttttcactgttgtctcttgtttggtagaaaggtttaagactttggaatgatactcacctgcatttgacttctggctctgaaattcatcttgagcaatttgtatcatctctatgaacctcaactgttttcatctcttagggctggctgtgttataaagaaagtacgtacatactgcatggctgagagttgatatgcaataaaagttattaattattactggcgatgagtacctatataacctcttttggttttttcctaataaagaagataatattattaggattattctgtcttatactattttaattgaactaacagggcagaaaaattagataaaattagcaaaatagctgtttattaaaatgcctcattataaatgttgccttaaaaacctggatatattgctgagtgatagaagtggtgacaaaaataagacctcttaaaatatgttgttttgtgtaccttttatgtttactttttattttaacagaaaaatctatatagatgtttcatttaatgataaattggtaaagtcctgttccaataaagtaaatattgattatgacttttatataatcttggacgtaaagtaaccatggactgaaaaagtgatttttcacttgatgcctcaaaaatttgattttattatgccaatagtgatattgagtttgtgactagaaaacccagcagagggcgccacaatcataattctttgtcatagcccaatataattaggataaatagctcaaataataaccctaagcttttaccatgtagacatataaagatgtgtctaaacatttctatttgattcatttataatatatttaatatattcagtaattcaaaaatacaaaaaaatagatttttcctggccgattttttaatttttaaaaatatcagtttaatttttctacttctagctttaaataaagaagtacttttgatagagagtgaaagttccatacaagagtatcagttcataaatcaccaccatggtagtatgttaaaggacaattagaatgaggaaaaaagtttctaatagatgagagaaccaagagatggaattatctatttattttaagaatttgtttctaggttaataatgcttcctagtaatagaaaaaacagcttaactaaaacattttctagtcacaaaaacctgatatgtgtagatacagtaaaaaaaggtatggtcatggtttagtagaaccattaatttcaattgtaagttcattttgaatatcaggggatgattatattcattgcaaattttcagagatgaaaggatcagtcttaccttctgaattggtttatgctctaagtgaaaagacgtggaaaaatctctttaattttggaaaataaacctctagataacttatttactattagaaaagataatttttttgtatttacttttttgtatagaagttttgtggttttaaatgtatgaactgcaaagtgttttatatttttgaggtaacttttcattgcttgaatttcttcgaatgttgtgggaagaaattaagaggaatctcgtacagaatgaatcacgtctgcgtattgatttattgctgtgtgatatacgacccaaccttctttttatatatttatatttactatggtggaaaacaaaccattttgaaagtgcttacctttaactaggaataggtatgtatatttcattatttggtttctactacttgagaacctactttcttttgagatatcaaagcttcttggtcaggaggttgtgtctactattgattcattgtgcccagaaagacatgctgacaagctacctagggaagagtataggatgacatctttcacctcagatgaggtactggctgcttctgtgtctcctttgatatgtcgctcagataccttgggtaacaagggagtgctctataagcattgtagcagatttcttgcttctgctttttctgtgggcagggactcctttctagcttgtcctctgacctctggtcaaagaagctgcaccatgctgtctcttccaaaatcattttccttttctccaaagttatttcgttccactactgaaaggaatttttaaaaatgtaattctcagtgcttacttgatccaaatttggataccatagtatctaatttaactatttgttgtttataacatctcatcttatgcttgggtctgtagtagattcattggaacattttaagcacatcatcctttgttgagtagtatgaacagaagtgttagtacttcgtataatttattataaactatgtacaatataatgtatataatcctttaaaggataggaggtcagcagttaaatcatttcagtaatatcattgtgaagcaggattcctggcaaatgttgcagcttaagtctgggggatgtattggtaaaacttctctactattctttgaaaaaaattttttttcttggttgagctccatgacaggaccctgtggtagttggtgtcacattatctcctggaggaatttgtagaccctctgccatatatacttgtacatgtgacagtggtgatttttgttttccctagtgaattctaagactgaccaggattttttttttttttaatggagtttcactcttgtcccccaggctagagtgcaatggtgcaatcttggctcactgcaacctctgcctcccaggttcaagtgattctcctgcctcagcctcccgagtagctgggattacaggcgcctgctactatgtccagctaatttttgtctttttagtagagacggagtttcaccatgttggccaggctggtctcgaactgctgacctcaggtgatttacccgccacagcctcccaaagtgctgggattataggcaagagccactgtgcctgacctgaccaggatttttaatgcacacagctatagactttgcttcctagtggtctgatagcagaatctgtttgtctgtttgtgatgtatctaaaactgatctcttttggggtggtaatcagttattattgaaagcaagactcattaaaataaaagtcaggtgtggaggtatgttcctgtagtcccagctactcagaaggctaaggctggatgattgcttgagcccaagaatttgaggcaagcctgggcaatatagcaagacttttcctgtaaaaaaaagacaatcaaatatttatcttcctggtttttctagaggaaaaaaaattatatgttttcactttttacttgtatttaggaaaccaaaggtaatagtttctttggaaatatggtctaaatttttagtttttctgtttcattgttgttatgttataaagttagggtttggaatgttggtgaaattatcaaagcttcaagaatgtcagcttggattttaaaatgctattcttattcaaataaagatgtctatatatgtaatgcatatgtatgtgtatatgtatatgtagttatataatgcatatatgtagcatgtgtgtatacatatgcatatatacatatatgtagtatatgtgtatacatgtacatatgcagatatataatgcatctatgtagtgtatgtgtatacatatgcattatatatacatgtatgcattgtatatctatatttatatacagatatatacatatacacagtacagtggtttgattaaaaaatgaaaaagttgggcttttatgggtcattgctctgtttttaatttagagtggttatggaaggtacatgggatatgaagttcaggttttagctctgcgggttattagctgtgtaattgtagacgagtctttgtacaagtcttaactccttatgtaaaattgaataggaaacaataagtactttatagtgaggtgaacataatattagataatgtgaaagtaccaagtaaactgtaaatagtatttgtattttttatggttagtaatatcatctgcctcattcttgaattttttcagtacctttgttattcaaaataatacaagatagaagatatttttggtatgtgccattctgttttaatatcatacattattttgttatgtgaaaacaatgtaaagctacacaattaaaatagtgtggcattattgcagaaatacacatataaatcaatatttttagaataaagtgttcacaaagacctaaatatatgtgacttaacatatgatgaagatacaattttagtaagagaggaaaggatggattctttaataaatagtattgggaccattgcctaggaatttaggaaactaataaagctgactccctcctatatactatatgccaaaataaatttaatatgggttaagtatttaattaaaaacataacactcttagatatttcagatgaataattttaatatattgaaatcaagaaggtccttctaagtgcgagtcaaacaccatgaatttaaaggttaatagattgactaatttaagatttaaagaccctttattcaaaaagcgcatcaaaaaaattgaaatacaaattacacactggcaattattatttatgacatatattcagatgaagatgtattttctttataaagagctcttacaaatccataataaaaagacaatctgaaaacctgtaagatagagaaaaacgtagccaaaaatttaagaagaggtatttcacaagagaaatagcaatgttctgtatgtacatcaaatggttattttattaggaattgaaggaatgatttttaaaagtgagataatttttgcttatcaggttggcaaagatgaaagaagttaagcagtaatcagtaaattgtagggaactgggtattctcatacactgttggtggaggggggtaggtaaattaattctacttttccagaggcagtctgattatatctttcataattttaaatatccatatctttcaactaatgattacctttctaaaaaaaaaaaaaagaaagaaagaaagaaaggaaccaggatgggaactgtggctcacacctgtaatcccagcactttgggaagccaaggtgggcggatcacaaggtcaggagatcgagaccatcctggccaacatggtgaaaccctgtctctactaaaaatacaaaaattagctgggcgtagtggcgtgaggctgtagtctcagctactcaggaggctgaggcagtagaatcgcttgaacccaggaggcgaaggttgcagtgagccgagattgcaccactgcccttcagcccaggcgacagagtgagactccatctcaaaaaaaaaaaaaaaaagaaaaagtacacaatattttgttttaaaataatacttttcttgaaggagctcacagcatgttagatgttaatgtattagtcccccattacacttatgagataaggaatcagagatcaaatcattttaaccctttcttaggttgggaaagtacaaagaggttaaagtcagtcagtggcagaatattgagctttgggaatagaaaatttataagttgtgttacaaaataaatatttaaggtcatcaatgcattatgtggttagaacgcatgggtaatgatcagcagccctgagagtataggggacctgaaagccagtggagcactgatggtatgcagcatggcagtggattcttagtccctctttagcatcgtaatgtacatgtagtctttgattcttagtctgtgttagaatttttgaaggttggcttcggttgctagatggcaatttccctagccatgtgtctccaacttcttagctccacagttgtcaggacggttttttcttttggctcaaaatcaggtaagcgtgcccctaattcataaacagagccctacacgtttgttatcaattaccagagaaggaaaaagacacatttgttatcaattaccagagaaggaaaaagacacatttgttatcaattaccaaagaaggaaaaagaagtctctttttaatgtattttaaaaatttctatttgaaataagaaaccacagaattggaatgattctttgacagtagaacttggtgctatcatgggaactgactgaaataaaccctataatcctttgtagattcatatgccttaatcagtgcaataatatagagaggtagctcatgtctttgtcataaacctgctagtttctccctcttttaaatatctaaagggatgtttctaatttaggtacttccaagttttagcacaagatatgccaagaaagtctttttatttttcccccgagcaaatactgagtagttttcctttgtctgtcttttaaatagctaccattacttttgcatcctttacagtatttgtcaggagctttgtaagtactgtcccgtttaataatcttaacgtctttacaaggggtgaggaaactgatgtccagaacaaggtaatttgcttaaagatttagtaggtggtggcacaggaatttaactattctactttatttcttaaaggctacatttctccaaaacggcgagaaatgaattttaaaagtttgtgatgggaattgaaacagaaagtggtaacttgaagggctagaaaataactttggcaaatggaattctgtgcagcagattgtgtctcagaggagactgattaaaggtcaagaaaaatgggctctccagggtttctgcaaggtagttgacaatctaatggaatggggatttggggagtgtggataagggacaaagaatgcgttttcttttaatagtcttaaaccaaatgcgggctttgttttacttcagtttctttcttttttcttttcttttctttttttttttttttgagaagtgctgatttttgtaacgataatacaatagtaataacaagttatgttttaacatagccccttctctaaggtacttctcaagcttatggctatatattttaaaagtgcttacataaacgtaaatcacccaaagagctcaactaaaaggatgttcttgatttttaacaaagttgtttggattgtggatagcctttccacagagaattgttatatttgacatttatatgaactgtgtatattgcactgctcttgttaatgcttgataagaacaaaatatttgatgattgaatgaatttagtgtttgtgtgtatatactccatgttaaaaaaaattttctcttctctgaacttttactctccactcagccctgagtctgaatattttcattattttctgggaggtgggaacagtttgcaggaaggaataaggaaaagtttccaatcattctgtgtgtatgagattgaaaaggcgcatgttttgtgtaattatagatacgtcacatgctcacaatctgcttgtcctggtatactggatcaggtgtagtctttgctgcacatggtaaattcatagttcgtcttaagcctttgcccttccagggttttgaagatcagacttctgtatcacttaatttctgattgattttctacaaaaaagtattgtttttaattgtgtgatagtcaaacacagacaaataatattttggttaatcctggactttgtttttattttaatacttggtgacttaatcagaatttagtggggattgactgcactgccattagatacaagtaagaaatgatatgtgtgggatgaaaaccacaagttctcctctgcttgtgcctatcctctgaatttctttaaaagagaaattaatgtaacaataaatttgttgggggagggggcattgattcttattgccctctttgatctttctcttatttcccacagatttgttaccatttcccttttttccctctctcatctcctgccatctcacattgctactggttctacacctcttaaatacaaaataatcaagaaaaaaaaaaagctaagaaaaaattctaactcttgtatccatcataagaaaactcttgtcttccattttatcccctttccttctgatttcgtcatgatagaattgaggaagacggctgtcaatgtaggatttttcttgcaggaggtgagcctggggtaggtagactggaagaagaagagacagaaacagaccaggttcttttagttagggtgactgtacagcctcgtttgcctccagtggtcgcagttgttcttatcataattattaacaatgcttactttcactcccaaaagtgctctgatttggatgataaattatatgtgtatgtttagaagacaaggaaagagaaagattggaagcttaattatttatagtcatttataactctttatcccagcatagtacctttcacaaagcctgacccaagtggtattcagtaagtatgcattgattcatttgaatcccaagtcatacccaaacaaatctgttcattctacacaagtgtatttatatttgatatgttaatatgttctatataatggagaggtaaatctaagtttcaattttagaggacatataccacaagccctataaactaatagaaactgagttcagaacacatacattttttatttaggtaatacaataatttttaaaaaattacaaccaggatttaaaaatcagaaatattcacataaaaatgtcgatttttcagtttcttttagagaaaaaaaaaatgatctaatggcccgagtctgagctcacatggtaattattatatggaatgagcagggtctttattttgccttggcactcaccactctacccatggacattcagatttgcaatccctgatgcatattgtatatttggaagcatttaagatgttaaactttgtatatttagttatctacttaagatgagccaattctcattagtcatgttgtttatcaaagctatttaaatgaaatacttaaaaattcttttggtgataagcctttttaaaaaaattcaacaagttaatcattaatctttgggaaatattttttcccataccatccatgaatggcaacagctattaacaaatatttatattattttattgaataaaaaataagctaacactattttaaatatttttcaacagccagtatcttcgagaaagcgtatttttgaaacatacttatttgagttaaaattgtgaaatgcatttaaaaattgaaattgaaagtagaactactggagaagttttaaatatttgtgagtacatgtatgtgtgtatgtgcatgtatacttatgtgtgtgtatatatatatatatatatatatatatatatgtatgtacataaaatacatagttaacttgttcttcatttggttcttgtttatttatagattggaacagaaagagcaatctccacaagtgtttattaagttcctattatgtgctgtcctgcattttcaattctcaaatgatttatcaactttgaagtacaaagtagtaaaacattctttctacacatgttgaagaaactactgcaagttaaatttggataaatatctcagtatctgatgcatccaggtacttggatgatttctgtgaactatatctgacttctcaccagcaaacatgttttaaaaataatacaaagacggggcacagtggctcacgcctgtaatctcagcactttgggaggtgaggcgggtggatcacctgaggtcaggagtttgagaccagcctggccaacatggtgaaactccatctctactaaaaacagaaaaattagccaggcatggtggcggacgcctgtagtcttagctattcaagaggctgaggcaggtgaatctattgaacccgggaggcggaggttgcagtgagctgagattgtgtcactgcactccagactgggtgacagagactctgtctcaaaaaaaaaaataaaataaaatttaaaatagctacattgcttcaccaatgaagaatttaccctgctaacaatttttagaattttggcaaaaaaatggcttgaataactacattaaatatgaatttaatggcttgaacatattgtctcaggacatgattttatttgtacatttttaaggtttaatatattttcagttaaaattatctatatgtagatcaatttcttgctttcggagtcttttctgaagccttctgatgtcttccagtttgacctctacaccagcaacaagcatcttgacatcttccctcactatcatcttgaggattcatttcatttcttttgttttgtatctcgttctaaattccatggcttcctttttgtttggtctgttgttttggaggattataaactccagtagcttcctgagaaagtaaggggaagtaattttttgagaacttgtgatactttggttggatataaaatgatagaattggccgggcgcggtggctcacgcctatagtcccaggactttgggaggccaaggcgggtggatcacctgaggttgggcgttcgagaccagcctggccaacatggtgaaaccccgtctctactaaagatacaaaaaaattagccaggcctggtggcaggtgcctgtaatcatagctactcgggaggctgaggcagaagaattgcttgaacccgggaggcagagcttgcagtgagccaatatcgcaccattgcaccccagcttgggtgacacagcaagactctgtctaaaaaaaaaaaaaaaaaaaaagatagaatttaaaacaatttccccttcaaagttttacagtaatgtgtcatagcttctagagttgcatttgagtagtccaatgctattctaacttatcatttttatgaaacttgttaattctctgttgattgaatcttctgttattcccattattccaatattttatgataaaatatctttgtgtggctgtattttcaaacattgtgttggacatttcttgggcacttttcagtttagaaagtcatatttttcagtctggaaaatttttttgaattactcttttaatgactttcttccatctgttttctctgtttctttcagaaacttccattttttgaatgttgtgcatcctggacagttctctaattatcttttcatcttttgttttgctgtttttttttttttttttttactttttctttacttttaacctttctgttgagttttttatttctatttttacgctttttaatgtccaaaagttctttttctcttttcttagctttttcccccatagcattcttttcatatttcttaattgcctttcttgctttttttgaagatattactgaaagttttttttttttttctgtctttatagtctttgtttcctttaaatcgctttttctgtttcttttctttggtctctgtctgttacagtagaggctttcattacatttctgatgatccttaagagttgtgtactacaaaactgattggaagggacactgatattacagtttcctctgtgggatgatctggttgggttgattcttagggaaccctggctgtccatatggtgtttcccttgagctggccagtttatcagagaaaacacttttgagtttgctgctttgggcagtatgtataccttagcagctagcattttggaagatggataagaagagtcctcagttactcaaccccctgattcagttactccacccccaattaaaaagtattttaccttccttaccaccaccctccttgagctgcacgaatgccttccagtctggagagactagacccgaagacatctgacaggatggagcaagggtagttgcacaaatctttggaataagagatgagatttcaagatctaattgttttgtaagtagattttcaacaaattcttctgtgtttagtccatccttgtactctactcgtagacatgtaactccggttgcttcttagcttctcactactgctgatttaagattcagctttttgtgcctttatgaaccttcattttgtttctaaatgtacttacttttattttaggtggggtgtcaggaagagagggaagctaataggtagattcactctaacatctttagctgccatctttaacgcatacacacatatatgcactcatatacattaatttcacataaatgctataatcacttaaaaataaggtaataaaatttttaatacttcatttaattagactacatatggttcttgtcaaatctacactagaacagcatttccagtttacatgtattgagataaatcaccaaggctttgcataaattttagaaattctttcttccctaatttctgaattcttcagccttcaagattcaactcagatgtcacctataaagcttttcctgactctcctaagctatagtttattggtcctttctatgtttacctatagactttttaatttaatataccattaaaacatatcacattgtgttataactatgtctaaatcacttactagactgtaagcttccagaaggcaggagtgatgttttgtttgtacagtgcctggcatataatgaatacccaatatatgctttgtggattagtgaacttattatttaaaaaagcaaaccacactttaagtaaataaattaggatatgattattttagaaaatattcactatacaaaataatttacaatgcatttaaaatttcattacatggcttgttttcccctccaggaacatgttcatattagtatcatttttgcatatgtgtgtacatatgtatgcattttccattgttcttctttagtaggggtgttactcgtcttttaaaatacatacgtgttattttgttacatattggcgatattttcccctccagatatcttttgctaggagagcactaagttgctattcatctagttttttgatcagtgcaatatattttaagcaactagttcaaaaatacattcaaatagcatgccctattcctcatgaattgctatttctttgcttaaatttcccactcagaccaccagcaatcccttaagtacttttcctaccagctaatgctagcttttaaaaatctacttaatgtttctcttttctttctctttgttgcctctgtcacttaatatacctgtgtgcctgtctcgatattgttccttctcaaggtctttttatgcttttaggatgatctttcctagtttctttttctactgtcttagatgctttgattctgctgtttctccattgcagagagcttagtggaaggaggaagtgaatattaagagtgtctttttaaaaaaagatgttatgtataatattaaagagaatataaatgctggtggttactatataactagtgctccaaaaaggattttgataaacttttagagtctttcatggaggcaaaaatacgaaaatgcgttgtgtttaaatttcttagacaaggggaaaagggagcattgaaattgggcaattgtaaaaaatgaatgatagatacatgggagttcattattttctatctctatgtttttgtgtatattaaaatctatctaaatacaaggtttaaaagaggttaagtatcatttttcatttcttttgacccaataatcccacttttgggtgtcagtcctctagctcataaagacagatgagcaaggatgttaaatatagcactatttggactggaaaggaacataacttgaaaacagtctgacagctgtacttccattactaatggaattgttggataaattatagtgtgtccatacaatattatatagcaatcaaaaagaatggattgagttatatgctatattctggagggatgtccaagatgtatttttaggtgttgagtaatgcataaaatgtaatttcattttaataaaaagaagctatgaatattgcaaaaagctgtgaaggcatatataccaatttatcaaagttgcttattttaggaaatcggaacttgaaggaatggggtagaagaaaaattaactttattaatctttgtacttaatttgtttcaagtatgtgttacttttggggaaaatgtaatgaagatttgaaaaaaatttaaaaataaaatatttaaaaaatgaatgtcaattcatccaagataataataactcatttttaaagctgtaaagagacacagaaagtgatatgcataagaaactaaatgatgaattagatcataatttgcctttggaaagaaacataaatggattgatagctcatgcctatgaaatgtatattcaactctgattctattcccaaacttctaacagaaattgctgggtaataattagaaaggagactttggccttttatatattaattcagtattctcctaaaatctgtgcctaaactttaagcctttttgttatggtaactgaaccaatcaatttcatagttaaagatgtcccattttcaacagaccatatttaacttggaaccaagggtatctagttatatcagttagggttctttggttgtgagcaacagaaactgagtctagccaacttagacaaaaagaaatgtattggaaagatactaagcaggtaatagaattcatgtttcacctgacagttgggcatttctttttgtgttttagtatgcctctaattatattctctgctttcaattatagcattgctccaaaagttcctaaccaagcgcctttgtcattttgccttaagtcttttttttttaattaccattttttaaaaggggaatttatataacatctgttgttcaaattgtgccctagtaaatgttgagtttggagttataataagtttgatttattataagagatattcctattcagatacttacagatagtttcaacctacatattttattttagaattgtcacccttgagtttctctttaataccaccccagtgtctttgtgtgtgtgtgtgtttagcacatttgttttgtttatcttttttgttgttgttgttttattggtaagttttctggggagattaattgtaaaatgtttattaacattaaattattattatttttgagacaacgtctcactctgttgcccaggctggaatgcagtggcaccatcatggcctactgcatccgcaacttcctggacccaggtgatcctcccacctcagcctcccaagtagctgggactatggaagcgcactaccaggccctgcttgttttttgtatggttttgtaggaacgaggtttctccatgttgcccagccaggctggtctagaactcctgggctcaagcaatccgcccaccacaccacatcttcccaaagtgctgggattacaggcgtgagccattgcgcccagccaaattatttttttatatctatgctattctttataatttctgtctacttaactggaacagtctcttgtgctttttaattggattccagacatcgtgtgtaaaaggacagcagggactaaggtaataagattcatgcccaaaagtggtcatgcctcttctgttaggtcattagtgtaggagattaagtcaatttaggcagtagtgaaactgagtttggttttgttgttgctgtagttatctgcagttgttctggtgggctatcattatcttgtgcttagtttagagcctggggtcttagagagtttttttcaataattttgctcccttcacagctttcagcagactttgcacccctgtatgacagatctctgtgctcctgagcctctctagaagtagactgttaagttggttcaaggcttgtggtagggcctggagggctcattcttggccataccctgtgcacatgagtctcaggggttagacgttttcaatgtttgtgcttctccccagacggcaatacacttttgctttgtattagtgcaggatccttggcatgagtgggttttctcccctttcacagcagcaggtgtcttttgcctagtgtcagggcaaggtaagaatgaggtggagattgtcttggccaagttaac

SEQ ID NO: 340 - DNA, 1514 bp, Homo sapiens
acaaagtgcctagtggctgattgaattagccacagcacttgtctcctaaaggttcacccaccccttcattctaaatgcattcacggagaactcacggtgtgccgggtactcagatgtcttaatgctagaggaaccatagtgagtacaaagcaggtccggctgcggtgtggcagtgcccagcccgagagggaggtgatgccctgtgctcaaagacaggaaaaaaaaatgctgtaaaaagaattcaaacaggccaggcatgatggctcacacctgtaatcccagcactttttgaggctggggtgggaggatcccttgaacccaggaatttgagactggcctgggcaacatagcaagaccctgtctattgaaaatacaaaaattagccaggtgtggtggtgcacacgtgtagtcccagccactcagaaggctgaggtggcacgttggcttgagcctgggaggttgaggcgcagtgagccgtggtcacgccagtgtaccccagcctgggcgacagagtgagaccttgcttcaaaaaaaaaaaaaaaaaaagaattaaaaatataaagctttttcggctagatgcggtggctcacgcctgtaatcccagcactttgggaggccaaggtgggcggatcacgaggtcaggagttcaagactagactgaccaacatggtgaaaccctgtctctatgaaaaatacaaaaattagctgggcgtggtggcgggcgcctgtaatcccagctatttgggaggctgaggcaggagaattgcttgaacctgggaggtggaggttgcagtgagctattgtgccactgcactccagcctgggtgacagagcaagactctgtcccaaaacaaaaacaaaaaatatttaacttctatgtggaatcaccgtagctagtgtgtgcatgggtatttcattgttaccagaacagtggaaacgctgcatagaactacctcagtggtttatcatctcacctctttgtgtgtgtgtgtgtgtgtgcatgtgagacagagtctcgctctgtcacccaggctggagtgcagtggtgcgatcttggctaactgcaacctctgccttccgggttgaagtgattctcctgcctcagcctcctgagtagctgggattacaggcatgcaccaccacacccggctaatttttgtatttttagcagagacagggtttcgccatgtttgccaggcttgtcttgaactcctggcctcaagtgatccgcccccctcagcctccctgaagcactttcaactgcaagtgcaaaggtcctgaggcagaaagggacatggccttggaggagggtgggggtggctgcaatgtggggaggaacaggcaggtgcagacctggatcttatcctatgtgccttgggcatcgtaccgaagggcttagtccgggaggaggttactgtgtgacatgattcttgcccccaggtcagtctcgatatgctatccatttgtagttctaatattcacaggaaaacccaaatgtaatctcctcattgttc

SEQ ID NO: 341 - DNA, 11925 bp, Homo sapiens
cagtttttcccctatctagtcacatgtcaacaatgagaaatttaacatttgtggattccgtttcttagctgtaaaatgaatgatctagaggtggattgtccaatacggtagctgctagccatatgtggctatttatatttaattttagctaactaaaactaaataaaatttaaaattcagttcttcaactgcactaatccacacttcaaatgctcagtagccacatgtgactagtagctaccttctcagagaacacagatagttgcagtattgtaaaaagttctactggacatgctggtctagaatacttttaatctttgaccagattatttcagcaaacatcctcctaactctgcacaaatttgaaaggtagggtcagcattctcctcactgccctgtgttgtttcccaactacttctattccacccccagtgacaacccctgttttttccctgccactcaacagtactcagtgattccctcctcaatagctaaagtccttgggacatggcctaatctcactctctactataactctggcctgatccagtgtttataaagactgagaatctcaacacagctgcccatcagatccttgaccaccttgctccactccagctgtccactttatgtatctgggaccttctctccagaaataatacacaattctgaaatattaaattcatgtatctcagtctctgcccacagcctccaatccatccagttatttcattcattgtctcctactacacttgctcctcattttcccaatattttcacatccctgatgttttcacttctttcattaggcagcttttgtcctatggtctaatgcttctaccattctcatgtcaataactttgaagtcttactatatttccaggcctacaatattacctatgcctaagctgcttagactggtagagagtacctcacaaaggcagaccttggtactactaatgataatttatggtcttccactcaatcaggctctcagtgctacccagaagtgcttctatgttttcctaggtagctctctttcccatcttccacaaaggctaatttaagtctcttcttttatcctcaattttgcaaagaaccaaggcccatcacttcacgaagaaaagagaaatcatcacaaggatttgccttcaaatttccacagtcaaatccatacactcacctatagctgtcttttcataattccctctcatgcagtaagagacaatccatctgcttggctctgaacccttagacttcactctacaattagaataaccttcctgcttcttctctatttactttctaccctaagctcaaccaatattactgaatgcatgaaagaaggaatgtgaatgactaaccacctatgataaagtacttcagtatatctttttttttttttttttctgagatggagtcttgccctgtcgcccaggttagagtgcagtggtgtgatctcggttaactgcaacctctgcctcctgggttcaagtgattctcctgcctcagcctcctgagtagctgggattacaggcgcgcgccaccacacccagctaattttttttttttttttgtattttagtagagacagggtttcaccatgttgctcaggctggtctcgaactcctgacctcaaatgatccacctgccttagcctcccaaagtgctgggataacaggcgtgagccaccgcgcccggccttgagtgtatctttaaatgctaattaaatgagtttgtttatttagtagggcagtcatttcatgtaagtatggaaataatctgtgatatattcacacactaggatactaatatagacataaataagttaacaaaactgaactacagtaatatgaacatcacacatatattgatttaaaaaaaacactgaagaatatgattccaatgtattaagttcaagagctggcaaaactaattcatcatagaagtcagaagagtgattatctctggaggaagataaacaaactaggaaggaacatgagtgaaccttgtagggtataggaaatttcatgtgtcattttttaggtgatgattatgtgagtatacaaacacattttaaaaatcatagaatctacacttgaaattggtatacattttataccttatatatgttgtctctcaattaaaataaatattagaatactttcactttctagttcttttgtatatctcatagcgccgaaggtgatatactgtatataaacgctgaagcattccatgttttcaaaaggaattaggcttttgttattttatcctaaaatactgaagttctataagaaaccataagactgaagtcacttaacaacttattctcaccctagattactatgtcttctggctaacacagtaattttaatacaatatactttcattctacaaaaaaaaaaaaaaattaacccaaggacttactatagcagttttcattgaaaagagaatttataaacctactcaacttgctgcatcctttatttttgcatcctttattttaaatagagtcctagtttagttgctgaacacataaaattgcttaatcatggctgaatctgcttctcttttgatcatgatttacctttttattatcatccaatactgtgttcatgctctctatccacaaagtgtcaataggaccatcaaatacaacccatttccggtcaggtgtttctgataaggcaaattctctaaaagtgttagccacaataccatcagtccactgaggaggaaaaaaaagaattaaaaagctctcctcataaaattagatttaggagtaaaactatgaaaatacttcacgtttcttgttttaacaggcactttccataagagagttgggaatacttatatttaggttacctcatgagacactgggtcaaactgtccaaaaagttggcccatagtaatagatttggggtttacagttctataaatgaccttttcttcctctccatagccatgttcattcattaaagttagcgtatccgccagcacatgcagaacttttgtcttagcagcaaaaggctctcctactaacataaaactatgaaggaaaagaaataattatacaataagagtctttaaagagttaaataatttatatcagtatataaaactttaccctgtgataattactacttataatttttgaaatcatatgaatttttctcagacatgaagaaaacatatttaatttctgaactgattgactacaaatcaaattcttcactgtaatattattttctccaaaagggaatataataaacaatctccaaatgacaatgaaaacttattatctgtgtactcttaaaaaaactaaacctgaagcccactaaggagagaactgggaaagatttatattcccaaagtcttcacttgccataaaactattagtgttctttaccaactatttctggatctcctccctcctggcacatataggatttctggccctcttgtggaaagactaggtaactagttctaaccaacgggtaataaatggaaatgatgggcattacttccaagcagggataggtaattgccagctagagacctcacagagctcccttttccctctagcatggccgtgacccacaacgttgaggtggtgcttactctaacagcctgggccctgagtggtcatgacgagcagggctgccctggtaacctactatatataaatgagaaataaatctttgttttttaaatcactaacatttgggtgttgacagttcttacagaatatcctagcccatccttaataacagaagttggtacctagaagagggggggatattcttgccataataataataataaaaaaaacctaatgtggcattggcttaaaggccagattgtgagtgacaaattaactggtatcagaagctaaaatatggacaattattgtcatgcaatgaatgatgaaacatttggtaaatgtattccttgagattacctggaagacagctaattacctaaggaaatgagaattttaggtgaaaaggatagtaaacagaatgttattagtatataatgacaggtactggtttcacttaaaaaagaaccataacaaagaaatgagcccagaaaaaaacatggtcagtttgcaagcaggaatgaaagagggagtccagaaattcagggacttctggaattgaatgtatcaagttattctcattcgcaactggtaaaagataaaattaagaaaacctttaaacaaaaatctattaaaactcagtttggcatcaagtatcaaatcaagggtagggtcattgtatcacattattaaaacctatgaaggattaatatgggccgggtggctcatgcctgtaatcccagcactttgggaggccaaggtgggcagatcacttgaggtcaggagttcaagaccagcttggccaacatggcaaaaccctgtctttactaaaaataccaaaattagctgggcgtgatggcatgtccctgtagtcccagctactcaggaggctgaggcatgagaatcacttgaacccaggaggtggaggttgcagtgagccaagatcttgccactgcattccagcctgggtgatagaccaagactctgtctcccaaaaaaaaaaaaaaaaaaagaatataattcccagtaatcatttcaggagaataaaatgattcatgaaaaacagactaagattgtggctccctccacaaagcctgataaggtcaaggatacttccaggaaattttaaaaggtatggcttattaaggacagtagttacggatataggaacatggagctgtctagaatcaaatagataaaaagctgattgtttttgagggagtttactgaccaaaaaaactgtgagtctagtctaaaacataagtgaatgttcaagacttaaataatccttgggaactaggtgtggtggtgcgcacctgtagtcccagctactcaggaagctcaggagggaggatcacttgagccctggagtttgagaccagcctgggcgatatcaacagactacatctcaaaaatacataataaataatatttaaaataatccttgggtattgaatgcataagggttgattgtactattccctctatttttgtatgtttaaaaatttacataatgtttttgtaaccctacctttagaaaaaatcgtgaccattgagatcccaactttctataggcaagaagcaggctcaaaacatttctcaactctcccaagaacagtattttctctattgcccacttcatatgtgcccagagaagaaaatggaaatggaaagacctctcagaaggttaaactaaggcccaagaagaagaattaaactggaaagcccctctcaggtagcaaaaaccaagcagaagtagattcaggttttaagaaaggtggctctctaagtaaatataaatatatatacacacacacataacttacttatataacatatatataacttttacttatataactataaatacaaaatgtccatagccactttaatgacaccctgtataataaatcacatatacaaaatgcttatggctccttagatgaggcccttcaagtgagaggtcctgaagtttaaactctattagtttcacaatcaatccatctctagaactggggccctcacatgaccagctggatttcagaattgtcacattacagtgttggctgtgtcttctattcttcagtttctgaatgggagtgtttgctctggtaaccctgttctgataagcccactattgtgcactgggtttgtggagaaaagataacttgtctttctaggttgtaggtctctggatcaagaggaacaacttccaggtatgatacaaaggctaccatgcatcgtcacctagggatcctgaactttgagtctggttcatttattgattagaacttttaggtgcctccctgggaagggaagagtgtgtttttatgcaaatggtggtatttattagtactaggtcactgaatgagcacttcttaccaacccttgttggacatgtagtatgagaaataaacctttgccttttaagccactggggggccagggggcgggcgggggttgctctcaactcacctaatcagtttgccaagtctttggttcatggattttagttgttttaccagcttaattaagaaataacatctaactatagcaatatataatcttacccatgtctaacaatcatcatttcatatgtttgaattattttttcaagaaaaaatttaacaggctgaagattatgtacattgcaggcttcatgagcacattccaaaaattcctgaaataaaaaaaagtaatgcatttctacaacacaatattataaatgtcatacctgtcttataagtgtagattttaaatttactagttaaaaaaaaactatcatcattgtttattatttcttaaaactttattattttttcaaatcaagaggagaaacatagactcaaaatacttttaatgtattagtcttccctattgtaagttatgaatgatcatagcatgatagtactgggtgtatgctgcatgaaaataactccttttaatagtgtttcccagaatttcacttttggttaggaaatagaaagacctgtcagacaatcctgcacacttgtagtaaccagaaataaacaaataagttttttaaaattataaaaaatttaaacacatagaagtactttggatgcaaataaatatataaaagaactcagtttcagaaagggatgatgagcctttcctaggtaagcacaaagcaacagctgttttcaccctagggacattttctaagtctggacttggtggatatcggattgggcctgctatagacagaaggacttagccaaagtaggaagaaaccaatagagattttaatggttgtgtgggcttatgtgacagatttgaatttggagaagcccaaatgccaagctggttctcccgaacatccatgcttttgctcagcatgtagtgacacaagagaccaagggcttggctggaaagacacacagagagatttctttagtctcagaatgcttagatcccaaaatcctactacagggaagggccaatcatatggcaggacaattcttactcagaagacatttgaagccagaagtaaactacagctcagtaatgctgcaacaaaactctgacttaggtcaacactcaactgaattgattagcaatgcaacctagctacctgaaatagggaaaaatctcatgatttttctgcaggaaaataataccacctggccaggtgcggtggctcatgcctgtaatcccagcactttgggaggccaaggcgggtggatcacctgaaatcaggagttcaagaccagcccgcccaacatggcaaaatcctatctctactaaacatacaaaaaaatcagccaggcgtggtggcgggcacctgtaatcccagttactcgggaggctgaggcaggagaatcgcttgaacccgggaggtggagcttgcagtgagccaagattgcaccactgcactccagcctgggcaacaagagcgaaacttcgtctcaacaacaaaaaacaaacaaacaaaaacaaaacaaaacaaaacaaaacatcttagcctgtataattattttatacacattgtttaacatacaatcaaaacttaaggttggacgtcctagccagaacaatcaggcaagagaaagaaataaaaggcatccaaatagaaaaagaagaagtcaaactgtcttctctgacaatatgatgctacacctagaaaaccctaaagactctgccaaaaggctcctgaaactgataaatgactatggtaaagtttcaggaacaaaatcaatgtacaaaaatcagtagcatttccacacaccaataacattcaagctgaaagttatatcaagaatgcaatccggccgggcgcggtggcccacgtctgtaatctcagcactttgggaggccgaggtgggtggatcatttgaggtcagaggttcaagaccagcctggccaacatggtgaaaccccatctctactaaaaatacaaaactatctgggcagtagtggcacgcacctgtaatcccagctacttgggaggctgcagtaagcagagattgtgccactgcactccagtctgggcaacagagtgaaactctgtctcagacaaaaaaaaaaaaaaggaaagcaactccatttacaatagacatacacacacacatacacacacacagtaggaatatatctaaccaaagagataaagatctctacaaggagaactacaaaacactgctgaaagaaatcatagatgacacaaatggaaaaacatcccatgctcatggattggaagaatgaatattgttaaaatggccatgctgctcaatgcaatctacggattcaatgctactcctatcaagctaccaagattacttttcacagaactagaaaaaaattattctaaaattcagatggaaccaaaaaggagcctgaatagccaaagcaatcctaagcaaaaagaacaaagccagaggaatcacattacccaacttcaaactataagattacagtaaccaaaactgtatggtactggtacaaaaatagtgacacagaccaatagaatgactagaaacccaaaaataaagctgcacacctacagccacctgatcttcaacaaagtggacaaaagcgatggagaaaagacttcctattcaatccatagtgctaggatggcttgttagccatatatagaagaattattggacccctacctttcaccatatacaaaaattaactcaatatggactgaaaagttaagatctcaaactgtaagaatcctagaagaaaacctaggaatcaccattctggacactggccttgggaaggaatttatgactaagtcctcaaaagcaatcgctacaaaaacaaaaactgacaagtgggacctatttaaactacagagcttctgcatggcaaaagaaactatcaacagaaaaaacaacaacctacagaatgggagaaaatattcacaaattatgcatccagcaaaggtctaatatccagaattgataaggaacttaaacaattgaacaggaaaaaaaaacatttaaaaatgggcaaaggatacgaacagatgcttctcaaaagacatgcaagcagccaacaaatatatgaaaaaatgttcaacatcactaatcgtcagagaaatgcaaatcaaaaatacaatgagataccatctcatacaagtcagaatggctattactaaaaagttaagaacaacagatgctggcaagcctgcagagaaaagggaatactcatatgctgttggtaggaatgcaaattagttcagtcaccgtggaaagcagtttagagatttctcaaaaaacttaaaacagaactaccatttgacccagcaatcccattactgggtatatatccaaaagaaaataaattgttctaccaaagagacacatgcatgcattatgtttaccacagcactattcacaatagcaaagacatggaatcaacctaggtgcccatcaacagtagattgaataaagcaaatgtacatatataccatggaatactatgcagccataaaaaagaacaaaatcatgtcctttgcagcaacatggatatagctggaggccactctcctaagcaaattcacacaggaacaggaaaccaaatactgcatgttctcacttgtaagtggtaggcaaacactgggtactcatgaacataataatggcaacaacagacactggggactactaaggggaagagagagggaggggaacaagggctgaaaaactaactattgggtactatgctcagtacctgggtgatggtatcaataatacctcaaacttcagcatcatgattatgcccatgaaacaaacctgcacatgtaccccttgaatctaaaagttgaaattcctttaaaaataagtaaataggccaggagtggtggctcatgcctgtaatcccagcactttgggaggccaaggtgagtggatgggttgagcccgggagttcaagaccagcctgagcaacataacaagacctcctctctactaaaaatacaaaaaaattagccaggtgtggtggtacattcctgtagtcccagctactcagaaggctgatgtaggaggattgcttgagcccaggagttggaggctgcagtgagccatgattgcactgctgtactccagcctgggtaacagagcaagaccctaactctaaatagtcacttcataacagaaccaaaaaaataatgaagtcatgagaaatagctgatgaccaagagaaaaaacagtaaacaaaacaaactcatagatgacccagatgtcataattaacagataagaacttgacaatacatttacaaagtataaaaagaatagattataagatagaaaaaatagaggaaaaaatatagaattttagcagaaaagagaactctctaaaaagaaccaattggacacactagaactaaaaagatcaaaatatgtgaaattaagaattcattgaatgggcttatcagcaaactggacaaagccaaagaaagaaccactaaccttgaagataggtcaattagaaagtatccaaactacagagagaaagtaatgaaaaacaaaagagaaaaaaagaggcatgagagacacatgaaactatatagaatggtctaatatacatgtcactgaagttccggaaggagagaggagaaaaaattaaggcataaaaacatataaaaagataattactgaatattttctggctgagtacagtggttcatgcctgtaatcacagctctttaggaggctgcttgagcccagagcttgataccaacctgagcaacaaagtaaaaccttgtctctatgaaaaataaaataattagttgggtgtggtggcacgcgcccataatcccagctacttgggaggctgagatgggaggattgcttgagcccaggaggttgacaatgcagtgagctatgatcatgccactgcactccagcctcggcaaaagtgagaccctgtctctaaaaaaagaaaagaaaaagtaaattttctggcaaaacacatcaacacacagattcaagcagcatagcaaatcccaggcaataaagtacaaaacaaaactaggcacatagtcaaactgctcaaaaccaaaaaagaaaaagaaaaaatattaaaacagccagaggagtataaataagaaaaatgcctgacttctaagcacaacactgaaaggcagcagtctatgaaataacatctttaaatgctgggcgcagggtggggtggggaggagacaccttgccaatctagaattctgtatctgtgaaaatattcttcagaaataaagattaaataaagacattttcagacagacaaaaggtgagggaatttgttgccagaagacccatatacacacaaatactaaaggaagttttttaggttaaaaataaaaaatccaaaatgaaaacatatatctgctggaaagaataaaagcactagaaagggtagcgtaagaggcttttttttttcaaatacaatacttaaagcagaaaataataacaatgcattgtggtgtttacaaaatatatagaagtaaaatatatgacaacaatagcacaatgggcaggagtgagtggataatgaaactataccatttaaggtgcttatattttttgtcaactggtaaaatactaactgtaaagttgtaataagccaaggatatatactgcaacctgtggagtgaccactaaggtaaagctataaagccaatagagaagataaaatggagtgataaacattttttgaaatccaaaagaagtcagtaaaacaaatacagaacccattaaaaagcaagatggcaatttagtactatttttccaactggaatctacggatttattgcagtattcataagagtacataagagttcttcaagaa

SEQ ID NO: 342 - DNA, 11243 bp, Homo sapiens
tagcaacaggctacagatatttcaggtgaaaccacattttttttgttacatcgacaatgtgtaatttaaaaaattattttggggaaagatggaggttttactttttaatagaaaagtttgtatttcaagtacatcagtccttaattgtattctaatctgctaaatgatgcaattgactcctctgtctccctccatgctcctctccacagaatagctctctgtatttttagagaataagactgattctcaacttaagaatataacttattttagttctaagcatttcatttgatatgtaaagtaataagaaatcatagtatagtaaaatttatcaaaataatattttaaatattggcaaatgttttccctctgtattcattattttgtcttccttttgcatccatctctttaagtttccctacttctttgtcctatctcctctgcctgtacaatactcattggatcaggccaaccattcaccatctttttctacactcggattgctgagcgcgtctagagaaagttcacacatccacatggattaatactttgcaaattcatggattcctatgtgaacttcctcctcaggagcatcaagcaattctcttctttgctcctgctctttttcctgtttcccacagtggctgaatagtgtgattagttcttttcatgtcccctttcccacctgcattcttagtaatcaaaaaaaaaaaaaaaagatcagatgcctactgtgtggcttgctcaggagaaatttgatgaagaagtggttcttacctctaagctgctaaaatctgatagagagatagcaagctagagagaaaactgcaagtgcgatgagagctgtgacctaggtatgtgaaattgtgtaatggaaacagatgggctgttagagcagatggagaaggcttcctgaaagaggaagaatctaagctgcatcttgaaggactaattagagttagccaggggaagacggaggggaaaaagaaagttaggcagaatttgcagctcatacaaaggcccggcagagaggaaactagtagggcaatatggggagatgtaaggagtgcagggtggggtcgtgtacctttgggatgcggtactaaagaggatagtggtgaggaacgaggtgacagagtgggcagcgagcaccagtggagggcccggtaggcaataataaggagtctgaattctatcttgagggttggagggttctaagcagggagtgatatgatcatacttgaatttttaaaatagttggttttttaaagatttttagtggtactaatgtagagactggtttggagagaggaagatcaaactgagggcagttttggtagtaaaagcaagaaattgtaaagagggagaccaagcaagtgacacctgtataatgaagaaaattggatggatcatgaatttattaacgaagcagaattgacgggcctgaaacctggtttgagggaaaaagttaaaggtttccaacttgggcatattgacgaaggtagaactacttatcgaaggagggcatgtagtaggaggagtagctttggggcttgtttgagcggatgaccttgttttcaagtttgcagagaaaatttagggcatgtgatgtaaaccaactgattagtcagcaactgggacattatgtgccaagattttacccaggggtgtggttgctaatgtagccaggtattgtggcatgtgcctgtaatcccagctactcaggaggctgaggcaggagaattgcttgaacctgggaggcgaaggttgcagtgagccaagattgcaccactgcactccagcctgggcaagagagcaagactccatctcaaaaaaaaaaacaaaacaacaacaacaaaaaaacccaacaaaacaacaacaacaacaaaaaaaccatctcaaaaaaaaaaaaaaaggcaatgtagggcacatcttttgcctttctgtaccttctgttctgcctgtctctcgaggtgtgagccaaacaggctgtttggcatgcacttcactgggatatgtgacttgaggtcagatttgtagacacaacccttttcaaaatgagatgtactccaaccccctaaaaaaaacaggtgccaaaggctggatgtgtgaaggcagaggtgccttatattgggccttgggtcctgatggtgctctctcatgcaaatttattttggggagttcttgggcaccctgctggcctgttgacaaagctgatactttattcctgttcagctgatgctgtgggtgtttttatgttacttgcaacctgaaggaaaaaaaaggtgagtgattagcatccatcaatagtctttacacattgatgagtttttaaacaccattattttaatgtattctaactttagtgttattgtttatccttccttagtgttcacatagtcccactcttcatagtgaagagtcctatggactcttcattcagtacatttattgaataaccaccatgccaaccaccaaggaatacacaaagtacaaaatatggcacttgccctctaggaactaagagttcattcgagttcacctggtatcttcatgccttcctgatctgggtcctgtaaaatatactaacgtatctgtcagatctgtatttttgtctaagccttgtgaggtctgatgctggatattctccagggctgggaatttagggttctcgggaatatgctgtaccacttacacagagtgctcatatgtcctcacagatgggttacttctgttggcatttgtgctttgaacattgctaatatttagcatcccaaatataggatattcaaatcccaattcaaaaggaaaaattaaaagacatgtgcattaactttggtgatttaagttgttagaattatttcaaatggtgttaaaattggatcttcttttttatagactcttcattgcatgtacagaaaacaggactgaatggattagactaacactttgctcatttgagccctgtaggatagagatggccagtctaaattactgaaaaatcctgaattgtagagttttaaaaatgcagctttattacttttagatgtacttatgggaactcgaaatataggccttctggagaagaagaagaaataattttatataaaatgaatgcttttagaatgcttgaaagcgaactttcctaagtgtttaactttttctctgatagcttggtatcagtataaatttgcttcacaaatccttattttatagctattacttaataaacctcaacctagcttttatcccaatgaaaataaattccactttaattctactgaattaattgtattttagtacaatttaaaaacctttgttacaggccagtttcgatgatctgtggaggaaatttgttacgtattcatctggtgaacaactttttggattgcctgtgactgattatgaggttttacacaaaaccaggtaagtttagaaaataagcaagtattacatgcaaataattaaatactatctattagaagaatcatgtcaccattaaatcctttatcatgcagaggacactacagcttggagcacaactgaatattctccttattccagctattctttacaaattggacacacagtctcctatacaaaagaaacgttctaggggagtaaaaaatatgttgctaaaattttgagcatgcatggtctatatttagcctatgctttactttttcttttgactgtttttgcatagtgtcagtgattatgcagaagcacagcaattttgagtaacttttgtttatttagaggaataaccttcctggctccccttgccttcttttttttttgagacagagtctcgctctgttgcccaggctggagtgcagtggcgcaatctcggctcactgcaagctctgcctcccggattcatgctattctcctgcctcagccttccgaatagctgggactacaggctcctaccaccatggccggctaatttttttgtgtttttagtagagacggggtttcaccatgttagccaggatggtctcgatctcctgacctcgtgatccgcctgcctcggcctcccaaagtgctgggattacaggcgtgagccaccacgcctggctccccttgccttcttactccatttgtggtaaaatgctcttccccattgggtagacatagaatttattgagattgacgtccaaataagctaattgattataaaccacacatataaacaagtgtatttcaatcaaattttagaatattcttaaagaatttgaaatataactttccttaaaagcaacattaatacagtgatagtattagctcattagagtcttggctttagaaaataagtttatgttgacttccttcaaagccacaacgtgaaaatttcatgaaaatagacatgaaattttctgaagagaaatgaatgcttcagccatttagggtaggtggtttgtattctctttctaaaacagtcattctccaaacgtaatccattagccaattgtgttagaattgcggatgtctggccctcatttctgatttactgaatcagaacctctgggattgggtcccagaaaatctgcattttacacactctccaggtgactgtgatgcacactcagcctgagatccaatgcgttcaccctcaggctagcaggagaaatcatcatcaccatttaccatctggaccaacagaccattttcattttgatattttaaattttatgaataattttagagaatggtgagaatggtgagaagctttgaagttttttttttgtttgttttgttttttttttgagacaggatctcactctgttgctagtactggagtgtagtggtggaatcactcgacttccgtagttcaagtgatcctcctgcctcagcctcccaggtagtggggattataggtgcataccactgggcccaggtaatttttaaaaaattttttatacatacaggagtctccttatgttgcccaggctggtcttgaactttggggctcaagtgatcctcccacctcggcctcccattgtgttgagatttcaggtgtgagcacccgcacccaaccgagaagcactttttttttttttgagacggagtttcactcttgttgcccaggctggagtgcaatgacatgatctcggctcacagcaacctccacctgctgggttcaagtgattcgcctgcctcggcctcccgagtagctgggattataggcatgtgccaccatgcccggctaattttatatttttagtagagacggggtttcatcatgttggtcaggctggtctcaaactcctgacctcagatgatctgcctgccttggcctcccaaagtgctgggattacaggtgtgggccaccatgtccggtgaagaagcacttttattagaagatttaataataatttaagcagagtaaactcaaacttttattctgtaatatcctagtttgaagatgtatatatacaaaatggggaccagcactgaatgagactaactcctcatcggctgtcatgtgtgaacctggagcatatccatgctgtaaatatggatttcatattttaaatcatctccaatggatctgtggcttatcattaattctgacttttcttgcacttgcattgtcaagactcaaagctgttgaaaactcggacagtcatcatttttttaagagaagactgtcatctgttttgcttcataaatattgaagactttacttttagatttgaatgatcaattccaagaaattttaaatttctaaatcatctatttccttgaatacacatctgacttcaacatttgtccacttatgaaatgtatcaaatacaacttatgtaaatataaataatgaaggaacactgtcacttatctttttcacaaaatggaatagtttaggttcttgttgcaaaatattgcatgataaggcccttatttctattgaagtctacggaaatatattgtttacttataaattactggattttataaaattcatctaggttatgatcatctgaagacatagtatgagatttcacatattaatcaatttcaccatcaaaagggaatgctgctttctctttcctgtttaatacttgggaaacacatttctttgtcaattttcttctctttacccttttaggtagaaaatgaaaaattctgaattcttaactgtattaaatgaaagcaactgtattaaacaagcaaaaatcaaaagacaacaaaaatggtgtctctggcattctttttatatacttttttgaaagattttgcaatactttatgttatacagtaagaagcctggaggatgatgcagtagtcatttttttttcactgttgcattaccctttaggcaatgtcatcattctcttttcttattttttttagtcatttttagcatagttgagaataataataagtggtaatgaaataattctaagaatgatgaaaaatgaatcaagaattgaaaaaataggacaactaagatcgcagaatgtgtcttagatttgtaaaatctactacgcctacatggtaattacaagatagaatgggctgggtgccgtagctcatgcctataatcccagcacttagggaggctgaggcgggccgatcacctgagatcaggagttcaagaccagcctagctaacatgatgagacctcatctctactaaaaatacaaaaattagccgggcgtggtggcatctgcctgtaatctcagctactcgggaggctgaggcaggggaattgcttgaacccaggaggcagaggttatggtgagccgagatcgtgccactgcactccagcctgggcaacagagtgagattctctctcaaaaataaaataaaataaaataaaaagatagaacgacttttacttcattacaaaatttatttttggtttttgaagtatctctgatgaagaataaaagttgtgaatgtcaatccttataaataaacttgaaaactaaaactgaatccagtagaaccttatggcatactaagggctgaggaatttctgggagaatccacaaattctgttgagtggtcaatttggtgttttacacatttaagaattttcctttacttggaccttttattcttgttttaaacacagtaacttcatctgggcacatgtgggatttttttttttggataggatcttgttctgttgcccaggctggagtgcagtggtgcaatcatagctcactgcatccttgaactcctgggctcaagcagtcctttcacatcagcctcccaagtagctgggactacagtcacatgccaccacacctggccacatgagggaaaacttctggtaggaatagggtgtttaagctcaatcttaaaggcagatcagggcttagtcaagggaaatgttctcataaaatccagcttgtatttgaaagaaaaaaaagtcaaatgaaaccttagccgcagctatgaccttatcattaagttttggtcacattgtttgcaatgattggtatagtaagtttctcattaaaaagtagcaagattttttttctttacagaataaaccatttgctaatgtcaagttatagtctgacttggaatatttgggagcagtaaacttggccttaatgacagatctttaacgaagtctttgtattgaaaatggatatagttgtatgcatttggtatctataagacattgtacacgcaatgtatgaaatatttgattggatgaactctgcctttccaataatggactttattaaatattatacatgatgtgataacttagttactttgtttcccagaaaagaactcaacttgctgcagaagctgtatggattgtatgacaccgtaatgagcagtattagtggttattatgaaatactttggggagatgtagatattgaaaaaattaatgcagaactgctggaatttcaaaacaggtgagtttcaatggaattttttataatgcctgtcttcttaggatcctataggtatttcagaagctaatttattccctaatataatagtgtatatacataaaaccttcctcaaataaatgtgaaggtggcatattttttttctctttctttctgaaagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggtacataagtgtatacgttcttatcaatgatccattaaagaatgtctgctttttcttttctgggagttgtacagatattttatgagaggttggactaattgccctctataatgcaccctcaaaatttggaatgatcctgaacattcttgacttttatgaaataatcttgtaactcaatgagattatatgattatttgaaatacattatttgaaatacatttgttctggaacccttcaatacatcttccttgtccccagaatgcacttccacttaaaaaaaatttgtttatttatgtattgtgttcttggtgaatccctctgaactattttccaaatttctaattttatgctttttcctgttcagtctattaagtttttagaattttctattattacatttttcctttccaagatttttaattcattcttttttgtggccaatctttttttttcattttttcattaaaaattttctgtcccttttgtagattcttagatctacagtcttaaatctatatatattcccagatctgtaggtttcaaatctatagatttatagatgtcttcgcttatctctttgagcattttaaacataattatttaaacatttttcattagggaaaattttaaacacatacaaaagtaaagatctccttgctctagcatttatcaactcatggccaatattattttatctatactatctttatctatacttcaacaactccaaattaaacataaagatgttttcagattcttctttaagattaatttcacctggactgaatttttgctgtgattgttttttatgttggctatcctctgagccttagatttttttcatgggttttgtaatttttattggggtggctgggaggactcattttgaatgggcaggatttcaaaaattctggcttatataatgtgttaaaattgtctctgtccgtttgtgtcttcgttttccttgtctagtggctttgtggttgcctcctacactgtccatgtcccctcagccccaagttgagagccaggtgttgtaatagcggtctccttcctctactgtgctgtggtgtgatgatccaggaatgtgctgacctatttcaggtcctggttgtggggctggttttgtgtcaccccatcccccaggtccacagttccattaaatctagttgcctagatggcagctagaggcagtgttttcagcctccttccatgaatggagggctttagaccccagcccaggtactccttttcctatagatcatttttactcttcttcaccccatgggaaccaaaggcctggccccagtgtccaggcctcaggcctgtgtttcagctccaccaactggtttgcatagcttttccacttttggttcatggatatgtttgtcttttttttaagtctggctctgtttgcttttttacttactttaaaaaaattattttatccattattctatgtttttggagttgagaaaatgcaccatgtgaccagaaatctcccaaatatatggtttgggttttctgccttcccctacctctttttaacaacatgtgtgcacaaaaagcttttctttcaaagcatttttgtcctatttgtaaatatcactaagaaacaaagaggtagaaacactttggtgaccatctccttcttataagtaggtttttatacttaataatatagccattcgtaggctgtgctttattatacaatttcaagtaattccaggcttctgttaatgactcttggtacacaaaacagagtcttggtactgtctaccccagatacatctagttgctcagccacacatgctgtaccattagccaaattagattcctgctgttactggactcactgcctctaaaggaaggcttcccttcagtacagaatttcctcttcctcccagagagtctctgctggaatctcacctcctcctctacgaagctgttcctcctcagcacagacctccctcctcagaaatcaccatggttcacatcattcttaggacatttattacacagtaatttgtgttaagatcatttgtggaaacatctcacacctttaaattctttttcatctctgtgattctaactatgaacacacattgaggcattgtggggaaaatatgttacttttattttctttcgtgagtctttcttattaagtattctcaaaaaaaaaatatagaaaaacccataagaaaaaaacaactgatgcttaagcaaatgagatattcatattaggaccagaacaggcagaaatatagtaatatctatatgttacttgaaagagttcaaaagactcttatgtatattctcatttgaatctcatagctaatctctgggataaacagggcagctgtgattatccccattttagccaaaagttcgaattgaaaacataatctgaaaaatgatgatttaagttccattgtttcatgtatgtggtacagaaaaataattagtagtcggcgattagtaaataattagtaaggctctagtgtcaagttgcaacacaatgatctgaagccttttcttggctgtaaaatgactaaatgaactgggtgacttacaggtccctttcaagcaaaaaaaaaattctatgatttgatgatgcacttaatttgtagttgaaaacatcatgacatatactttgcttttccttcaaaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacaggtaattttataatttgagagagagatttaaatgggatatttagggttataaaattctaagtaaaagctcagttttaaagctctttc

SEQ ID NO: 343 - DNA, 5603 bp, Homo sapiens
acacctcattccataccagaaacctctaaacctttgttctgtttcaaaaagttaggctggctcgatcagatttccctctagggagtgtggaattgggaaactgtggaccaaatcagcgagcaccaagaacttacagacgtgtgtgctgcagaaaggggcactgactggtgagactggggaatttgagagagtgataagcagggtggcaaccactgtaaaccatggcaaacaaggttatgcaaaagggaagctggaagaaagaaaggaaggcagctggtggggagaggagagggggcagattggcagagagaggtagagactcaaagagagacagacatacagacaggtgactagtgccgcctaaattcctaagatttccaagtcctggccacatgtatcctgtcaataaatttcccctacttttttatagtatcctgaatggcctttgtcctctgactctgttcacataaacatgcgtagcctcaaacaagaagagaggagggatcaggaggctgggggtgcctcctgctgggaaccacagccaccagctaatgccccttttacagtatcttactttgttgtttctccttccaacaactagtctggatataatcaatgtaatccttctctattgttttctccaagtcatgcagagaagctcctctgtaggccttgtcaaagtttttatccacaaagtaaggcacctgcaggttctgagtttctctagaaatggtgtagcccaaggtcctgaaacaaggagagagaggctcatgtgagctcataatatttggcaatattactcttagcactgccctcacagatatcatcatcatcatctgctcatagagcagaggcagatatcattttctaatatacccaacacttcttatttccctagcaaagttgtaagtataacatcatcataattgtattatgtaagcaagttcatactatgaattcagcttcagcatagtttattctcttaaaggactcacctctcttatactgctctctgtgctaaaagtagaatgctgaatgcttaaaacaaacaatttttacgttgtgtaggatctagtatggtacctgacagagtaggctattataaatgctggttgaatgaactgattatgttatatagcaaattatttacaaaaaaaacagatagctcacaccaacctagaagcaatattttggacatgataaaaagtacttcgcacatagctgctaactgagaactgcaagaaactcagacaaaagatttcaatgatgctttagagctaactctctgtgggtccaagacatccaaaggtatctggtgcttagcaacattaataagagtactgagctgactaattctaaccataaggaaacatagaagggacctcaaactcaagttaaaacaatgtgacagaaatggttttcttcaaactggacaaattctacattaaaggggctatattttatttggcctttttccggccctctcctttgatcctctctaattagagtaagagctgaagccatgactgctctcccctcactctaaggttttgggggagcttacagagcaggtccgtgcttaccccgctggcctcacaagaaagaaagctaaagtgccatatggaaaaacatgagaagctgggaaacagagggaatcaggccagtgtggcctgatggcaaaaacctctctatgaaggctaggtgcagtggctcatgacggtaatcccagcactttgggaggccaagaaaggtggaggtcaggcgttcgagaccagcccagccaacatggtgaaacccagtctctactaaaaaatacaaaaattagccaggtgtggtggcacatgcttataatcccagctactcaggaggctgaggcatgagaatcgcttgaacctgggagaaggggattacagtgagccaagattgcaccactgcacttcagcctgggagcctgggtgacagagcaagactgcttcgaaaacaaaaacaataaaaagaaacctctctttcagcctcagcttcgctctctgtaaaaggaaaatactagccgggcgcgatggctcatgcctgtaatcccagcactttgggaggccaaggtgggcagatcacctgaggttaggagtttgagaccagcctggccaacatagtgaaaccctgtctctactaaaatataaaaattatccgggtgtggtggtgcgtgccgcctgtaattccagctactcaggaggctgaggcacatgaattccttgaaccagggatgtggaggttgaagtgagcccagattgcaccactgcactccagcccaggcgacagagtgagactctgtctcaaaaaacaaaaacaaacaaaaaaggaaatactgacctggattgacctggaatgatggtcttgtctacagtgatcactgacaaagactcttcctgttatatattgtctaataaattctacttttaaaaggtttttttcccactaaattataataatgaataataatttattattcattattaacaaaaaagataatctagtgattctcaaacttcagtgtggaccagaataatctagagggttttttaaaactcagacttctggtcctacccccagagcctctaattcaatggatatggaggggccctagaatctgcctttctaacatgttgcctgttgatgctgacgatggctggtctggggaccaaactttgggaactgaatcaactgaaagaattaattgaagaaatttttaaaaatcctatcagagtttataatctatacgcaaaaagcattacaaggaatttctctattttcaacaaaaacaaaaaaattgaaaataatcacttgatccccattattaatactatgctccgagacccacagggtccagcaatcctatcaacagcttaacagagtctttctaactctaccatggtgtgataatgagttcatctaaaccttaaattctactgatccttcaaaaaccagttactgctgttctgcagctgaccagatgatgtcactatagaacaagacaatctatttcccgaggcacacaggagactgcctcagtatttttgagtctcagcaccatgactacccagctgttcctttaaacatcaaatcggtgttttctacagcaaaaggtgaaatgaaatgttagtaatgtatcagcaaaaccttcaagtctttcacccccagactgttactgagaaagatttagaaataccagacttacgatttatagaacagactatatgggggattagtagccagcagctgagtaatgacagatataatcacaatcacaagaactggaagtagctgaataaatgcagaatatgtagtctgaaaaagaaaaaaaaataaaaacttgctgtaagtgttcttttttttttttctgtcgcccaggctggagtgcagtggtgcgatctcggctcactgcaagctccgcctctcgggttcacgccattctcctgcctcagcctcccgagtagctgggactacaggcacccgccaccacgcccggcttagtttttgtatttttagtagagacagggtttcaccgcagccaggatggtctcgatctcctgacctcgtgatctgcccacctcggcctcccagagtgctgggattacaggtgtgagccactgcgcctggcctgtaagtgttctttatcaatataaagcttattgaaaataagatagttgctccaaagaaaataacaaattatcaatgcactgcataggaggatccacaaagccccaggcttttctgggaaggctgtactttcagctgagaagtacaggttgggcagtcctaatcagaaaattcaaaatcacaaatgctccaaaatctagaactttttgagtaccaggatgacacttaaaggaaatgctcattggagcattttggatttcctttttttttttttttctgagacatggtcttgctctgtcacccaggctagagtacagtgacacaaacatggctcactgcagccttgacctcctgggttctgatgattctctcgcctcagcctcctgagaagctgggaccacaggtgcacaccaccgtgtccagctaatttttaaatttttgtagagacaaggtcttgccatgttgcccaggctaatctcaaactcctaggctcaagcaattctcctgcctcagttcccccaaagtgttaggattacaggtgtgagccatagcacccagcctcagattttcagattaggaattgtcaaatatataatggtataatgcaaatttccaaaatccaaaaaaaaaaaaaaatctgaaatctgaaatactactggtccaatttacttcagataagggatactcaatctataccaaataacctttactctctctgctgagcaggctgaaggaggtccaacaacaacctggattgacacccagtaatccccctgcagccccattaataagaccaatgaagcaaacatctctaggtaaacctgcccagactgtgcctcttacagtagtggggctctaggagccaggttagcatcatgcttggccacagctgattggactcaggggacatccaactctggcagaggtaatcacgttttctctcctaggaatttggggttgaaactcatcacccttcacttctgggtcatcactttaaggaagaacacacactctcaggcactgtagactggctatttgcaaggggaagtagaacaagcaaagctgcttggtgaaaacaaaacagaggcaaagagtggcaggaaaactggagacaatctgggcccaaagagtcctgcagagcacagctgcttgggagcctgacagtatcccagttccttgttcctgtctgtcatgaggcccagctgtgcttcttgtccttgagcttcatgagactcttttgatcccttaccttaaaccccctttagttctaaatattttgaagaggattcctattttctgcagccaagaaaattatgaagccggagcggtggctcatgcctgtaatcctagcactttgggaagccaaggcaggaggatcacttgagcccaggagtttgtgaccagcctgggaaacatggtgagaaataatctctacaaaaaatgagctgggcatggtggcacgcacctatagtcccagctacatgagaggctgaggtgggaggattggttgagccctggagtttgaggctgtagtgagctgtgtttctactattgtactccggcctgagtgacagtgagaccctctctcaaaaaaaaaaaaaaaaaaaaaaaaaaaaaaaaagccttgatgaagtcagccccacagattgctgagattctgggagagccacccaagaatgggcagagggaggggataccattctgcctatttaggccaattttccagctcttctaaccattgcttttgctttcctaaagcacatctttcctaaagcaacatatctcaggttcaacttctaaaacttgaccatgtaccatcaaggttggccaagtacaactgtttatgggcagcagtgctcctccctccctaggtacctgaggtttctcttcttcctcctccttctgagtctgtgtcctctcatgtcggtgccgtcgacggtaatagtaagtgt

SEQ ID NO: 344 - DNA, 231983 bp, Homo sapiens
ctggacaaaacaacttcaatccttaaaaagtcctacccattttagaaacaggtcaatgaagctacctgttatgattgtagaagtcatgtctgcttactgcacctaatttgagaattacagaaaaacatttttaaaaatcacatattattctatcactcagagataaacattgatagtgtttttatagttcccagtcttatttatatatttgccttctttttttgctatttgtttaatttttaaaccaaattcggattacatagcaatgcaattttcccatattattagatataatttttgaaagattttaaaacactaccttatgttccataatttatttaacaatttcactgtttactgacagataatttagagtacttaattattctataaatactataataccaaagtataataatgaatttttgcctgcatctctatttctttaagaaagatttctataaatgagattactagatcaaaaaacattaaaaaattctttttctagggagaatatccccatgcccaattccactacatttgccaactagctgaaaatgatggggttttttttgcatgttttaaattgttatataatggtattagattgcattcttctgaaactcattttcaaaacatctttactcaacatatatttatagttattcttgttactatatgttgtttttactcattctttttttgcttttcgaaaatcgtctcttagttgaataataatatttatgtattagctattggtgaacatgtacgttttcctgaattatcaaaaagatactattgtaagtatgttgtgcacattccccttggcatgtgggccatgggagttgcatgtcttcaactattctggatgatgccacactatattccacagtggctgtaccagtttgctctgtgaatgataatcttcattgctttacaacctctccaacacctagaattgttagatttatttttccctttaattttgacaattggatagatgtaaaaagctatactgtgctgattttagaaggcatttcctgattacttttgcagttgtacattctttcattcattaattgtccatttctgttgcttctccaatttatgtttcttcagaccccttagttatttttctattgatttttatttctgattacttgtttgtattaactctttttatatttcatattaattttctactatgaaacattctgcaaatacaggcataacctgaatgatgttgcctcgattaacattttcatggtaaaatgactcttggtttttaaaatccaaatttcatcatctatttttttttttttgccaatgttcatgtagcaaaactttagatttataataccaaactctgcaaaactttcaataaaaggaaatataggaaaatcatcaagatattttcaaaacatattcagtagaacatcagaataatatatagatattttggaaagcaagctgagtgacaacacacgaaacacccatttcagaagttgctgatgctaaaaggccatcataccatcagtgtgagccacacttggccaccaggcactagagcacatttcccagtgccttccccattttactttttttgcttattgttgaaatccccaaattgttgagaaaacactgaagacaattgtagagaagaaaacaaaacaagtgagaatagctactacgtacaaagcaaacattttataacatgttaattgtagaagtcatcaaggatataatttttttaagtacaagtgatcgaggatataatttttttaagtacaggcataccttgttttactgcactttgtttcattgcacttcacagataatgtggttttacaagttgaaggtttgtggcaactttgcatctagcaagtctattggcaccatttttccaacagcacgtgttcatttcacgtctatgtatcacaatttggtaattctcccaatatttcaaactaattcattattattatgtctgttgtggtgatctgtgatcagtgatcttagatgttcctattgtaagtgttatggagcccaatataagatggtgaactttatcagtaaatgtttgtgtgttctgactgctgcactgactagccatttttccctctcctcaggcttccctattccctgagacacaacaaattgaaattagtccaactaataagcagacaacagcttctaagtgttcaagtgaaaggaagagtcccatgtctctccctgtagatcaaaaattagaaatgattaagcttggcgaggaaggcatgtcaaaagctgagctaggatgaaagctaggcctcttgcaccaaatagccaagttgtgaatgcaaaggaaaagttcttgaaggaaattaaaagtgctactccaatgaacatacaaatgataagaaagtgaaacaggcttgttgaggatatgggaaagtttgagtggtctggatagaagatcaaactagccacaacattcccttaacccaaggcttaaaccagagaaaggccctaactatattcaattctatgaaggctaaaagaggtaaagaagctgcagaagaaaagtttgaagatagcagaggctgattcatgaggttcaaggagagaagccatctccagaacataaaaggcaaagcaggaagtgcttatatagatgctgcagcaagttatccagaagatctagctaagataactaatgaaggtggctacactaaacagcagattttttttttttttttgaaacatagtctcactctgtcactagggctggagtgcaatggtgcgatctcagctcactgcaacctctgcctcccgggttcaagcaattctcctgcctcagcctcccaagtacctgggattacaggtgcccaccactacgccctgctaattttttgtatttttagtagagacatggtttccccatgttggctaggctggtctcgaactcctgacctcattatttgcctgcctcggcctcccacaatgctgggattacaggggtaagccaccacacccggccaaaggcagattttcaagagagatgaaacagccctctgttggaagaagatgccatctaggattttcctagctagagaggagaagtcgatacctggcttcaaatcttcaaagaacaggctgattcttttgttagctgctaacgcagctggtgactttaagttgaagccaatgctcattgaccattctgaaaatgctaaggcccttaagaatgatactacaccaactcttcatgttctctgaaaagaaacaggaaagcctagatgacagtacatctgtttatagtatggtttactgaatattttaagccctctcttgagacctattgctcagaaaaaagattcctttcaaaatattactgctcactgaaaatgtacctggtcacccaagagttctgatggagatgtaaaaggaaatgaatgttgttttcatgcctgccaacacagcatccattctgcagcccatgggtgaaggagtaattttgactttcaagtctcattatttaagaaatacatttgtaagactatacatagtgatttatcagattgatctgggcaaagtaaaatgaaaaccttctggaaaggattcaccatgctggatgtcattgagaacattcatgatttatgggaggacaacaaaatattaacatgaaaaggtgtttgggagaagttgattccaactctcatggatgactttgaggggttcaagacttcagtggaggaaggagctgaagatgtggaagaaatagcgacaactagaatcagaagtaaagcttgaagatgtgactgaattactgtaattttacaataaaacttgaatgagtgaggagttgcttcttacgggtaagcaaagaaaaggatttcttgaggtaaaatctactcctgaagaagatgttatgaacatcgttgaaatgacaacaaaagctttagaatattacataaacttagttgataaagaagggttggagaggattcactcattttgaaaggagttttattgtgggtaaaatgctggcaaacagtgctgtatgcaacagagaagtcattcgtgaaagcaagaagccactgatgttgaaaactttactgttttcttactttaacaaattgccacagccacttctgccctcaacaaccaccagtctgatcagtcggcagccataaatatcaaggcaagaccctccaccagcagaaagattatgacttactgaaggctcaaatgatcaccagtatttttagcaaaaaaaatttttaaattaagataacatatttttttataatgctattgcatactagactactatagactgtaaacacaacttttatattcactgggaaacaaaaaagtttgtgtgccttgttttattgcaatattcactttattgtgatggtctggaagtgaacatgcagtatctctgagatatagatatgcctgcattttaagtctcagtgtgacattattgttctactatggttattttactgtgttttacttacacttcaagaaattcactagagggttggtttgacatataacacattttttcccatttaagtaatggcaaactgtctcaaggaaatcatttttgggtaatacatctgatcatcaggaatcaattagtaacatcaaacaaggggtgtctatatttttttctcagcatgttccttatcttttctttgtttgcttgtttgtttgttttctattttacatgtctcatttaatcctggaaaaatgctataaagtagctagctgattctatcttacagatgagggcactgagattcagagaggtcagtagctggctttattatcttcttcactgtggctgcaataaaaaataaccacaaactttgtggctctcacagctctggaagccagaagcccaaaattaagatgtttaagagcaaagatccctccagaggctctaggagggattccattccttgccactttcagcttctggtggttggtgggactcttgtaatagcatttaggtctcccaaaataatccaggatgatttcctcatctcaagatcctcaatttaatcatatctgcaaggaccattttttttgcaaacaaggtcacattcacaagctctagaaatttgatgtggatacgtttgcagagccaatattcaacttggcacactcaccgaaggccacatagcagaatacggtgtcaagtccagatataggagttccagactccagagttcatgttctttccactccatgtgcggttttccatcacattgtgtgacctgtcgtctccatccctcctcacacctcagattcccttagtcttcccaacctcagagtgaggttaatactctgttctctccgtgccagggtctcttccaaggagagtattcaagagctgtgccacccctttacaaattccattgcgcatccgtgacttcctttccaatacccagacagtttcctgagtctagttcacagactagatcaccaaagcaaccttcctgggagtaaatattacatctttcccattcatattagtttctcaaaagtgctcaagagcctgaagaatgacagaagagaaatgctaaagattgaaggagttcagaacacaatactccaaaatatgttgctctagtatattgactattttgagcttaaagacacttggaaaaacagcagatacaaaaaatatactctgagctttcttcttttccttagaaacaggagataacttgtcctccctacgccagagggaaagtagcgttcttatcatcaaagacgagaagttgatgctgagagaaatctgaacaaacacaccttattaaagtaacccttatcttcctagttacttctctacccaattaacctccctagcccaagcccgttggctttgtcacatactcacaattttctattcctttcccaattcagtacataggtgttcaactttcaactctgtctttgggtttcatttccttaagagggctcttgtgctcacataaaaattgaatgaattaaatttgtatgcttttctcccgctgatctgccttatgtcaattcaatcctcaggcccagctaaaaaaccctaagagagaaaatttggcctcccctacaatgtcatcctctttcttttttctggaccttctatctgctggtacttaagatactaaaatggacgggagaaagaaagcaaaccatgttatgtcttctgcattggcctggtacactccgtttgaaggttactcgaagccagcttgctttttgtcaagagattgcttgatctggagccatatagaaaatggtgacatctccaccccgtgacatatgggccagtaagggcttgcaaagttccattctgcacacttctcttcattctaagaacgagtattcattccatttaaacacatattaccaggaattcaatccaacctctctttttacagtctacctagaattactattatactatttacatacaatatggaaacctcacacatgtatgaatctatttacaaactccctctaaattcaagttgtcattgaaattacatctacctgtattataaatcccataaaaatgatgctatagtttttacttaaacaaacatacatattcttaaaacattaggaggaaaaaattgatttttatatttatcttactatttatgatttctttatttttacataaggatctgagttttcatctattttttcttgtcatcccaaagaacaaagcattttttacagtgtaagttggtctgctggcaataaatattctgtttttgtttttctgaatgcaactttattttgactccgttcctgaagtatgagtatctttggatatggacttcgggattggatagtcatatctccttacagcacattgaagatattgtttcattgtcttcttgctttcatagtttttgaaggtaggttggcagtatttagcagtgcagtttcatgtatatagtgtgttgtttttctccggctattttcaagatagtgtcttgggttttcagcagtttgattacaatgtgcctcagcatcttgaacgtgtacatttatctctcaccaattttgggaagtgtgtggggccactgtttcttcaaatattaggttggcacaaaagtaattgtgggttttgtaatgaaaagtaattgcaaaaccacgattacttttgcaccaacctaatatttttatgacccattctctatcacctttccttctggggaaccaattactcatatgttaaaagaattatcccataggaacctgaggctctggttgctttttttttaatcctttttaaaaatacaatctctgttcttcatagagaaaatctatattgatattatcaaattcactgactgctttggtctgcctgtgtatgtatattccaaaggtcagccagagatttgagcagaatttacaccaaaaatttgtaatgctccttttctggccctctttttaatgacattcctcccttactttccagtagctggggttgctccaaactctgtcccctggttcataaggccagaaagactgagcttcctacaggagtttcagccactctgtgtggccctacctgtggcttgacctcaggataatagtcataagaaatttaacctatactacttccaggtgtcttcaacccccttcgagaatcttgctgcctttgttcattcttcagatccctcagagagttttgttgttgctgctgtttgtgttttgtgagggtttacagactacatgggaagcagaaattgttctttgggatttaacttttacaaaaatcacaagcactcatctcatttgtggcagtgaaagtaatatttacaatgttaacgttaaataacataccttgctacaggtttccagtaaatatcttgtattatgctgcgtaagctcctcctatttctagctcattaaataaatattatttgcttgttggtcttatttaacagaaaaaaaaggagtctctatttattaattcattagttttattttccacagattgattttgttactctcctttaataatgaaagttctcagggctattaattttctgctaaatacagctttagccatttaaaatattgatacatagagttcttactctcctaacagtttattatatagtttcctttcctgtttgaatctggagtttttagaaaaaaatttggtttttgttatcattatttctcttttccaagctactgatttttgcatttaaacttttgctattaatgtctagctctatttcagtgtaggcagaacatggaggctgttaacactttatatttcataatttaatatggtttctttgagatataatatatgatcaatttttttctaaatgcttcatggctccttaaaaaagtgtattgcttatttctagagaacaaaatttaataaatatttattaaatcatctttgttagattattaaaatattctatcaattctgtgtttatttgacccatgaaagatcaataaaagtgtattaaagtgtcatacaacaattctacttccatcaatttttccttatatttctaacagcctttgtttcatgtattttgaggctgttaccaagtcaataaaaattcagaactgccttatcttcattgtgaagtctatcttaaagaaaatataaccttcttgattgcatttaatatttttatagcctttgattctatttcatctaaatattgccaagattacttttttttttaatttcgcttctgcctaataaatcttgtccattctattgttctttcttttttaatctaatgagttactttgttttaggtatatttcttctcagtaccctacagttagattttgctttttagctgaaatatacagttgttgtattttaatagactagtttaataaacatttcacaatgagattcagctttacacaatgctttcacatttatatttcctcttttcaacatatcaggtacaggggaaatgtcattcctatgttatgcataaggaaattcaaagccagataggttagatgcatttcccaaggtcattcaggtaatatatggcagtggcaagacttaaccaaaggatgataatactaagaaaatggctttttacaaacatatactatccccttgctgaacatcaatattcagatagactatttggtcaaattatgttttgtgtttttttttttgtttttttttttagacagagtttcgctcttactgccccagctggaatgcaatggtgcaatctcagctcactgcacccttcacctcctgggttcaagtgattctcccgcctcagcctcttgagtagctgggattacaggcactcaccacaaggccaggctaatttttgtatttttagtagagttggggtttctccatattggccaggctggtctcaaactcctggccccaggtgatccacccacctcagcctcccaaagtgctgggattacaggtgtaagcccctgtgtccggccatggtcaaattatctaatttttcttccactgggggactttatactatttatttttattgccgtaaatgatatgtttgtaacactgtaatcttatttcatgctttgtgtagtttatgctttactcttttttctttgttttatatactattggccctccttgtctgtgggttccacatctgtggattcaaccaatcatggattgaaaatgctcagtgatatggtgtggctctgtgtccccacccaaatctcatcttgtagctcccataattcccttgtgttgtaggagggacttggtggaagacaattgaatcatggggggtgggtctttctcatgctgttctcctgatagtgaataagtctcacaagatctgatggttttaaaaacaggagtttccctgcacaagctctctctttttgcctgctgccatccacataagatgtgacttgctcctccttgcctttcaccttctgccatgattgtgaggcctccccagccacgtggaactgcaagtcaaataaacgtctttgtttgtgaattgcccagtctcaggtatgtctttatcagcagcagtaaaaaggactaatacactcaggaaaaaaaaatggcatctatactgaatatgtacagacattttattgtcattattccctaaacaatacaactatttatatagcatttacactgcattaggtattataagtagtctagagataatttaaagtagtctgtaggttacatgcaaatattatgccattttattccagggacttgagcatccacaaattttggtatctggaagcaatccttcacagataccaagggacgacagtacttggtgatttagatcaggctgcacattcttttctctctccattggtttggaagtcatgcatcctacttttgtttctaatagtggcacctggtatatcaaaaagaatattaatatttgttgaacgaatacattttaaaactttcaaatatttagaatatttgagtctacccctagaaaaatgagaatttgtcacaaatttatttctggaccttgtaaatatgatcctgggtttcttattgcttagtgttaaatattaaggtattaaatatttaatgcttattaaagcattattttgtgtgacatattttctctttcaaaagcatagttttacatttgcattcagtattataattaaagttacaatcacttaaatctcactttttgttaacttggtttaattattaacaaccagccacttctctgttactgaattcttttgttgttgttgtggttgttatttagtttttatttcataatcataaacttaactctgcaatccagctaggcatggaagggaacaaggaaaacatggaacccaaagggaactgcagtgaaagcacaaagattctaggatactgcgagcaaatggggtggaggggtgctcccctgagcaacagaagaaatggtctggtggttaagataaaacacaagtcaaacttattagagctgtccacagtcagcaatagtgaccttcttgctagtcttgccattcctgaacacaaagcgctccatggcctccacaatatccatgccttctttcaccctgccaaagaccacttgcttgccatccaaccacttggtcttggcagggcacatgaaaaactgggaaccatttgcgttgggtccagcatttgccatggacaggatgccaggacctgtatgcttcaggatgaagttctcgtcatcaaatttctccctgtagatggacttgctaccagtgccattatggcatgtgaagtcaccaccctgacatacaaaccctggaataattctgtgaaagcagtaaccctcataatcaaatcctttttctccagtgctcagagcatgaaaattttctgctgtctttggaagcttgtctgcaaacagctcgaaggagacgcagcccaagggctcgctattgacagcaatgtcgaagaaaacagtggggttgaccatagctggtaatacggggctcccagtggcagcaccatctgtgaagtctctgttactgaattcttaacttcaatttctctctcagttacctgggcagtgcttcctaaatgttagtatgtttaagaatctcctagagagactgttaatgcacagattgctacagttcatccagagtcctaactgttctaagcagtaggttttatagcaatattttgtaccatatagtgtggccaaaaaaaaaatatctgattttttgctcctttataaggctaactgttttgtttgcctgtgtgtgtgaaggattttttttactttattctttaaaaaattaccaagttgaaatgatataaaacccttttcattaatgttgcctggagtacggaaagtcccttcaatttttgttttttggtatcgggttttgtttttgtttgttcgttgtgctccgaagagcttttattaatctttcactactatttgtgttctaattgcttctgcctcaagaacatctgtgattcttactttggttctgggtgttcaaatctatgatctctattttctatatttttaatcatctcttttgttattttaatttttattgcacctgttcatttcaacagaaattatcaatttttttcccctcttgattttttctttttcttctttttttttttcttgagacagggtctctgtcatccaggctggagggcaatggcacagccacagctcactgtagcctccacctccccaggctcaggtgatctacccacctcagcctcctaagtagctgggactgcaggtgtgtgccaccacacctggctaatttttgccttttttgaagtgacaggtttacatgttgcccaggctggtctcaaactcctgggcttgagcaatctgcctgcattgtctcccaaagtgctgagattacaggcttgaggtaccacacctggccatgagtgttttttaaatagtgatttcttttcagcttccaacacagacttcaattgtgttatgacattctggtctctttacaatattttcttgactaatccatctccttttccaaataatcctactttttacaatctaaacttattctctcatttcactttctgtttcctgatgctgttgaggatgacaaaaaatcccttcagatttctgtgacatatcatcttgggaggtcaacatttactctgagtctctgagatactgttcccttttccttgtccataatgatttctttttactttagtttatcatgaaagagaccgtgtttgccaagaaaaagatgaagattgtctttatgtgtcacttaaacataaatctcttacagctaaatgacatgttggtttacaaaacttatatcctaatttccatcctctagcaggttttccacctagcatacctgttgggattggcatagactcatcttgtatcactacctgcatctgtattatgaaaaacaacaatccccaaggccctcgtagtttcagcatagatatagtgctttaactgtgacagatcctgacaaacatatttccaaaaatattactgccctatttagtaagcaggataatggtcttccaaaggtgtctacatcctagtccctaaaatctgtgaatgtgttagattacatggcaaaggaaaattaaggtagcagatagaattaagtttgctaatcgtctgaccttaaaacagggagattatcctccagtaccagggtgggaccaatgtaatcacaagggtcattaaatctcaaaaacagaagtagaatagtcagagcaatgcaataggaaaaagagttgactggccattgctgatattgaagatgaaagggggccacaagctaaggaatgcaggcagcttctggaaggtaggaaggacaaggaaacacattttcccttagagacctcagaaaggaattcagcctaacatcttagcccactaatatccatctatttcaaacttctgacctcccaaactgtaaaataataaatctatgtcattttgaacctcaaagtttgtgttaatttattacagcagccacagaaaactaatatatgaccatttatttgagtaaccactatttgcattcttcacatgcatatgcaaaagatgtcttcattaaaagtgatgcttcacaaaagtacttacatgcatagtaattcttgttcacttttctgattagcgtttgcatgtttctgaagcaggggaaagatagcagccaaatgattaaaggtcttccctctgtttggccacagcataagggaatcacctgttgaaattgttcattctagttccaccaaacatctcattagtagaattctctacaagaatcaagactagcttgactataaaaacaaatttttagtggcagcgacttctttttggcatatatcttcttgagtatttttatagaaagttgaaccaggtataatagaggctactactccaatatgaatttaatttcattcattcttcaatcccttcttggataaggtgctgatccacctaagtcactccctcataagtgaatgcaaacttaagaaattataccttcataaaatgggcatatttttctaactgtaaaaatgttttctttaaataggcatgactatggcctgtctattttaatttcgtatagcagtaatttcccttggggaaggagtaaaagacaatattttttaaagtttctctctatctagataggatgctagtagaagcaagatttctatatgttctgatgtgaccaagtagatatttctctactcaccagcctctgaaaatccctgtgtttacccaagatttaactaaagaggctaaactcgtgggtaaatattaagagggaattgacaaaggcatattaagtctaaggagtagactatacttttctaaaataaacacataattacagagttaacacagcagcaccttctgccttgtcagtgctgaaggccccatggcagccagtactcttcacttgacctcgtcctgcaaactttctgtacagcagataaaggcccaaagtacactatagtttagtgaatagcataaactcattcatctgtaagtactagatattacaacatcaggcttctcactggtcctactataaaaataattttatgcttgcacattggacacaattgttctggtggcatagctctttagctacaccagcactgaatagaaagaggcatcctctactattagtctgcaacagaacccagcatttccaccattgcaaacatcaaactggatgaagactttttattcccagcaggattaagtcaaaacatagattgacctaggagaagaagcattagcccttgtcaaataagtataattacttgatgacattggttagtaaagctgcaaagaatactgaggaaattaaaccagctaatttgggaaagaccagaaaggcaatatgaacaccataaaaacatgggtaaggaacagtaagatgctgacctttactgttttctctgggcatgatcctgcctggcagagctatgtttaggctcctcagaaaacccgatgctctctttgcattactagccaatgtgaagcaacattaaataaaaaaaaaaagaaaggaaagaaagaaagaaaacaatcagagaaatgcaaattaaaaccacaatgagatatcacctcacaccagttagaatggcgatcattaaaaagtcaggaaacaataggtgctggagaggatgtggagaaataggaacacttttacattgttggtgggactgtaaactacttcaaccattgtggaagtcagtgtggcgattcctcaaggatctagaactagaaataccatttaacccagccatcccattactgggtatatacccaaaggattataaatattgctgctataaagacacatgcacacatatgtttattgcggcactattcacaatagcaaagacctggaaccaacccaaatgtccatcaatgatagactggattaagaaaatatggcacatatacacaatggaatactatgcagccataaaaaaggatgacttcatgtcctttgtagggacatggatgaagctggaaaccatcattctcagcaaactatggcaaggacaaaaaaccaaacaccacatgttctcactcacaggtgggaactgaacaatgaaaacacttggacacaagaaggggaacatcacacaccggggcctgttgtggggtgtgggggtgggagggatagcattaggagatatacctaatgtaaatgacgggttaatgggtgcagcacaccaacatggcacatgtatacatatgtaacaaacctgcacgttgtgcacatgtaccctagaacttaaagtataataataataaaaaaaagaaaaccattaaaacactttagaaatatataaaggtaggccgggtgctgtggctcactcttgtaatcccagcactatgggaagccaagacaggtgaatcacctaaggtcaggcgttggagaccagcctggccaaaatggcaaaagcccatctctactaaaaatacaaaaatttagccaggtgtggtggcgggtacctgtaatctcagctacttgggaggctgaagcaggagaatcacttaaacccaggaggcaaaggttgcagtgagccgagattgtgccactgcactccagcctgggcgacagagtgagactctgtctcagaaacaacaacaaaaaagaaatatataaatgttttcatttgtatgagaacttatgaaatagtgattaagagaatgggctccaaagtcaaactgtgagggttcagatgctggtcttccccttgtagaaatgttatgtaaattatttatgcttcatttcctacatctgtaaactgggggataatactgttacctcactggctgctttgggaggatcagctgtgataattcatgtaaagcttgtagcagagtgcctaatccctaacaagagttcaacataattgctgctgctgctagggagaggctgcaaagcattctgggtaagaacagggacgctgggacaagattgtagaggctctgccattgacaagctgtaatcttgagcaacgtatttaacttctttgtacctcacttccctcacctacaaaatggaagtaataataaccattatgagggttgttgtgagaattaaagagttaatatttgttaggtgtttagactagtatctgatacatgtctgacaaactattcagctgtacatgaatggttttaaagctgtgattatggaaaaccaagggctttgtacggaggaatggagataaggagagtgtgcagcccagtcccactctgtatgcaaacaaagtaattctagctcttttacatatttaactttcaagcaagattttctttgagtaaagggtaatgctgctttaaaagaagaaaggaaggaaggaaggaaagaaggaaggaaggaaggaaaccatggctctatatgtatgagcctcatataaaatatatcagtacaggtcttacaaaacactgaatgtttttatacacattccctagcagatttaaccagatcagttttaaggttccttctagaaaggaagttctccatacgttgaaaagtgaatttcagtacattcaaattttaaagacacgacttcccatacttcttcagggtaaacaaaaatctcaataattctaatttaacatgcaaaagccatgaatattcactacagtcaaatgaataataaatcacccctgggttcaagtgcttgccatgcaaaattgcctatttcctagaacatccagaaatctgtttttaaattgctttttattacttttgctcttgtgatggttgctcttcaaagcaacttggaaaaatgtgccattctcagcattaaggcgataaaggagaagtgaggacagcagaacacggtgccatccacaaaaggaaagagagtctgtggatcagagggctgggctccggaagacagtttttaaatgtcactagataaaatttatgagataaaagggaatgttccttagtcatcctgagcattgatatctacatgaataataaatcaaaaggctctttatccatttactggtaaacattacgaccttaggttgaagatgtgatttactccactgatatcaacacaacagaaatccagtgaaagtatcactggactggccccaagttctggaaaatcaatgatgcgtgggagaacaaacattttgaggggaagagtatttttttaaaagtaaatatttgtggcactagcaacatgagtgcactcattaagatttcttttaaaggattaccctttagtctctcctacatggaaaactcaagtatactcaagttgtcaattgtataatttgatggaaagttatccctagtattttcccccaaattggattgaattattaatatttcacctttacaaatacatgcagtataattcaatttatataaaatttaaaatatacagaacttacagtgattgcaagtacctaagctggtaataaaggtatcaattaatgaaggaaaatggatatgtcaaaggacaggatagtgactacctctaatatgatcagagagagggttcagatcagggaattttcagaggactgctggggatgctagaaatacaatgtattgacttgggtgaaccttgagataggtgtttatttatagttattcattaaactgttcatacatgtcatatgcacttttcctgtacaaattatatttcacaattttatttaaatagtatgtttcattctgagatgactctccaatctattacatgagacacacttatactcaaaaaggtgttcattctttttctctgaaattcagatttaactgggcatcctgaattttatctggcaattgtaaaccaatcagaatagcatggttagattacaaataatatatatattttaaaagacaggaaaataaaccacagataaaatgcattcttaaaagtcttagtcatttcatttcatattctattaatatgatacatttgtgtttcatggtttctgaccccttgtgtccagcggactataaacataagtatgctacctagacccaaactaatttacttaaaggaaggcaaagaagctgaccattataaatacagcatgccttagaaaggagagtttcaagtcaaaaacaaatctggaaaaaaaattaatttgcttcttttttgtaaagcaatgatgtgtcgtttttatgtgcatttgtttacacagtaaaagaaaagacaatcaaataggtaaaatggatgctgtattgctcccttatacacacaaggaattacacatctgtctaacaatgctaaccactctgagcgataattatggatcaatgctttaaaaaatatcctgaattgcctgcagaaatggcaaggagaatacaattaaattatttgtaaaagccagagtctttttttcctatccatctgctacttgaaatgggatgacctttcaaatagtgcttgctgttctcaatgcaaactctaaataaagaagtggagtgtggctttttttttcctttccaggttcagcatagatacagcatttgtactgacattctacaccactccataagaatgcagatttggcttctagaacataaaagaggcgtttcaggaatataaatcaggcttttgtcccataccttcagtcatgacatttggcttctatcagaaaggtgtgcggcttctgagataagtgtttgagaacaagctacatgaagtaatttactccctggagaaaaattgcaaacctcacccccaaacaaaccgcataaagtaaatgtgttagtgaagaaccttttgttaaactacctatggctggggagctaaatagaaaaggtcagatatttaagctaacaatgggctcaaaacaaaccttccaacaggtctctcaataggcctacattatcaactaacaacttgcactattaagactattaatagtaataagccatgctttcttcactgagtctatatatattttacattgttttattgctcccctaccctttttaatttttaaagcatttccagtttggtcctttgtgtgcttttttaaaaattaggattttggacaaactttcatgtatttttcttaataaaagtgtatcaagcacatttcaaaaagttcaaaaaatacagaaatataaaaaataatctattagcacatcacccagagaaactgacttttaacagtctggtgtttatactcccattcatcttaatacataagcgtatcacaaaattagatgatattatataacaatcaaaactaatcaactgttttatgaacatctttctatgccataagtaacaatctgtatcattatacaaaaattttcattacaccttttaaatgttttatgggtatctctgtgtgtgtatagttgtaaaatataacttttaagtgaatttatttaaatacccaactacttatgagtacatagatttacagctttttccactactgtaaacaaaattgaaatgagcatccatacacacatctttgcagttatttccttagtattactttccagaaatagtatagctggaccagaaagtataaacattattagagccttttggttaatattgtcaatctgccttccagaaagtttactaagcaaggtaggtagatttccctctactgtataatactgagaaatatcaattttttggatacttgtcagtgtgagcaaaaatgtcattattgctctaattattattgctttgataactaatggggctgagagttttactggtgttttataactcttcctttgtgaatcattattcagatacgtttcaaatggtaatttgtaaagtattttgaattttggcccatttttctataagataaaagcattatcgttagtgggtgcagcgcaccagcatggcacatgtatacatatgtaactaacctgcacaatgtgcacatgtaccctaaaacttagagtataataaaaaaaaattaaaaaaaaaagcattatcttaaagtacaacaccattaggatttaagataaatacacacacacacacacacacatacacacatacacacacacaatgagaaaaatcattttaattttaaaaacaatactcagcataacaaattaaacaaaaatgcacacatacgccaggtacagtggttcacacctgtaatcccaacactttgggaggccgaggcaggtggatcatctgaggtcatggagttcaagaccagcctggccaacctggtgaaaaaatacaaaaaaagtagccaggtgtggggtgcatgcctgtaatcccagcttctcaggaggctgaagcaggagaatcgcttgaacccgggaggcagaggttgccatgagccaagatcacgccactgcactccagcctgggcagcagagcgagagtctgtctcaaaaaaaaaaaaaaaatacacaggtatgtatgtatgtggtatataaaataagtcaatacgctatcccagcactatttccaattccattttcccatggcaactaaaaaaaacaaaacaaaaaatagaaacaattacttgtttatccttctacatctttttctagtttcataccagtacatacaaacaggttttgatatagtcattctttgctttctaattccaacggtctcatatcgttccaattagtcaaatgattagatgctgccatatcatggacatgctggacatcacatatagatgtatttagttattattattagttccataatatttcacagtatggttatagtataaatatattcaacaatctcactattcatgtgctgtttttatgttaatgttatttgtcttgatttttttttgccactactaaaaatgcagccatctttaaatatacattttcacatcagagattactgactcccaaaattaaggttgcagagtcaaagagcaagtgtaccattaattttgataaatatatccagatttagcaatatatgaaactcttccatttctaagcacctttaacaagcatggatattatcaatattttccaattttgtcaactacttgactggaaaagtatttatttcattgtgattttaatttgtatttccacaactactagtaaagttgagcagagttgcatgtctcttggtcacttaaattttccctctgtgaattgccaattaatatccctagccatttttctcaaatatggtatataactgtatgtcatcagtgtctaagaattcctatttttctaaaatttatattgtttaatgtacattcatatatttaattcatctgaatttttagatttttattgtaaaaaatagtggtctaacatttacaacttactgatgaaaagccaattttcatagcatcttttattagataaacatacatttcccaactgaactgaaaagacccttttttttttttttttttaagacaggatctccctttgttgtccaggctggagtgcaggggagtgacctcggctcactgcagcctcgacttccctggctctggtgatcctccaacctcagcctccaaagtagctgggactacaggcatgtgccactgtaattgcccagtgggttctccttgcctactgcctagacagagccaatttctcaagacgagggaactgcaatagagaaagagtttaattcacgcagagcaggctgtatgggagacgggagttttattattactcaaatcagtctcccccccaaactcagggatccaaacttttaagaataatgtggtggatagggggtcggaaaggggggagtgctgattggttgggtgggatatgaaatcacagggagtcgaagctgtcctcttttgctgagtcagttcctgggtgggggccacaagaccagatgagtcagtttatccatctaggtggtgccagctgatctatggagtgtagggtctacaaaatagctcaagtactgatcttaggttttccaatagtgatgtttccctgtggagcgatttgggaggtttagaatctcgcagcctccagctgcatgactcctaaaccataatttctaatcttgtagctagtgtgttagtcctataaaggcagtctagtccccagacaggaagggggtttgttttgggaaagggctgttatcatcttttttcaaagttaaactataaactgagttcctcccaaaagttagttcagcctacacccaggaatgaacaaggaaagcttggaggttagaagcaagatggaatcagtaaggtcagatctctttcactgtcataattttctcagttataatttttgccaaggtggtttcgccaccatgccttgctaattttttgtatattttatacagacagggtttcgccatgttgcccaggctggtctctaactcctggggctcaagcactctgcccatcttggcctcccaaaatgctgggattataggcgtgagccactgcatccagctgaaaagacacttttactgaatattaacttcatatatttggatctgtttctcttttttctgtttcatttataaaatgttctcgtggctaacaacataccattttaataacagtaactttatattacattttaatgtttagaagaaaaagtaaaaatgaaacctgttgccattctgataaattatattaacatatctattttataggaatgaatgacattttataataataaaaactattagggaatatgagtatgactcttttgacaggcagttttatctccataacatttttcttttttctatataggccttttttgttaaattgttactaaggattttatattttttgtttccaaagtaatttttttctatttctagataactagttattgaaagtataaagaaaaaatttgatttttatatatttattttgtgatcatccagctaacatgttttcttagtaactgtgtaacagtcataaattctctatgaatataatcatatcacatgacagtgaagagagtatcattttcttcgcttaatttttttgtttgattacaacaagcagaacccataacacagtgctaagtaacagtgctaatagcaaatattcctgtgtattcttcctgatttaatatgagtgacttttatattttactgtttaatgtaatgtttgattataggtctttataaatattccttattgtgtttaacttccttccatgcccattttatttagagtattgctagaaatttctaatacattttatcacatttcttatcagtatgcatactgagttgaatacagtcctccataatttatagtcatgtggaatctcaagtgactttattttgaaactgggtctttgcagatgtaatttgttagattacagtaattagaggtcataagggattagagcggcccctacccaatgactgttgccctcataagaagcaaaaccagagatatagtcagacacgcagagagaataccatgtgataaaggagacagagactggagtaatgtgtctgcatgccaagaaatgccaaggactgttggcagctactaaaaggtaggaaaaggcaagggagggccaccccttagagccttcaaaggcaggatgtccctgctggtaccttgattttgaacctctagctttcaaaactgacagacaataaatgtctgttattttaagccactcattaccaaattaccaaacggtaatttgttatggtggttttaggaaattaacaaagcatatgttgtataatcaaatcatttaatcttttaattaatggtataaagttccaattcagaaccagtttgtaatttttgaaatgaagcctattttaaacattttatcatgttttcataagcagatagatacaagttgctattttttaattatatacttccacatatgaaaatgaaattagcataaaatatctcattagtgttatttatctcaagttttgatataacattttgctagatttgtacagttgagccccattctattttctctatagtcttgaattgtttaagaaccatagggaatatctgttttttaaagctttcgtatgttacaagtatcttttaatcttttaaagtacctgtttttaaatatctagtttacatgtaaaactatctgggcctggtgccttttttctagtggtacatgtttaataattttccactttcttctatgattattggtattaaatgtttttattttgcctatgggaataatataatactgaatgtatatatacttttctaaagaatcatcattttcctagatttgaaagtgaatggctataaaatttttttttaaaaaaaatctagccgtaccagtattgattggcagagttgaccaagggaagctaagagggtacataccatcttcctcccacacgactacatatgcattaaatcagaagacgacagtcttccaagaataaaatgaatcatcaagggaataagagcagttctcatccctagttagaatctctaaacaaaccaaagcaaatgtttttatttgaatcatcaggactgtgtcacaatgaaacctagatggtttgtcttcaagtcatttactactcccctaaagtcttatcaaaagtatgctaaaaaagtttatgacatttccactgagctacaataaagcttctatttttttagatacttgacaaaattttaaaaagaattatttttcccccacacctgcacacattttaaaatatcttcaacttttctacaaaacaattttctctacagctctcccagacttcacaaacatattcttttattcatagcagatggaggaaattagagtaacatatttgctctaaaatcattagtgctgcatcagcacttctgatctaaatgacatttcaaggggttattgttacatagagcaagactttgctccaggcagaaagagacagaaaaacaacttgaaaaatgaacctttttttgcaattagcttctgcatcttaatttgttgaatgccattctatttggattttaaatacaaatcaaaggaagaataaagtgatccaattctgtcagggtcataccttccttactggtcagtcgtctgattaatcattatagctgcttcctaaaaaataatgttgttaaaacttaccatcaactacttgattctctggaaaactaacatattcttacttctcagagatatcttgagaggctgataagtctgctctttagcctcaagaaatgcctaaaattaaactatttaactggtgagcttcacatgactgccactctgtccaagagataaataaacatccctggctgaagaatgaaccaacccataggtgtttctttagcacatactctgttaagtccactgtggaattaaaaaaaaaaaaaaaagtttaaggtactacacacctggaaaatgcaatcttgtaaacataggagaaaccacagagaatgatacaagatagcaacaatcatactttatatttttacactgcattacaattttcaaactactttcatgacacttttcttattttatcctcacagtaaatccataatggaagcaggataaaagaggaaggagacataaacatagaacttcagagatgaaagcaacattaaaggcatcaataaccttctttacagataagaaaatggagaccaaagggaaataagaaccttcaccttgtttcagagtcaggcaagcaaagctaatgaagtgaaggcttgtcaccccaagttgcaaaaagaagtcacaaaaataagacaagaaagagaaagatgatagaaatacaggacactaatttggatttaatgtacttttttaaaaaatagaaaaggaaaagcaattctattgaattcgggtttgaaattcaacgttggtctctagggatcacttggctatggtggttttatgccattaccagatccctttgagaaaaatactattttgaaattcatggtttccagtaaatatgttcaaggctttgaagaacatactcctgtaggtgtaaatggtgtatacacatatacacaaaagcttgaaaacactacttaattactgaacggagtctaaacattctacagctcagttaagaagctacacatgcgtctcacacccaccatctctccagctgtcctccacacaccatcccagcaagtcctagctgaccctcttaatactgtgacctctctgttgtataataaaggttgaaaatcatccttcctttgaataagaatatattataactatattattttttgttacagccttctcaaaaatgtatttcaagccacacataggccattgtcatggcatcttttatttaacagacaatagctattttccatgactcagtccagaatattctttaacatctacatctaggatattatcataattataataagagacggcactacatggatgaagctggaagccatcattctcaggaaactaacacaggaacagaaaaccagacagcgtatgttctcactcataagtgggaattgaacaatgagaacacatggacacagggaggggaacatcacacatcggggcctgttgggggtttggggggcaaggggagggatagcattaggactaatgcatgcggggcttaaaacctagatgacaggttgatgggtgcagcaaaccaccatggcacatgtatacctatgtaacaaacctgcacgttctgcacatgtaacccagaactttaagtaaaaaagaaaagaaaggtgcaaaagtgaaaacattaaaagtggaatcatgattttaaaaaataaattcacagtggtgttgaaagatcatatcagggttagaggacaagtctttgggttagaatgaacacttaatttattatcagagtgaacaataattacctcgacattttaaaacagcattttgtcaccttttaaacgtttgggaacagagaaggcgaaacaccatgtctgacacactatggaaagttttataattctcctcaaaaaggaagaaaaaatatttctatttccattccagatctgcacaatatattcttgcatcccatttggtctgattcatttacattttgctgaattctgtttttgtccattttcatcattcaaaagattttaaaaattcaacaacatcaaaaagccatcaaaagatgctttcagatgaaattgcaaagaaaataagcacatgaattagtgaagcaacttccaagttatacaattgtggcacttacatcttttctcatcttgtccgagaattaattgtactgctgaaattagacatccagcctgctccatgcagacaggagcccaagccggaagaaaactctttgaataacaacactgccttctgattcttttcacatggctacatttttgacatttacttcaatattctacccagttgcagtgtgactatgacaaaatatttctgtaggcatgactggcacctctgcggtaagtggcagggaatggaataggaaacgagtccctttagtagctccaaaaagcccacaggcactctgcaaaccttttgcatacatgctgttaagtaaaggatgtgaaaaatggaaaccgtgatgacaattttaatcaccttacagatgattctatgatctactataactttataatggcaaagccactgacacaggagactgacaggcatatattctctctctgcctctaagtctattaaatgtttatttggggggtttacacatggatagagatgaacttaacagagtatttattgaatctatccacggataaattataaatgactacaactttaactaggtggaattttcatggttatttttaatttctaggcccaaatcacttccctaggctctagaactgtcttccaggagatgtcagatgtcagtaatcagagggaacccatctacagtcaatgcagccaaaagttctgcctacaaggtagcaattagagtccagcagtctcttctggaagtgccaattactgttctgtcttcccttttgaatgcctccttaatataagaataacatatcatttttatcctatcagattagaaaatattgtttaaaataacactcacagttggcaagaatgcagagagagaagcactcccaaacagatgctggtgaggatgtaaattggaatgtcctttctggaaaacagtccagcaaaatttatcatgatgtttttatcttcctgacattagtttgggtatactgttgcatatttttaaatagtcttcaaaagctagagttttaaaactctgtgtggcattttgttacgtgaatacgctatagttttcaattatttccacatttgtcagcattttagttgatttcaacttggggtattataaataatgctccagtgaacatcttcataaatacacatttaactcacattctgtttatttcttagtatagattcaaagtgaaaatacagtggttggcaaggcttatattcaagtataattttatcctagtaattatggaattagtatcagcaaacggattcctaagctagaattcaccatcatttactaggagaaagatctgtggtggtaaaacagactctgcttatttacacagccttactaatgggcaatttgccagaggaatccaaaccagagagcatgtatgattgactaaccattacatggaaagaagaaatcagctcctaccaaaagcacattcatttcaagtaatgccagcaacctgctgagtcagttgtattcagcccctatagaaacccttcccaagttcattgatatgtgacacccatgacatatttttaccatcattggttttcatgaatttgcctgtctttgagacctgaaaaacaatctgatttattgaactgaaaaaggcgaatgtagtgaaaccctatcctgtaattggcaaaccttttacctccctggtggcttgagtagagaagttactggctggaggctgttctaaaggaaaacatgaatggccctaaaattaaaattccagactttaggagccaattaatgaggacataccacttttaatccatcactttgcaatatatttaaaatgttaagactcattgttggcaagggaacagtattccccaaagcttattccatgggaaaatgtttttgtggacaaaagagtttgggaaagagtgatattggaatgaagttcaagctgaacttttaatgtgctattaccaactgtgaatctccatggggggctgtagctagtaacatttgtaaacttcttcaaccacaaattattcctgctttatattgcctttgtttctggcaactgggtttctatagcgcattgcaaggcagagcattctatggaacgtactttagagaatgtttctctaggtcagcagttctcaaacattttggtctcaggatccatttccactcctaaaaactgtggaaggccccaaagagtttgtggttatgttggttatatctatggatatttaccatgttagaaattaaaacagaaaactttcaaaacactatgaatttattttaaaatgacagtaataaccaattacatgtaaatatacatattttcccgaaaaaagagctagtgagaagagtggcattgtctcaacatcacattaatatttagcctaatagaagacaggtggattctcctatctgtttctgcattgtgttgtgatatattattagggttgaagtgtgccaagaaaatctagaaggaatattttaatagccttttcaaataactggattttttctctaatactgcatcaaaacttaacaaatggtagtttctttaaaagttacttgcagagtagaacccgaaaccacatcaagaaatttttagtgctctgttatgtgaaaaatccatggtctgtgtagcattttgaatggatcctttccccatgtgaaattttgtaacagtgcacattgctctggacaaaaatagtggttcattggattatgcagatcttccaaatgttgacacctttcattgcatgatataaaaaagaattatatttgcaatatcatcattgaccttttattagaaaaagtctttaagtattgggaagctgtcaagctcatggtggcatatccaagtttcccaaaatttgaatttttgcttagaagcttgaattttatcactatcaacaaatactggccaacggtttacttaaagcaacagactcactttgtgcattttaaagaaaatatgttaaatacttgagtttgcataattatagtttgtctttcaatgcttctttcatgcagaaaaatagtgttccatataaaaggtagctggttcatttcactacccagtctcacaagtgcttttccttgagacaaccatgatatgtcagtacacagcagcagttctttctgcatacttcccatttcagcacacagaatgctaaaaaaaaaaaaaaaaaaaaactcaacaatcaaaatgcaattaaattaataatttttacttttcaacaaggatattcttagaaaaagttgactttttattttttttaaccatagtgcatggcagtgaaaaatgaaaggccaaaagtacagttcagtgccactgtcttgattcatgctatggtgccagtagttttaaaaaacattacatttggaggagccaagatgtccgaagaggaacagctccggtctacagctcccagagtgagcgacacagaagatgggtgatttctgcatttccatctgaggtacccggttcatctcactagggagtgccagacagtgggcgcaggagagtgggtgcagtgcaccgtgcaccagctgaagcagggcaaggcattgcctcactcgggaagcgcaagggatcagggagttccctttcctgctcaaggaaaggggtgacagacggcacctggaaaatcgggcccctcccacctgaataccacgcttttccgatgggcttaggaaatggcgcaccaggagattatatcccacacctggctcggagggtcctacacccacggagtctcactgattgctagcacagcaatctgagatcaaactgcaaggcggcagcgaggctggggaaggggcgaccgccattgcccaggctcacttaggtaaacaaagcagcctggaagctccaactgggtggagcccatcacagatcaaggaggcctgcctgcctctgtaggctccacctctgggggcagggcacagacaaacaaaaagacagcagtaacctctgcagacttaaatgtccctgactgacagctttgaggagagcagtggttctcccagcatgcagctggagatctgagaatgggcagactgcctcctcaagtgggtccctgacccctgacccccgagcagcctaacagggaggcaccccccagtaggggcagactgacacctcacacggctgggtacttctctgagacaatacttccagaggaactatcagacagcagcattcacagatcacgaaaatccatggttctgcagacaccactgctgatacccacacaaacagggtctggagtggacctctagcaactccaacagacctgcagctgagggtcctgtctgttagaaggaaaactaaaaaacagaaaggacatccacaccaaaaacccatctgtacatcaccatcatcaaagaccaaaagtagataaaaccacaaagatggggaaaaaacaagagcaaaaaaactggaaactctaaaaagcagagcgcctctcctcctccaaaggaacgcagctcctcaccagcaatggaacaaagctggacagagaatgactttgacaagttgagagaagaagtcttcatatgatccaaccactccgagctacaggaggaaattcaaaccaaaggcaaagaagttgaaaactttgaaaaaaatttagacaaatgtataactagaataaccaatacagagaagtgcttaaaggagctgatggagttcaaagccaaggctcgagaactacgtgaagaatgcagaggcctcaggagccaatgtgatcaactggaagaaagggtgtcagtgatggaagatgaaatgaatgaaatgaagtgagaagggaagtttagagaaagaagaataaaaagaaatgaacaaagcctccaagaaatatgggactatgtgaaaagaccaaatctgcatgtttggtgtacctgaaggtgacggggagaatggaaccaagttggaaaacactctgcaggatattatccaggagaacttccacaatctagcaaggcaggccaacattcagattcaggaaatacagagaacgccacaaagatactcctcaagaagagcaactccaagacacataattgtcagattcaccaaagttgaaatgaaggaaaaaatgttaagggcagccagacagaaaggtcgggttacccacaaagggaagcccatcagactaacagctgatctctcggcagaaatactacaagccagaagagactgggggccaatattcaacattcttaaagaaaagaattttcaacccagaatttcatatccagccaaacaaactaagcttcataagtgaaggagaaataaaatcctttacagacaagcaaatgctgagagattttgtcaccaccaggctgccctaaaagagctcctgaaggaagcactgaacatggaaaggaacaaccggtaccagccgctgcaaaatcatgccaaaatgtaaagaccatcgaaactaggaagaaattgcatcaactaacaagcaaaataaccagctaacatcataatgacaggatcaaattcacacataacaatattaactataaatgtaaatggactaaattatccaattaaaagacacagactggcaaactggataaagagtcaagacccatcagtgtgctgtattcaggaaacccatctcacatacagagacacacataggctcaaaataaagggatggaggaagatctaccaagcaaatggaaaacaaaaaaaggcaagggttgcaatcctactctctgataaaacagactttaaaccaacaaagatcaaaagagacaaagaagcccattacataatggtaaagggatcaattcaacaagaagagctaactatcctaaatatatatgcacccaatacaggagcacccagattcataaagcaagtcctgagcgacctacaaagagacttagactcccacacaataataatgggagactttaacaccccactgtcaacattagacagatcaacgagacagaaagttaacaaggatacccaggaattgaactcagctctgcagcaagcggacctaatagacatctacagaactctccaactcaaatcaacagaatatacattcttttcagcaccacaccacacctgttctaaaattgaccacatagttggaagtaaagctctcctcaacaaacgtaaaagaagagaaattataacaaactgtctctcagaccacagtgcaatcaaagtagaactcaggattaagaaactcactcaaaaccgctcaactacatggaaactgaacaacctgttcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcatcactgatcccacagaaatacaaactaccatcagagaatactataaacacctctatgcaaataaactagaaaatctagaagaaatggataaattcctcgacacatacactctcccaagactaaacgaaacgaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaactgaatccagcagcacaacaaaaagcttatccaccatgagcaggtgggcttcatccctgggatgcaaggctggttcaatatacgcaaatcaataaatgtaatccagcatataaacagaaccaaagacaaaaaccatacgattatctcaatagatgcagaaaaggcctttgacaaaattcaacaacccttcatgctaaaaactctcaataaatcaggtattgatgggacatatctcaaaataataagagctatctatgacaaacccacagcaaatatcatactgaatgggcaaaaaccggaagcattccctttgaaaactggcacaagacagggatgccctctctcaccactcctattcaacatagtgttggaagttctggccagggcaattaggcaggaggaggaaataaagggtattcaattaggaaaagaggaagtcaaattgttcctgtttgcagatgacatgattgtatatctagaaaaccccattgcctcagcccaaaatctccttaagctgataagcaacttcagcaaagtctcaggatacaaaatcaatgtacaaaaatcacaagcattcttatacaccaatgacagacaaacagagagccaaatcatgagtgaactcccattcacaactgcttcaaagagaagaaaatacctaggaatccaacttacaagggacgtgaaggacctcttcaaggagaactacaaaccactgctcaatgaaataaaagaggatacaaacaaatggaagaacattccatgctcatgagtaggaagaatcaatagcatgaaaatggccatactgcccaaggtaatttatagattcaatgtcatccccatcaagctaccaatgtctttcttcacggaattggaaaaaactactttaaagttcatatggaaccaaaaaagagcccgcatcgccaagtcaatcctaagccaaaagaacaaagttggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccataggtagaaagctgaaactggatccctttcttacaccttatacaaaaatcaattcaagatggattaaagacttaaacattagacctaaaaccataccatatgaggcactattcgcaatagcaaagacttggaaccaaccaaaatgtccaacaatgatagactggattaagaaattgtggcacatatacaccatggaataccatgcagccgtaaaaaaatgatgagttcatgtcctttgtagggacatggatgaaattggaaatcatcattctcagtaaactatcacaaggacaaaaaaccaaacaccacgtgttctcactcatagatgggaattgaacaatgagaacacatggacgcaggaaggggaacatcacactctggggactgttgtggggtggggggaggggggaggggtagccttaggagatatacctaatgctaaatgatgagttaatgggtgcagcacaccagcatggcacatgtatacatatgtaactaacctgcacattgtgctcatgtaccctaaaacttaaagtataataataataaaaaacaaaacaaaacattacatttgcatcattaatgaaaatattaacatagtgaaaaagaaaaagagcaacttagtattacagtaatatagtttcgaccttgcagactccctggaaggatctcagggatcaccaggagtctgtgaagcaccctttgagcattgtggttctagattcaaaatgtggccttggctgagcacggtggctcatgcctgtaatcccagcacttcgggaggccaaggcaggcggatcacctgaggtcaggagttcgagaccaacattgcaaaaccctgtctttactaaaaatacaaacaaattagccaggtgtggtggtgcatgcctgtaatcccagctactcgggaggctgaggcaggagaatcacttgaacccaggaggcagagtttgcagtttagctgagatcacaccgctacactccagcctgggcaacagagtaagactgtctcaataaaacttacacacacacactcacacacacacacatgcaaaaaacccttagtttaaaacacaaacacatcgtacagctgcacaaaaatattttctttctttatatcctttttctataagcttttttatatttttaaatatttgtattatttttttaaacttttttttgttaaaaactaagaaaaacacaaacattaggttaagcctacacccggatggtatcatcaatatcactgcctcccacctccacatctcatccaactggcaggtcttcaggggcagtaacaggcatgaagttcttacctccaatgaaaacaatgccttcttctgaatacctcctggagttcttgcctgagactgttttatagttaactgttctttaataagtagaagtacatgctaaaataatgataaaaagcacagtagatagttcataaaccagtaacagtcatttgttatcattatcaagtattatgtactgtatgtaattgtatgtgctatacagctggcagcacagtagatttgtttacaccagcatcaccacaagcacgtgagtaattcgtgacgctatgatattagcacactacaatgtcactaggcaataggaactttttagctccattataatcttaagggaccaccctcatatctgcagtctgtcattgaccagaccattgttaagtggcacatgactgtatatacaatggaatactattcagcatttagaaagaaggaaatcttgccatctgcaacacgaatgaacctggggaatgttatgctaagttaaataagccaaacatagaaagacaaatactgcatgatctcacttatatgtagaatctaaaaaagttaaattcatagaagcaggtagtagaaggttggttgccaggggctgtggtgtgggagaggaaaaaaatggggaggtgttggtcaaagggtacaaagtttgagttaagcaagataagtaagttttggagatctattatacagcataataactatagttaataataatttatacttgaaaattggtaagaggttagatcttaaattgctaagagagtagcatttaagatctactctcaccacaaaaatttatgagatgatggatatgttaattagcttgatttcatcatttagcaatgtatacatatatcaaaacatcactttttaccctgtaaatatacacaagttttatttgtcaactataccttaataaaggtggggtgaaaatgcatattcctgaaacccatcatgggcctactcaaacagagtatctgaggaggaggcagggctacccgagcagcagcgcaggttgtacactgcacaccttgcacaaaggtatacagttagcgaagatttgagcttgaagtttgccttttaaagaaattgcatatgtgaatcttggttatagtagaactttaagtgttctagagcagttgttcttcaactttatgtgcatcagaattacctgtcttggggttgaaaacacaaatttctttgtgccatgcttgaactacctaattagaaacctgagcatctgtattttcaaggaactacttagccaactctgccacctaccaaaatgtgacagccatttttctagactaaaaatggtatagctgtctacaagaaatcaactcaacaaaagctgaagacaacacacacacggcttaggatactcaggcatcatttggacagagtctattcaacagctataaatttgttgtttaaaatagccaatgttttttaaaatgcaactttccatagttttctgttgttatatttgttttcattctgtcagtatggtattggatctcaaccttgtatgttatttcaccaacatcttgaaatttatttagccatattttcatggttttatatgaatgcttactaaacatagtctgattttttaaaaggttttatcttatgcaagattcttcaagagaaaagacaaacttagtttactgtcaaattaccaaactgactcagatttttaaaaaccattcgaagtttcatgttatgcacttaacataaaaaaatgactcaatgtaaatgtcatgtctcgtaatgatcctattcctgggatctttcacatgaaacagagtgggcaggaacattctatggctgccaaaatggaattaaacacatggaaacaaagaaacaaaagcacaactcaccccttccagacaacaggaaaacatgtagataaatcagtgattttccttccagctaaccaatgaagtagagacatgtattttaacaattgtaagggcactgggcttaaggaaaggcaaagtaaaaactaggttataatgttcttctagatgcgaaaatgccaaatctgccagtcactcatgaaaagaacacagccccaggcaactgatattgatacattcaaagattatagttatgtatgattacagaatagcatttcataaactctatcagacagaacaactctttaatggaatgttaagagttgggagagagagaaaagttggtcattctaaggtccaattaatttgaaaactcatgagttatatagaattaaacaaatttttttgactgtggaacttctcagagcccttctgtactaatgtgcattacacctctccaagaagaaaaaagcatgcagcatttttcaaacttttgatactttgatgcttttttatttagcttctgactgggctagagttctctgggacacacccagggaaatattgatacagacaggtcaaacaattaaggcaaatgctcaggcatatacctgaactgtggtagaacaatctagatgccacagaaatggtgaaggcatgcccaacagccagccccactatatcaagtcccttagcctctctccattggccttagctctgaaagaaagatgatgcttattagtaaagtgccttgggatggttgggcaagaaacactaaataagaacaaattattaccctcattacagggtagatgatctaataaaccatctctattacttacaaagtttggaggcctgctatttttttccttttaactacactccaatttgaccttaaaaatctatgctaaaaataacttataggaaatatcccaaaaccataccataaactttcttatcggacctctgtctgtttgcacattctcaatgactgccaatcacctacaggtaaatgcaaatttcttagcctgctgtataactctccatctttcaggagctgtagagtttatgattaagatcatggtctttgtagggagacagacaaggttcacatgcaggctccactctactacatctgaagttatttctcttctctaagccctagattatcaaagtatggtccatgaactggcagcgtcagcagcatttggggcttcctagaagggcagaaattcaggctccattgaaaacctactgaatcagaatctacatttcaacaagagcctcacactgtagtttgagaagaactacacaaattctcatacgctttgaccagctcctctgcaaattggaggtaataatagtaaacttggagatggcattcatcgtctactcctttgaatccatcctcaagtcctaaggtccacgcaaatatccttacctgtctctttcccttcattaccttagtccaagctgttctcatttctctccagatctcctgcaatggccactcaactcattacaatgcatctcctcttgcttccttctattctgtttcacttactgcaaccagagagatctcccaggaaaagcaaatgtgatcagagcttccatgagctctcaaaataaaggccaaaagcctttcacagaactacaacctctgttgagggggtcgcttcccacctctatatcttatcttgcatgatgctccacctggtttcctctgctccagaagcactggtaaattcttttttccactccttgaactagccatcctccttcccgatacagaatatttgcaaaaccatcctcctggtcatcagtgccttcccctcaactctttacctggttaactccttctcaatctttagatgtcagctcaaatgtcatctcccctgaaagctttccctgaacctcctacccagcagccaaacacactgcctgacctgttgcctgtgccccataaatatttgttgaataaatgaaggaattaatgaatgttcattcatatggttattgtgacaatcaaatggattgaaacctgtaaatcatttagcacagtgcctggtagagagcaagagcttacttaatgcagtaccaatggtaatatattttgaatattagtcttgctaaaaactagaccccaagcagtacttaacaggggctaacaattagaatcacctgggaaatgttacacttctcaatgtccaggctctgctgcagaccaattaagtcagaatctctaggtggtgggacccatgcacctgaggattttaaaactctacaggagattctaacgtacagccaaagtgtgactgctttactcgttgtctcactgtggtctcccagccttccagagaatagcatactgggcgtcaagaagagtcctcattaatcatggcatgagtctgtggcccacagaaaggggcagtaatatgaatacatgtagtaaaaatctagcaattcatttcccctggctccttgacagcagccagatggtggaaactctccatctattacccaagccagaagaaaacctttctgggaaaatccaagttgcctgaactactgttgggaggaagtatggtaacacgtgaagatgactctggtcctttgggttaagtgatgacttaacaaaattcatcaggattccattataaatctgtcataattgttttgttgaagcaattgctttgtgggagcaattaattcctactgctaaaaaaaaaggtgagaactcctgagtgttccatcaggcaccaagaaataggtgagccgggaagcatttgcccttaccttctgtcttcttcactactcaagtatttggagtgtcaagagaccacactgtacttcaaaggcctcctcttccaaataaccaaccttctgctatgtaaaaacatgattaagaacacacatatttgtactgtatgtctcactcattttgaacttttcaaaatgtgatattgccaaagaagctttatctcttttaagggtttcacacacacacacatacactgccttggtttgaaaaacaacatagaatgcaggcctcatacaatttgagaaccatttacaattataacctaccaagtcagagctgataccaagccaacacaaaggcctcagaattgttataaaaggaacagaattgctctctggaaataatatcccagtgggctaaattccccctccccctgttcctccaaggtggtaaattgcaacaacaacaaaaaagcatgattcatgaatataaatttttcttggcttttaaaatcatacactggcatagtcctccccgaacttcagccaaatgagaatacacagataatgacaattttacaataagtggttccaggacacaggcttttcaagatccacaaatgaaaggcactataaaaaagagtattattattattattatttcaagcacccagaaaaaccacaatcaatgattagccataacaattaaactaacaatagtacatctggaatcagctccatggtaatatgtacttcatgcttaatagttcaaattaattcaatctgatggtgttagacataccagttaggagctggagagcaccaaaattcacattagcttccacttcaaaagatattatgaaaagagaaggaaggaaatgaggctataaacagcagtggtaaatacgaaaggctcagagatgatatggtcaggaataactctcagctattaggaattcagtgatgaaaatatgaaggctgatatttctatccttgcacattcctccagagtcaatgactgagccacccatctgagcgacagaactgaaaccctaaaatcagggcaattatattcaaagaagagggggccttcttcattctgcttacagcatcctttactagtagcccatttatattgcagaatgcatggagaatttctcattttcaggttatagacttcaagtaataagaaaagagagcaggagttggggcaggcataaaaggtgaggtagttattgcctgattaccttatttgtctcactcctccttgaagattcactagataactgtcttaagctgcactataaatattctctaaggcaggatttctcaaccttggcactgtagacactttggcctaggtcattctttgctgtgaagtgctatcctgtgcactgtaggatgtttagaaacatccctagtctccaccttgtagatgctagtagcatcccccacccccagttgtgacaacaaaatgtcttcagacatggccgtatgtcctcttgggggaaaaatcatactggttgaaaactgttaccttaaatcttttttttttttttttttttttttagatggagtcttgctctgttgaccaggctggaatgcagtggaatgcagtggcgcgatctcggctcattgccacctctgcttccaggattcaaatgattctcctgcctcagcctcccaagtaactgagattacaggcaggagccgccacatccagcgaattttttgtagttttagtagagactgggtttcaccacattggcgctggtctcgaactcctgacctcaagtgatttgcccgcctcggcctcccaaagtgctgggattacaggcatgaaccaccgttcctggcctactttaagtcttaattcacttgtttctgggcatcgggaggaaaatccagagggcagactcccctctagactcttcttcctcagagatgagcatggattgtattgccagctgtgtgcaaggcagcactcttcccacggcatgctgaatcctcctcctaacaccttttgcacatataggcttgttgcatataatacagaaatttggaacctggcagtcttctattcattgtgcagaaaagagttaacacagagcaggctcgagaaggcctatccttagaaggcctgtttgcaatgttggcctttggttagcagctgggaattggagctggtaaacagttccctacactaatatgacatttttcctaaattatagagtggccactatgcctcacctgtttgtacaaacagtgtggtttatgctgaacacctgctttccttctgggagtctggaatttgggtatgtgctaggcagatcagctcccagcagtagccttgggcactgagtctctaatgagtgccctagtaggcaacacttcaaacttgttgtcgcagcttgttgcttaaggaactaagagcatcctgtgtgactgcattggaagaggactcttggacgcttactcctgatttctccagactgcacaccatgcaccttttccctatgttgattttactttgtgttctttcactgtagcaaatcagaaccagaagataacaatgctgagtcctaggagtcctcctagagatttacagaaccttgcaagtggtcttggggaccaccaatgcagggactcattcagcattctatttgtgtgcctctatttctagatacagcaaagacttaaactccaagtcctcacagaatttatgtggtagcagcgagcaaagcattaattctagcatatttcaagcttctttcatagaaaacaagccctgtggcatctcttttttgtttttataacagctttttagagatataattcacatatcatactgttaatcaatctaatgtgtacaattcaagatttatattcatagagtcgtgcaaccacgaccacaatcaattttaggacattttcatcaccccacaaagaaaccctatatccatttacagtcactacccattttctcccaaccacccagctaggcaaccactagagtttctgccgctatggatttacctatttttgacacttcacaattggtcatatgatatgtggtcttttgtgagtggcttctttcacttaccaaaatgttttcaaggttcctccatgatgtaacatgtatcagcactacatttatttttattgctgaataatatttcattgcatggatataccacatttcatttatccattcatcagtaaatggaactttgtattgtttctactttttggctactatgaatagtgctactatgaacatttgcatacaatttttttatgcacatatgatttcattccccttgaatagctacctaagtgtggaatttctgggtcatacatatgtttaacttttaggacattttcaaactgttttccaaagtagctgcaccatttacttaccaatggcagtgtaacagagttctaatttctccacatccttgctaatagttactattaactgtctgttttttttttttgttttttttttttttgagacagcctgtcacccaggctggagtgcagtgatgcaatcttgactcactgcaaccaccacctcccaggttcaagcagttctgctgccttagcctcatgagtagctgggattacaggcacgccccaccatgcctggctaatttttgtcattttagttgagatggggtttcaccatgttggccaggctggtctcaaactcctggcctcaagtgatcttcccgcctcagcctcccaaagtgctgggattacaggcatgagccaacgcgcccaaacttatctgtctttttgctaataaccgtcttagtgggtgtgatgtggtatctcgtaatggttttgatttgcacttccctgatggctaatgatgttgagcatcttttcatgggcttattagccatttgcatatcttctttggagaaatgtctattcagacctatttgccccattttaactgggctatttgtctttttattattgatttgtaagaattctttttatattcatattctatctccaagtttcttatcagatatatgatttgcaaaacacttcttccattttgtgggttagttttattatttcaatcatgtcctttaaagcataaaagttttaatttttaggatgtccaatttatccatttttttcttgcattactgtgcttttggcaccgtagctaagaaaccattgcctaacacaaggtcatgaagatttatccctatggttttgtctaataatgttatagttttagcttttccatttaggactttgatactttaaggtaatttttgtatacagtgtgaggtagggggtccaactttattcttttgtgtgtggatatccagttgtctatggcatcttttgcatcactccaagacatagtttcaggtaatttttgtctatacaaattaaggtaacaggtaccaaaacacagaacctatgtatgtgacaaactgcctgaaagcctttataaaaacttttgcaattggtgttctttttttctattttcagaatatgctcagtattttgctatatcaggaagcagtaccaccattattaccactggtgctactgctgctaataataatagtaactagcagatattttgtacttagtatgtgccagacactacacttgcatttaacattcattaacttttaagcactacacatgctttaacttacatgatcttcctgccaacaccacgagataggtagaatcattatcttcattttacagatgatgatattaaggctcactgatgtaaaaaaattttccttaggtcatagaacaagcaggaaaaccgatttaaaaaaattgagggaaggaatggcactggaaagtggaggtcaagtaatgtcggatagcaaattctaacaaacagtagctaagcacgtatgcgaaatatacaaaaataaacaagccaaaatctagcactggtagatgacattcccagttctgatcaagttgctgacaacaaaggattggtctccccttctaactcaacaaagggtaggaaatcttatcactcaagatatcaatcaagatttatttgatcgctgaaagggttttgtcaacactccaaaaattgtattagtgactagatgattgatggaataagtcaattagaaccagattagaaatcgagatatgaagtcaattacttccaatctgaaaattaggaatcattaaacaataatataatagatggcatcaattttcaaaactacccttcgtgtgtttgtctatagggcaaaattcaagtaaaaaataactttgaaaagactaaaactatagagcaacttgatcttgggagtgttttcccagatgggtagtgggctgagtctggtcagttttcagtggagaaaatgtagacgagataagcagttgatgttcccaaattcaaataactttatggcagaaaagtcagtcaagtttaattctctttccctatactagctgtgtccttaatgataaatacaataataatagctgacatgtattgagtcttacattatatagctctctaggtacctaaaagatgacaactaatttatttaaaccaaggcatatgaagtaagtactattattattcccattttatataagaggaaaaggatgtgtaaagtgctaattgacctgcttaagaggtagagtgagaccttgaaccctgtagtctatgtttgtcctcctaatagtgtctctatatggtttcagaatagaagcaaatagacacataagggttaagcatggctaacctaactccaagttgagtctttttacactaggcaatgctgtcttcaatatatttataataactttatacaccaaataacattttgaagtttatttcctcccaatacagaaacatcactgcatttccactgggattttcagtactgtctgttgtggaactgatctgggcttagtgagtattgctttatcattcttaaataaaaaccattatagagaatgcagaaaacaatttccctttcagtttgcccacttctacccataccgagaaagacggatccttaaagctcagaatgtaataaaagctcacaatataataaaagctcagtatcagaaatgttccaagtccctccactctttctctatagttaggaaactaaaatttaatatagggcacaacgctccagagaattcagtgtatcgaaatgttaatacacttttatatattttaactgagataaacaagaaagagatagggaagccagagcagctatggcaaagacataattatgataagactaatccagctaacagcaatagaagcagatagtgactccactgtgatgctgtggtagagtttgtatggtcagaaaactatatcagtatacaatgttaatgacgcaggagccccattataggaaagcaaagataacttactatgtgactctataaagtaaagttcatccaaaagatcaaagagcatttgtcctattactaaaatattatccaaatgtattttatcaattaaaacttggataaaatcatttgcttcattgaacagtaatttaaaaggagcataggctgggcactgtggctcacgcctgtgatcccagcactttcggaggccgaggcgggcggatcacaaggtcaggagatagagaccatcctggctaacatggtgaaaccccatctctactaaaaaatacaaaaaattagctgggcatggtggcgggtgcctgcggtcccagctaatcgggaggctgaggcaggagaatggcgtgaacccgggaggcagagcttgcagtgagccgagatcacgccaccgcactccagcctgggcgacagggcgagactccgtctcaaaaataaataaataaaataaaaggagcatagtatgtccataaccaaataggaaggaaaatgcctattttgattttcataacagagcttaaacattgtggcaaaactttaaaatgcaggacataatgtaaaaattcttctaccagctctaaattcgtggttgtgctatcaactatgtcacatttctcagtgttgaccacaaaaataccatgagatacatacacattgctgaaatacactatttctcaaactcaactttatcttctactccaataaccctgtcaaaaggaaaactagtctggttacttcatttctggcagatccacattaactcctttcttttaatgctcattaatctttctgttaacaatacttctgaccctcaatacccaccctttcagacaggtcaaaactaaattcttcagtttaccatttaagcctttccttcaagtttttgcaggtaaaatgagataaaaacagacgtttgtattccagccagattgaaattttctactaccctctttgctcttcccattaaattctacctcgcagtttgtttgtttttgttttattttgttttgcgtcgtttttttaaaaaaaattgtttattgtttatttactaaatctggggcatattagatacttgaccaatttaaaatttacatcttttaaatcaattttgaagtgttttcacacacacatacacacacacacacacacacacacacaattggcatgcaacagttgtcctaaggtgaaacaatcacctcatcaacaaagtgtcataggtgttctcacccaaggttgcttatcctaaacctgaaaacctgtaacaaatttaaattacttatataaaactcattacttgtagttttccccttgcaaagatctccagaaatgtacaaataactaatatacatcagtcacaacataatcctggatcatccccacatcaaaaccagatgctcctttaattttaaactcattatcagagagcaagagaaagtcatttcgttttacacaaaacaaaattcacatatgccaaaaaagaaagacccaagagaaacaaaaacaaaaaccctagtgctgacactgatgttcagtgccctggttaaacagtggcccgaaggccacggatcaaaaataaaatagcggctgtatatcactgcaatgaagtttaacaggctttaaccttctggcttcagaaatccagatttttccaattacatgaatgcatacttcctacattccaagagtggagaaagtggatgcgccagtgtggaaatgaaaagagccaccattcactgggacaaccacagaactggctttaacagagactccttagaaagttacgcaaaaaataaagacaaaaaatggttgtatgcggcttgtgtcatcaattttaagtggaggtgactgagtcctaaggtacaatgtaaaatgtatgggggaaaataggtgctggggcaagtcttacctttaaaagcaaaacttgaaaacaaagtataaaagtgcccagcctggcagcatacacccaagccagagagctctgccatgagcatgcatagaaaatgtcaggattcatactattgtttctcataaggactcaacaaaatgaatccttaatagcttaaaccacagaatgagggaatacacagaatgcagtcatttcagtaaagtactatcaggctttgtgctgatttcctgaactaactgcattttattatcaaaacaaaaggaaaagaagattttaaaaatatatatatatatatattcctatatttcaattccagtgtttaatttctggaaggacctatataatggaggcagcatttaattaggaaattatgccaatcaattgtcaaattttcactatgactttcctaaaaaggtgttttcttccaatttctattaatcacaaagaaacataagctgtgactgtatagttcagaaaattaaaacatagaaattaatggcctatgacgttatcaccaaggtgtttggtaaacagtaaactatgagtttggaatcatcaggaagaggcttttgaaacaaccctctggacttcaaaaaatctcttcaggtagtagatgtgtcccaatgtcatggcaattagaacaagagcttcaaagaagcaccgaaggaccactgggctgtttgtgttgtcactaatggctctgtgtatcctctcccagattttcgtgtattcctctttgtgctgtacagctgtcatggccacagccagctcactgatcatttcttctagtttgttctggtgagcttctgtttccatgtcttctctttttgtagcctccccaatatcaatggtgaatatcactatctttggagtcatggtggacactcggtcactaaaacaaaatgtatttgttccatccatgtgagcagaaaatgtgtatttcccactggattctttgtctcctttataaatccttttattcttaggtcctgtaatctccatgttgatgcccaggaagccaccttcgaagatgaggcccatcttggtgcctgaggtgactcacttaagcattcttcagcatgtgcgtggatgctgatgaaatagcccaagaccatggtcaggagagtgttctggagcaacagcagctcagcgagcgtcaccacagtggggctggagcagaggccaggactcgcactgcggcctccagagccactgccgccatcaccaccctactgccttcgcctacctggcactttttgctaatcctaggaaaaacgcaaactcaaatgccttttgtgctgggaggtactgtaaataaatgaacagagaagtctagtgttaagaaaaataagacaggccaagtgcagtggctcacgcctgtaatcctagcactttgggaggctgaggcaggtggatcacgaggtcaggagatagagaccatccaggctaacacagtgaaacccagtctctaataaaaatacaaaaaaaaaaaaaaaaaaaaattagcccagcgtggtggcacgcgcccgtaatcccagctacttgcgaggctgaggcaggagaattgcttgaacttggcaggcgaaggttgcagtgagccagggtctcgccactacactccagcctgggtgatagagcgagactctgtctcaaaaataaataaataaataaaaataaaaaataaaaataagacagcagtacgttactggccgaacatatctgagtcatgcgtcatcaaagaatgttaccagcagtgaatctgtatgggtctgcagcaacctcagttcttacctcttcagaagaaagagttcaaccaaggggcataaggcagaaggagacaccaaagcaagttttagagcaggagtgaaagtttattagaaagctttagagctggaatgaaaggaagtaaagtacacttggaggagggccaagtgagtgacttgagagatcgagtgcatggtttgaccttttgacttggggtttcatatattggcatacttccagggtcttgcctcccttctcccctgagtcttcccatggagtgggctgttcacgtgctgggtggcctgcatgcacagtgtgtttactgcagtggtatgcatacccacttgaggcatgcttcccttacctatcaagcgtccctataaggtcatacaccagttaaactccaccattttgcctcttagtgcacatacttgatcccacgcacccacctcctgagatcttattaggaagctgctgatcaccggttttaggtttcttctgtctgttgggagactattgttccctggtgccagctgcaaccaattattatttgagagaaccatcttaacaactgcctgaccatcacctgatggtcgcctgacattcctggtgggatgtggggtgtccctttactgccccaactcatatctgactagctgactagctacctactgtaacaattacacttgattgcatttttttgttgttatttaatttttatttcataatcataaacttaactctgcaatccagctagggaacaaggaaaacatggaacccaaagggaattgcagcgacaatacaaagattctaggatactgcgagcaaatggggtggaggggtagtctcctgagctacagaaggaatggtctggtggttaagagaaaacacaagtcaaacttagtagagctgtccacagtcagcaatggtgatcttcttgctggccttatcattcctggacccaaagtgttccatggcctccatgatattcatgccttcaccatgccaaagaccacatgcttgccatccaaccactgagtcttggcagggcacatgaaaaactgggaaccatttgtgttgggtccagcatttgccatgggcaagatgccagtacctctatgcttcaggatgaagttctcctcatcaaatttctacctgtagatggacttgccaccagtgccatatggcatgtgaagtcaccaccctgacatataaaccctgtaataattctgtgaaagcaggaaccctcacacccaaatcctttctttccagcgctcagagcacgaaagttttctgctgtctttggaacctcgtctgcaaacagctcgaaggagacgcggcccaagggctccgtgtcaatggcaatgtggaagtacacggtggggttgaccatggctgatagtagggtgctcccggcagtggcagcgtctgcaaagactgcttttttttttttttttttttttgacaaagtctcgctctgtcacccaggctggagtgcagcggcacaatctcggctcactgcaatctccaccttccgggttcaagtgattctcctgcctcagtctccggagtagctgggactacagatgcgagctaccacacctggctaatttcttttgtatttttagtagaggcggggttttgccatgttggccaggtctcaaactcctgacctcaggtgatcggcccacctcggcatcccaaagtgctgggattacaggcgtgagccaccacgcctggcctgattgcatatgaaatgcactatttccccatcctatctcacccccatctttttttaacaaagacttctgaaaatgtatttttcatctttcaaactttgctggacaagtttttatgaatagtctcaacagtgcaagcatgatgctagagagcaattaacctttgacttcagtgttgggagactgcagggagaggtgaagactgcgacaaaccactcgtgtatcatggcaatcgctactccctctcagccatttcttgccaactaggaattcaggcagaatgttgtcagatctttcagttattacagaaaagtaagaaaacctgcattttatgtgaaacttccagattttctagtattttctaatttttgcttgaaatcttttattgttccaatatattttatttctatattcctgtgtagcacacatctggttttttatttgtgtggtttttgttttgttttgttttgttttgtttttaggccagtgagctgacagatcgagacctctgggttatgtcattccttggtcagtagctttcagtctttttcaccactacacccacctcaaccaaccatcctttccaccaaccgatgcccatcacttcctttcagatgttgctgaagaaactatttctccatataattttccctagatcactctatccttcattcctcattaccaaactgttttactcttttagcctttagtatgtatgctctgtggtccattggtgagccctttatctttctctaattacacctggactatagatttctaatgccgaggacccttggtctcctgccacattcacattcccttagcagaatgttgcacacccagcagacagtacatgtatactgtgagtaaatattttgtattcctagtcttgctaggatagaagtttttattctatacttgatgcatttctggatcaaaatattaagtctaagtcaagtctccatagttaaggtaatcttgaggattaaaacacttaggtggacaggcaacataaaacactttatctgaataatgaaagaagaatccgtctgttggtctgaagtatcaaagcaactgtcccaatcctacaaactttcagcattgggacttcctttcaagatgtaagcagggatggaaaatatacaatgcaagcgccattgtttcactctcctgggcctgtgacagacatcattaagtgatcacaacgttcttttcttctaaggctgaatgcagtcttagaaaccattttaacatggtatcctagatgtatcgtgtccatcttgtttatttctattaagaaatagagttggcatgagagctgaagatcctatcatatgaaggtacacatacaatttattattcaaaagccagagaacaacatacaactgctgctgcatctcagtctctctatattttaatttatttattgttttgagacagggtcttgctttgtgcaggagtgcaggctggagtgcagtgataccaacacagcttactgcaacctttgccacccaggctcagaaggtcctcccacctcagcccccaagaagctgggaccacaggcatggcaccaccggcatcccgccatgttaccaaggtctcaaacttctgagctcaagcaatccactcatcttggcctcccaaagtcctgggattacaggggtgagccatcccacctggcctcaatctctgtatattttagaggatagataacttcgaatgggaaaagttgtctctaaagttgaccagtcaagaagaaacaatgcttccactttaatgcctatgccagacttaccttacccattaacttttaatcctgtaagaaagatttgctatgtgatgaggctgcttttgttgcaccttgtaaaacatactgaaataaacaaactgtaaatgactttgcagggattgctgatttaaataaataaattgttataattgtagttacagttatagtcaaggggctatttcatttctcagactctgaaccaaagcaattaggaacaactcagacacaaaatgaccagcatcaagaattacaatgaaaagccaattacctttaactataagaaaccttatttgcatttattaaaacaaatgatctctcagtactggagaaaattatgtggattggttgattaacccttcacttgtaagagaccagaaattacttttcagagagcctgtatcttttctaaatttacagacaggaaaccagtaaatgataaatgatcaaggcccaaggaaaaaactgcatagcacaatggacatctatgagtttcacttgtgctagcatgcattcctcattgtgctggtaccatcatcctcactttcctctggggaatccccttctccagttctgactccagatggtgtagatggagctaacttcactccccactgagaatgagcaaatgaccaatcaatgtatttcaccgatgaatgattcagggagccaatcattaattcgagtcagtccagtactactcaatgctaagatttgagaactactgaaggaactattgtgaaagggaagaatttaaaaaaaatcttgctggcattctgagctggtaagataaaaactttgagcgtctagcggccatctaaccactacaaagtgagaccatgcctatgcgtgagaccaacccaatggaaagaaaactaagagatgatagagacatatttctgatgccatctttgagaagctgcatccaatcattctggaggcaaaaagctcttaactttatagataggcaagccaaaatcttcttactttcattaagccacagttagagctaggtttctgtcatttgtaaataaagaagttaagactaaatgcaaatcacttatagcttattttattactaggtactcaatgtctatgcttttgcatagctaagtgagagaacttaaattccaatactgatgggctattacctcatgcaggtaccctaataaatcttgtttcctctcagtgccattgtttcctcatttctaaaatggagattaaaatggtagctcacaaagaagaaatacaaatggcctataatcacatgaaaaaactgttgaacatcattagtcaagaaggaaatgcaaatcagctctacaatgataccacttcacactcactagaatggctatgatcaaaaagatagacaataacaagtgttttctaggctgtggagaaatttgaagtctcatattggcaagtgggattataaaatggtgcttcaaaaagcatctggcagttccttaaaaagttaaacatagagttaccgtgtgacccagcaagtctactcctaggtatatacctctgaggaaataaatatacaagtacacacacacatacaaattaaaaagtccataaccacattattcttaacagccaaaatgtgggaaaaaaaaccttaaatttccatttactaatgaatggataaacaaaatgtgtcatatccacacaatgggcattatttggcaataaaaagaaatgaagttctgttacatctcacaacatggatgagccttgaaaacattatgctatgtgagaaaagctagtcacaaagaccacatatcatatgattccatttatgtgaaatgtccagaataggtaaattcacagagatagcaagtagattggcagtcaccaggacataggaggagaggaaggacagtgactgttaatggctaggggtttcttttcagagtgatgaaaatgttctagaattagatagtggtaatggctactcaactttgtatttatactaaaaccaccaagtttcacattataaacggataaacattgtgctatgtgaattatttcaataagaaaaatatcttatagaaaaaaaatggtagcctattctgattctcacaaatgaccattataagaaatccatgatgataacaatattaaagtgacgttcttgttggagcctaaggaaaaacaatccatacaaatgcaaaggcctattgtttttaaggcctcagcaagtgctaagagaatgggaaaagaaaattaccaaatagattttcccagatcacttagcttcctttgtatccagcaatggtcaacaaatatatagcaggcatacataaaagctattcggagatctcttgaggttaacagcatgcaacatattgccactgcccccagcctggccaggaatattatttatgccaccctttcacagctgtatcaatctcccatgaaacattcagagcctccttgttaataaactacattatgagccggatgcattgtctggataaactgcattgtccaaaacactgccccattattacagaaaatgcagaatgtaattagtattcttctttgcataaactgcagcttccaaaaatggtgccatattataaagccttaattaataaacaagagttgggccatgaccagttacacttatctgaattttatattgtgaagaaaggccactgttcaaattccgtttacaaatatctaaattctggctagcctacatgaagatagtctaaacagaaagcctgagaattctgtgttgctaatagcattgtgttggtacaccaacaatagcaagccattaactgctgggacataaaccatcctgagaaatgttcagagtggaaggatgataacattgtatttcagctgcatcgtatggtgcaattcttctatttgttcatatgcatttcccatttaatagatggaggaaccagggtggcttttcatatctctgtgaaaccttaaatgtgggggagaaaagtgagctggcaaaaaaacaaaaaggataagtacgaggtattgtggggtgggagcagggttacatcacaatggaatgtaagtacacagttgctttctccatttccagctggtttttattgattttcccctaacctaaccccaaagcaaggccatttacataagtcatgagcattgaactaatatttgggaccataatattaagcagcccattttatgaacctcggctaaaggagcatttgcattaaactgcactcacctgattaaaatccatcaactctagcaccttgagaattgtagagtacctgttaagctcggctgtgggactctgcatactgaggcagaccataatcagaaggcagcaaggaatccgaccgggagaggaaagggaggaggagaacatgtgatgtgtgttgaaaagcagatcgcatgaaagaccgccagtgctcaaatctgaaaagagtcctaagcctactgcaaacacagagctgtgcgaacatgataattctttcagcaaagtccataatatggcttatagggccctgtgaaaacaaggtggatgagatagtattacagttcagtgaagagtaactggcccagcaatggaatgtagcatacacaggaggccccaaaatggtccctgcctcagcagaatgagcaagagctcagagagtccaagccgagggactttctgcagcctaaacaagccgtcttagatcactgccctttccatcagctccaggtaccaagcacaggctcagagtcctatctgtctcagaaggacctgctttaccgtgaccgcaaggatggcatttgaatcagtaataggctgtcagaggccaccttgatgcatttgaagaagagctatccctgagacattggttcaagttctcgatctgtaccacctagctgtgtggtcacggacaagcagtcttgctcatctgaccaagtggatgcagataataaacacatgtgaaatgaatgaatgagagaataagacctctgaagcagaatttctctccccagtgatacagacagaagacaaggaaatactgggtagaagagggaggttccctggcaaaggccccaacctcaagcctggagacctgcggcccctaagtggggcatttctgtttttgtacccaaacggttgccttttggcatgccacactcccttatcctgtacccatataaatcccggaccccaggctccaggagcagacaaggagaagaggagaaaagcagacaaatgacacaacagagaaagagagaggagaaggaatgtctgaacgccgagaggaactcagctgggggcagtcggagaagagtttggccgctgaacagccaaaactccaggggaagatcatcttcccattccatcccccagccagctccccatccatcccattgagagccacctccaccactgaataaaacccctgcatgcatccttcaagcctgtgtgtgacccaattcttctaggatgctggacaagagcttgggatacagaaagctgtcacactggccctctgcccttgcagaaaggcagagggagcactgagctggttaacacttaagctatctgtgaatggcagagctaaaagagcattgtaacactggggccacaggcacccacccctagacactaccatgggactggagcccaaagcactcactcttgctcctgcacctggccatctgtgtgctccctctcccacaaggggtttgagttcatggtggttgaacagagagccgcacccctgtcgcatgccccatgagtggggccagggaactcttctgtttcatcaacactattgacatttgaggtgggatgattctttactggggaggctgtcctgtgcattgcaggatgttcatccctggcctctacctacaagatggtagtagcacacatactccctcaattataacaaccaaaaagtctccagacattgccatatgtctctcaagagccaaaattattcccagttgagaatctctaatttatccttcagaatgtacattccaggatctaaattaatgagccatacacccagatagtgccccctaattattaggaaaacttacatagataccttcattatcactggaaattcatcaagacaaaaattttactgagcacctattatctgccatgtagaaagatactgttcctgctcctgagaagctcacaagtttaagtggaaagtggcattttacaacttcacatcaaagaaaagagaaatgttcaggtaaccatctttccaataaataatagaatatccttctatctgattagagaggtgaactgtaaagacaggcaagaatcagagcatatctctttgctattaaaagaatactacatgtatcaaagttgctgacatttgataaggtgaatttttggtaattttgactcattttagatgtttgctgcagttgtttattgctgggtgcagggagtctcagactcaaaggacaatcttatgaggtggtttagcctaagagcataagccaaaagagagagctctggaatgaaactgcctggttttaaatctagattctgccatttgcttgttacgtgacccctggcaattcattaaccccttcaatcctcaaatccttctctatgaaaaggagataatcaatgtacctacctcacggatttgttaaaagggttaaataacttatgtaaagtgctgaacacaatgcctcccacaaagcaaaaattgtaagaacaatagctgttagcattgttatattgatattgctgcctctccattttattatgatcttttttattgtagtaaaatacatgtaatataaaatgtgccatttcaatcatctttaagtctacagttcagtggcattaggtacattcatattattttgcaaccattaccatcatccatctctagaacatcttttattttccccagttgaaatttcccattcctccctccaccagggttgttctcttaaaccagtccttacccagcaaaataccttctaaggaaatgaggacaaagcttttgtaaatgagactaaaggcaattcaaactcaggtaccctggaaactgaatagaggtagtgcttaaaatggccatttgggccacttggggttatgttgatgagtttagtcaccatgaaccaactcctaggagtaacattctaagtgggtttttgttttgttttgttttttgttttgaggcaaatggttcctggctctgtggccttcccatcttaccatcacagaagcattcactctactcctctaatcaatattaacccagaaaaaaagtccagggacatatatattttggtagcctagaattaatgggaaaagacaagttgctgggtctaaactatcaaagtcacgtactttttaacagagaatgaacaaacctcctcccttcaagaatccacctgtttttgcaagagcattctggggtgggaggaaaaccttctgatttctagccagctcctcaaaatagctaaagagttcctaatttcacctcaaacctctgtttcagcacctactgtgttgtgccaagttatttctcatccactatcatttttgacagtggatctgaccctattgcaatcgagtttaaggagtttgtagacaggaaccctatctgagctgtcagcacgttgcctgatcatcttcagcaagtggtctggcagaagcatgcaggtaaggatgccctgaagcaggctgtcaagaaaactgaccaatgagaaaggtgttttgtgctccacagctgaagccaattctgctgggacatcccaagacagactccactcggactcaactgataatacacactttacatctgtcactatctgcccaggcatattgactttgtaacattccccccaggcacttcaagtccagtttcgactctgtgacttttgcctgtggtcactttgcctgaaatgccctttctccttctccttcttatccattcattaggatctagcaaaatgtacctcctttgaaaagcactttctgtagccctcaggcacaagtggggatggctgtgttggaccagaaaaagcaaccattgaaatttccaaactgaatctgtactttgatttatttcagtgtggtataatgtatggtataatatatggcaatgttttccaagtctgactgtacatcacagtgacctgggggacttttgaaaaatagattcccaggctcccctccaattaagacagcaggtcagaaggttgcaactcaggaagctttacttaatgtctagaagtttcccaggatattctgatgcatgaaccgtacttgaaacaatagtcagacattgctacttatcagctgtgtgatttggggcactctgagcttgtttcctcatctgtaaaatagcggggaagtaggggagtgtcacaaggtcttagaaaggaccacatgagggaatgagtgcaaaattcttaaatgatgcctcagtaagtgaaattatgatgctaattacaacgaatgtccttaaaaagctacttttcacttccaatagtccagcttgcaaaaccttcctctatcagagaaaaatttagtgaaagagtaaatgggcttcacaccaggatgatagcctggaaaaatcaaaagagacattgagacattgcccacatagaaagcaggggaagagcatgttcagtttttctgaaggtctatattcttcattcctactgtccatttctcctgattaaaagtctctcccaatagctgagaccattaacaaatataagcccatcaaatggtagctaccccactttgtaaaattaggcttttgtgtctctcatagaataatgttctaacacttcactacctgtaataaagtatttgcaccacaagaaaaaaatgtatttcatgaccagcaggctacaaccagcattctgcttttaggaacccatgcgtttgattgtatcctaagttggtaatgagtcaccacttttgcatttagttaaggacaccaaacaatgactctgtgaacctcagctcagactgcccctgagtcctcagaagatgcctaaatatggactgttctgtagcgcttaaggatatcaaatgacagtataccatgacaatcacaactaatcgaagtcccctgcagagtagttcctcataaagagatggagatggaaaagtaggaacgtttttcaatgctatgcagaaggaaaataatacctactgaccatattcatcctttcaaaggtctgccctgaaggcaagttgacaacacccaggcttggttctcccttttggaagagctaacgctaggagagttcacccttgctccctctggcgggaatcagcagaacagagcgggaggcactgtggcattaggattgcaaaccctggcttcggacacagtgctgcttgaatcagaatctacactgcagctgggcaactggctgaggtcacatttttaggctctgagctgctttctctatttgcaaagtgagaatacacagcttctaaggtcataatgcagatcaaattatatataaagcacttaacatgtgctcagtaaaaagtcattgatctaattattgttgtactttattgtcattaatatcaagggaatgacagcatagtgagtctcctagggatgcaggtcaatagatgttgaactgctattatgcagcaggtactgtgctaggtcctgggtaataccagagcaaacaagatcaacacaatctgcacctccaggaagcttatggtctagttcagaggtaggaaaaatgtgttttgtttggcctgcaccttgtgtataaacacaaaacatagagcaaacattttaaacttggatgacttcacaccacagtccagatttctggcttctctttgaaaacatcagaaattctgagagtaagggagatttctgtccacatgccaagccttctaagtcccaaagcaccaaccttccactggagagtggcctgctggctcttctcattaagaaaaatctccctctggctacacatgatgaggggcctggaggaattaagagagatgaggtagctgaggacacaggtccaggggaccagaactgaagcaaggaaggagaaaggagactcagcgctggttctctttcacggggtttttttgtctctcagctcagctcgctctgtttggctggacacagaaaaccctggaggagaattctgattccaacttgctctttgcacagttaattatttggagctcccagaaggttggagagaacaatgacttcccctgcagtggcagctggactagcttagttcccttttctgcccccaggggtcagaacccaaggaaggggggctatttgttttggccttaaaccaaatctgcctagagacacagagcgatgctctgacctgagaccacaaaagctactatttcaatgcctggtaaagctcctctctcttgccgtccacagcagtctactgacgaaaaacgcgttttccctatgcaaactgtttacttctctcctttgcaaattggaagtaatgtaaaaaaaaaaacaaaacaaaacaaaaaaaaaaaaaaacagaaagaaaagaaaagaaaaaaacctatatgcacaagaattccatctctccttgcaaataagatatttcacatttccttaggcagatagcatgcagacaagtaggggaactaattgggatggatcagtgaaaacaacgaaagctcatttatacacaacttgctaagtgtccacaactttgttctaataggggatccatgacaagtccctcaaaaacagagaaacaggagagaataatttacactttatagttgtgagccctgtaacagtagaacaaccttcctgcagtcccagagagattgtccccacatctaaccaaaaccattaccatcaatggtgtcctgcattttgaacagttgttaatgaagtcttgcctgacccaatacagagtgaaatgggtgtagttgctgctacaggctgccttctagccttcctgcatctgaatacattttctctgttggctgttctgatagagattcatctggaattcttaactagataaatccctcaatgacaaggtaaggcccatcttctgattaaacttgtattgaatttatttatttggccaatcatgtaatccatatttattaggtaccttttaagcaccaagcattgtgctgagtgacggggatatcaaggtgagtcaaaacaaccatagtccctgtccttagaagtccagaggggctgggtgcagtggctcacacctgtaatcccagcttttagggaggcagaggcgggaggatagcatgagcccaggagtttgagacctgccagggcaatataggaagaccccattctccacaaaaagggggaaaaaagcaagtccagagaaaaggaagctactaatcaaaagatctcacaaatataaaactgaccctctgaaaggtgtataagaagtattttggtactaggaggctctattacaaagagttcgtctagatatggggtggcagataatttgtctcagaagaaacagtacttgagctgacatttaaagccaggggaaaagcatcataggcagcgggaatcaaacactcaaaggccttgccgtgaggctgagcagtaaacataaggactgaataaagaccagtgagattggtgtggagaatgcaaggaatagagtgatgaagatggagagttggtagggaccgtgcaaggccttgtggagcacttcaaagatttccagcaacataaagctatttaaagatgtttaagcagggtataatggtggtagttgatgtgatcagatttacgctttgaaaaaatatagattagagttggcattttggggggacacagagtagatccaggtagatccaggtagaccaagtagtctagacctcctaggtcacaggtgtctaggaggggatggtaatttggacttggatggtatggcgctagaggtgatgtagccacattgacatattctaacaatagttactctggtaccaacccaatataccagagtcatccaatggcccaagagtggtactaactgtaattcctgattctgtgaagctgagtaaaaacatttagaaagaccaaactaaaaaggatctgaacgcatctgtactccctcatccccagcagcaaggtaccaccacgtactctgagtgatcatagctttatacttgaattgacaaattctgcataagactccacaggaaacccattaaataggcagggaagaaaatgctcaccattcagcattgacaagaaagatgataacaagcaagttttcagtcaaagtgggtaaaatgttgaatttctactctagtgtcattagcactgcacctgattttttaaaacaatattttggttaatcaaaactctgggtcaatcaactgttccacagtgacagctcctgtggtcatcaatctttgttatcgcttgaagctgacatggtctcggtccacaggagagtaagcagcaaaagacaaaggtttctcttcatttcccccaaagggagttaagcaatgagtcataaaagcatctaaattattcacatggctttccagaagtttatgattcaagatttgggagagataattgaaggaggtggggtgggaaacgtaacactggatgaacacatttattttgaaaatgaaaggatgagtttctgaggtagacccaattaccacacacagggcttcaggagcgacagcagcggcctatggttccgccacacaatgcttcattcattccttacatgggttcggacgatcattattaacctacagtcacctgagaaaagctcagtgtctgccaatcagtcacactggacttttgtggaaatggaaaaaggaagagagagtaagaagggagggatggagcaagggtatggagggaatgtgaggaaagcacaaggaggggccagaaggtgtcagctggtggaggagataaaatgttttctgtttctgttttacttgtagggtataagaaagagacatcagtgtgaagatatgccactgggtaggggctgagggttgtttgtatgtttgtttgttaataaacgtggcttgaattagatatatggctctccgttttagtatataagaaatacaagtaaaagagttcagctattgtgaaacttcattctcttgccaaatggagtttccttgactgtaatgctccaagactgaaccatgtacattcactatttataaaagctagacatgcatttattgaacctaccagatgtaggtactgtaaccaggcatgattaacagtagaaagaactgaaaaacccttcatgattcagccttagtttaccttactggttttatctcctgtgaattctcctttaaaactaagatcacagttctgtggttcttggaattcacaaaaaaaaaaaaaaatgctctacttcccctctgtgtatgtgagtattctctctgcactgaatgcccttcctccttcatctagcagcactgctcctctctgcctggaattgtctaattcctgccattcctcggatctgtttagacataacttcctcaggatgccatcctgaattctgagctgagtcaggtatcccttctcagggctctcactgagcttatctcaacagtagtctaggtagcattcaatcataattagatagtgtgcaagctttctgatggcagaggctaagacgttatcatgtttgtatccccagcccctagcacaccatgaaacacaaaatgcccaataaatttttgctgaataaataaaaaaatacaatacttgatacccaactccaaggcactttcagtgtagttagtaaagatagaacattttgaaacataacacagcacagggcaatatgaaagaaaataaaaaattaaataaatctgttataagcaacaaagcaggtatttagagaaggcaaagattacttttagctggggtgacaggagcaacagaatcaacgacaattcaatgtgtgttcatgacacaagtcctgtgttagttgttttcaacaacaaccctgtaacttgataatattatccccattaacaaatgtggaacccaaggttcagagaggtaagtgatttttcaaggttatataatcagcaatgccaggatttgaatgatgaatctaagatttcaaaacactgagaatggaaaggtgggtatcccaggtagagtaaaaacagaaacagaaaaaaatgtgcaagtgcatctcagtgtaatgtatgtcctggggattaaaaacaaatcaacttgatataatctattataggaatgctaaggatgctgatcctagcaagtaagctgtgactagactgctgggggccttgagtgtcatgctgaggaacttgggtgctgaggagccattagaagctttggagtagagaaaatgtgatcagagctgaaactctgaaagccttattagagagtgggagataggatgaactggaaagataagaaggaagtttgcaggcaaggtaattctgttggggacaaaaaaacttttcctttatcttcttatgttaggtatttgggggcctgcaaattaaactgacaaaccacagattaacaggagaaaagtttatttatgtgcatatggaagcttacaaaagaagtaactcaataaatggttaaagttagaggcttatacagtcttgcctgggtatccatggggaattggttccaggaccctctctcgccctccatcggataccagaatccaggttcacattccttatataaaatagcaaatataacctgtacacatcctcccgtataatttaaatcatatctaggccaagtgcggtggctcacacctgtaatcccagcactttgggaggccgaggtgggcggatcacttgaggtcaggagttcaagaccagcctggccaacacagggaaagcacatctctactaaaaacacaaaaattagccaggtgtggtggcacacgcctgtaatcctagctacttgggaggctgaggcaggagaaatgcttgaacccgagaggcagaggttgcagtgagcctagattgagccactggactccagcctgggcaacagagtgaactccatctcaaaacaacaacaacaaaaatcatatctagattacttataacacctaatacaatctaagtgctacataattattacattgtattgtttaagcaataatgacaagagaaaaaagtctatacatgttcagcacagatgcaattttctttttttcaaatagttttgatccactgttaattgaacctcagatatggaggggcaaatgtataactaccttagtagggaaaaaggagtgggagaaaagacctctttggaaagaataagcaggtttctacaggaaaaacaatgagagataagaaagtttgtaataatgtttgttcatccaggtacgagtggtctctctgtcttcttcaaggctataaaactcccccagagaggatatttatgatatattgagtctccttcctaggagtaaaagccaccctgaagaaggaatttatgaaagcctcatttcccagaagtttctgctattagtcaaataagagaagctctgagacggttttttttccgcatctgttgaatcccaaatgtcttcagcttaaaataatcttcagaccaactctgggcttctgagtgggtacccgacattaccacctaggagcctagcacaactctccagctccaaaggcactgatgtctgggatggagggaaagggtggattcaagccctactgtgagagaagacaccaacagcccctaacagctgagttattgtgcgtctgaaagagaaggaactaatggtgacttaaaagcattaagccaagatgacagagagatcattgtcaccactaacacaaataaggaagccagtcaggagaaagtactagtttgaagggggaaattttaaacatgctgaataagacacagcaggaaaaatctctaggagacaattggaaacgtggaaccagaaaaccagaaagtgatcagtgcaggaaatgcaacttgggagtcatttgcctaaagccataacttgaagccatagtaaatgtgggtatatctccaaggattaaggaatagagaaagaagactagaaggtaagcaacaaatcttagttaatactcaaatttagatggtctgcatgtgacattaacaagtgaaagatacaaagaattaagattaaagtgcccagtataagtctgacactaaactgggaactttttctatgtcattttatgacgtaggcactacctctatttcattaaaaccaaggctgagagtaatgtatcttgtcaaagccatataactagtagacaacagagatgggatcaaaggcatgttgcctcactcagggaccatctgactcatgccttcatggacaggactgtgggatggagggcaatggaggaagagttttcaggagtgcataggatgaacgtagtcaaaggcaatggggaccgagaagaggccactgaattctgagtcctctgagaggactcacctctcagaaatagttgcagtataaggtctaaaatcaaggcccccatattttgtgctgctttgacatatggagaaattcaggagggcctcaaatgacctaatgacaagttcccctcctgacatggtttggctgtgcctccacccaaatcttatcttgaattgtaactcccacaattcccacatgttgtgggaggaacccagcaggaggtgattgaattatgggagcaagtctttcctgcactgttcacatgatcatgaatcagtctcacaagatctgatggtttttaaaatgggagtttccctgcacaaggtctctctttgcctgctgccctccatgtaagatgtgacttgctcctccttgcctttagccatgatcatgaggtctctccagccatgtggaacagtaagtccaataaacctctttcttttgtaaatcacccagtctccgatatatctttatcagcagtgtgaaaacagactaatacacctcccagctctgctcctgcaaataaagtcccccagccaaacaaccctccctgtcatgtgaaccaggcatggttcctgcttattcctcttattccggagtagtggatttcagtttcctgccagcctgcagaattattcagacaagccgacttcatcctcccatagaaacagggataatcccacccctcttaatactaaagccttcttcccacatcccctgattgctcactgtgttcccaagtgcaactcccacgtggacctgtgtggcactcagggtccttcctccctgggctgtgagtatatgtgactaacaaactgctgtctcactggtccagtgttgttcagtcatctttctaaccctagggtgggaccctttctcaccaaccaggtaagtcgagagtggttagaacaacagaagacaccagagtgtttactgtggaagtaacatgggtgaaatgcttcactttaataactactggctttattacaactgaagaaatctgagaaatggatgattactcttttctaattttatataggaggaaactgaggaacagagaggtgttcaatggatacttagagtgagacagcaccaaattatttttctcactttaatgttgcattgttctcaaatattttttttacaagatcctttccagatgcttctatgagaatcacatatatccagtatttacagaaagccattgcaagcaataaggaaaatccaaaaagcaaaatatgggcaaaggataggaacagataatttccaaaagaagaaataggaatgccaatgatggcataatgtccaacctcactatgaatcaaagaaattcaaacaaaaattacaacaaatatttttgtccctttttggttgagaaagctttatactacccactgttggtgagattttaaggaattggagatgctcatacacagatgggataagtagaaatcagtatctctctgaaaggcagggtagcaactttctcaaaatctttaatggtagtattttatgaaaaaaaaattcattcgtaggattatatccaaaggaaacaacttgtgaaattcataaatgtatatggatgagaatgcttattcattgtttttttataatataaaaaaaccagaaacaatctaaatgcccatcaaaaggggataggctaagtaagttgtggtacacctataaaatagaatactatgcagtcttttaagtggaagatgtagatgtatatttatcaacataggaagatgatatttggttttaaaaactaggttataaagctgcaggtggaagagtacacatattatgtaaaatgtttataaaattttgtgtttttctacgtacacgcataatgagacatttgttgggaaatttgcaaagttttagtattccatagtcttcaaatttcaggtgagtcttactctcttctttagtttatcccaaaggcacatatcagtaatcaggaaataaaaggttgttttcactgggggtgggggaacacatggagaggaatgaataggtcacctcaaaaagaaagcatacttcaggaagaacttacacaaattacacaacatactttgcttttgcacttattttttatttcccaacagataacacgtgaaattccagaaaggggagaatcaattgtgcattcgatttttcacagggagctcatgaaactaaggcttctgtgcagcagcagggccatggagtggaaactggaaggcgactggggtcagtaggtgctggccagtccctctctgattgaaaaggacatgtgaagggtgccaagtgagacctcctctccaagttctcaacaatggctacttttttgcgttttattttgtgaacaattcgaacccacaaccctggatacattccacttgtgtaggtttccccttcagacagcaaatgctgctgtttccaaatccaatcatgagtgtttgctgttggagcgcttggtgtaaggcatgtgtgtcctataaaatatgtttctcaaaacttaactttttaagaaatcagtcactggtttatctcccaattctatcacccagaagaagagaaagatgccaaaacagatcccacagagagtttcattctgaaaaacagacatttaatgtagttattctgaaaaaaatacaaactgtattatgtcactttagaaatttcaaaatagagatctctaggtatcccgttaggcatctgtcgtgctcccaattacattactttcgacagccctaagagaagcaatatttattggcctactaagtctttaagaatgcaaaacttaacccatctggaactagttgtgttgttggctccagggttccttacatcagaacaaattcagacataaactctgggacagttcttgaatattgcatgaaggtgagttgcaggcattcacacaacacagcattgtcttttaaagcatttttataaagcagatccaaaggctggcaaacctttccttcaccataaaggaaatctaggctaaaggggaaaataagaagtttatgaactattaaaaaaataaagctgtggagttagggagttatggattaggttccaatccattaattcttttattctctggcagagctggctgaagatgtgcagccctctggcgggtaacagaaacattcatgtccagaacaatcacaaaaagggagagaaatggctggcagagcagagggcggatccactcatttggatgttaatttatacagaaatctggaattcaataatctcacatcccccaggtaagggagcgatccactctccaatttcatttgggagttctattacattaagcaatattctgtttggccagacatgccattcttctcttgaaggaaattaatttcttgattcttccatctaataatctaatataatcccaagtcagtgctttaagttttctcatgacactactagacaaaataaactctgaagtacctcttgtgggaactcacaagatacagatgaaaacaaaagaagaaagtaaaattgaagagggtgaggccagggacaattaggtattgaactgcctgccctgcctctgacacatgatacatgtgatttgttaagacgattttctatccttaactcttcactaagtagggctgctttacaatttccataggaaatttatttttaagtatgtaaggcctgtgaacaggataaataaaagattacaaggaaaaaaaaaagcagtgatttctggttgtttaaaaggcaactcaacaagcctttcccagcaaaaggaaaaggtcaggatcaataaaagggcctttcctttgggaggagatctgttttcaatttaacaaaaataaatccttatggtgtagtcttctgaagaccaaggaaacatcaagctatacaagggatctggccttaccaggataagaaaacttcttcatttgatattctccaataatatcaaaacaaagtaaactgtacccactttgcactctttctcggccccctgcctgttagtgaaaggccagttaacctgaaaaatgaaaaccagctcttaaatgtaaagatgatactactcattgatgcaatgttatcctgatagtggcttttcagagatatcatcttaagcgtgatatcaacagggggaatctcacatacgagtagaggctggtttagaaaaatcctgcaggatatggagtgtctttggtgacagaagtcatactcttaaaggtatcttggtcaaactcatcatctcttactctttttatattagccgggcgtggtggcacatgcctgtaatcccagctatttgggaggctgaagcaggagaatggcttgaacacaggaggcagaggttgcggtgagctaagatcgcgccactgcactccagcctgggtgagaagagtgaaactctgtctcaaaaaaaaaaaagtactggctcaactactatgatgagaagcttttgggagatactcagtggtaatgtcagccttattttctgtggcaaatctgaatctttgctgccgtaacacagttgttttcaacatttaccctttctacactcataggcacacacacaattttaactgatgaattcatagaattcataaacctgacagtgtcccattgctggaaccttagtcatacccattcctagctcttgctaactataacttctccatttttccttcctctcaagaaagtatattagattgcaaggttgcaagagagtaagagtcttaaccttaaatatgctttcatttattagaaaaaaggaaatcatctgcatccttcagcaatttaaatattattagagaaaaacctggtgggattcagcatcaaagttattctcctttctggcatgacctcctctcagcacttcttcaagtatataaatcctaccaatacctcaaggtccatctactctgtattctgaaaatactccaatctcctctccctggaatctaccaggactctcaaactcaagtgttttccagcagtcaggaaagttagttgcatgctgcaggccaattttcaggcatgtgtgtttactggatgagtgatgaggacatgacaacagaagagaacacgtcctccctgaagggggcagcagccagtcagtcccatcccattgctgtcaggtgggaatgcaggcccatagctacccgatcttccaatgttttaagataagtcgaaaatctgcattctatggataatatctcaacttcaaatgttggctcacttaggatgacaatgactctgtgatctgcattggacccatggaaccactaatttgcaacctctggtttctacaaaacatgaagctgactgataaatgacaagcttgtgccatttatcagcaagtgtttgctatttcacatcatcagtcacatcagtatttcagagagccataaataaatgtataagttataggtaacaaaaataaagcagggctttaacttaattatctttaatttagcttatttaaagtttcaaataacatgtaaagagggcctgagatatttatatttagaaatttagagacattggttaaataagttaaggaacaatgagccagactctgaagtcccagcaaggagggactgtatctttgttttattcagtacctatcaagagtgctaagtacacaggtttgaatggaactgatttgaatcatttaaggaaaaaggttccagacaaacattgcatgcattagaaactgagtatttcccgattaaacatacaccacccttacatttccaaagtgtcagcaaagcattctgttctttggtcaaatcttgtaaaagccacttactcctaaatatttttactttgtaaccttcaccgttccaagttcatctaaaagaataaagaaaatacctggcacagagaatgcattcaaagtgtattagttaaatttcactaaaaagaagtaaacaaaagacaaaaaacttcaatgcatcttgattctctgtagagagagcaccttgtggcttgggcttcttctatcaaacacatacccacacctttttgtcagataaactcatttggtttttcttgtgtaatggggtgagtattgtacaaggtttcaatgccttttttttccaactcacattgtcccttagaagctcgaagtactaacaaagtgcttcaccacacaaaagtgctgtctacatttgtctggcaaatacgatgccaaacgaaaagcctgatgagtctgcaattcgtcatgggcatgatcaagctccaggctgcttccaccagagagcaaattcaacattataaaggaagtgtggacaggaaagccttccagcaagattctcagaatatggacatgagattcaaagactaataaaatgggttggggagacggtattgatgaagaagcagccggagaggaaaaaaggaggatttgagcagatgtctgtcactaaagaaagtgaaagacacagaggaaagagaagatctatgttatcacctgtgatcctaaaacaactctaggaattaggccgcattatccttgcttttatagaggaagaaaatgtggaacagaaaagctgaataacttgtcacagtcttacccagccaattagtggcttaactggagtttggccaggtctttttgtctgtatagcacaaaccttgtgaccacacagcactaacttccaataagtcacccaaaaagtcagctgcatgtaattagctctgctgtgaaactatggactggggaaagggcattgttcatttgttagcttaatttttgttaaaggcatacaagaccaaccacaaaaaaagaaaaacaaaaacaaaacaaacaaacaacagcaaaaaaaaatcagccagagctgtagaaaatcaactctgtcattagtaagtatattttattcaagtatgtgttattaatatatttgagatctcccaaatactaaagagatagaaatttagatacattggagataaacttcaagtaagctattttttcactattgcataaatgggaagatattttcattgaaaataatgttcctttactcaatcacccaatatttattgagaaaccacctgggccagacattgttctgaattctgaagatcagagagtgaacaagaagcaactgactttgttttgtttacagttcagattgaacaaagcaatggcaacagagaaagaaagagaagccatttatggtttgtgataaatgctgtgaaggaaatattttctgatagagaatgaatggaaaacttcctttaggcaaagaggacaggaagggcctccttaggtgattgtgtctaaatgagtcaagcatgtcgagggttgaagaaagggtgctgcaggcagagagataagagtatgctaagagccggtgaggacactgaacttagctcttcctgggaagtggcagccccttgagttggtgcagtgaccagggtggacatgtgtagtataagcttcagggaagaggtgagtagaaaccagccagcccctcatgggtctggtataccactagagtgcgtttggaattaattgtaagcacaagagaaagctgttgaatgattcagtcttcaacaagggaacaacatgaacagattggtggttttattttggctgccatgtgaagaatggatgacacgacactcgcatagaagtggaagactagtctagagtttggaagatagcacttggacgtcctgctggatgcctgccattaccctctggatctgccctccaccctttcctcgcctgttgcctgcctcagaggctggcttacatggactacggcccagggctctctagcttccagttagtttggtcaatgggaaaccccagccagagatcagaagggaggagaaagaacttaggatattagtccctcagcaccctgtcacctccaagcagagtttctcacaggttggttgtatcccaccacccagggctgctggtccttcaggtggcctctgccaaggggcctgtcacacagctctccctcaggtcccaataaccttccctctcctatgcctctttcctcccctttacccttcaggagttgagtagcatcagaaaacgctgcagctagccccaaggtactgcactctgtcttgtagtttgaaaatgctacctttgttaaactctagtcaaattacccaatgtatggatgccatctgtttcctgtggggctgactgatacaggaagagagaagcaagatactattttgacacgttcagttactgtgatccttgagtaacattctgtttagcttgagttcatataactcaaaaggttatcaaggaaatcttacacccttttacctttttaggagaagcaacaaattcaccaaagaggtaaaatgccaaaatcatgggcgtgcggattcagaaaataaaataagcattagtggtcatcagtatttgatttcaggccaattgttagagctgtcgcttaaaaatttagatgtacatttctcattccatgtttcatttattcaatcaatgtttattgagtgcctactacttgcaaggcactattttatgaactagacatagagcagagaccaaaacaaaatgcctactctcttggagcttacattctgggggagaatcagaaaataaacaactcaatgatatcttatgtgcttataagaaatggttaacaggaatagagagtgggagatcagcaagaggactgctgatttataaaagacagagtaggcctttcttaaaaggtgataatctgagcagagatctaaaggaaaagatgaagcaagctacggcgatgtccagggcaagtgtgttctgggggcggaaatcatgagatgacgaggtgtgggtggcacttttgagtaccagtagaaggccagtgccactgtagcagaggaagtaaggaggacattggcagcctatgcaatcagggagacggcagggacaagatgaatagcctcaagaactttggcttctattttgagacaataagtttttatggttttgagtagaacagtgataggaattgatttaggttcaaggggctcattctggctactgtgttgcaaataaggtggcaaggatagaaatagagaacacttacgcaaaagtctagagcaaagatggtgacttagaccagggttgtagcatttatatttgatatgccatttaaatatccaagggaacatgagtaggcatgggatgtgtaaccgaagtctagagttgaaagaagaggtctaagctagagatagagatttcgaaaacatcagtatttaaccttgacagtggatgagattttctaggaagtgaggagagcattaagagacaagtttttaaggatggagccctgagtcattacagattgacagatcagaaagaggatgatgaccagcaaggagaccaaaaaggccagtgtggttaagtgggaaaccaagagggtgtggtgtccccaaagccaactgaaaaaaaagtatgtcacgaaggaggaagtgatcaactgtatcatgtactgctgatagatcaagtaagaatagaactgagtagaaaaatggatttggcaaccaaggggccatggatgacccagacaagtgcattctgagaagcggtggggatgaaagtgggatggagagaacatgtgcaggcaactcctctgatgttctttgctgtaaatgggaagcagagaaacgtgggagctggaatgaattatgcaggcttctttctttttttcttttcccttccttccttcctgctttccttttttccttccttcctgcttgcctttctcccttcttttctttcttccttcctttatctttctttcttttctccctctcttactctctttatttcttttctttatctctttctctttctttccatttctctctttccttcctttgttctttttctctctcctttcgttctttcatctctttagtttagagacactacagcatcttcatatcctctcagaattgtctagtagggagaggaacccaaatgatgcaggagagaacagataattgcggaagccaagtgtttttgtaggcatgtgttgaggttcacggcaccatgaaggccgagggtggaagcagaacagttcagagagcacatggtctaggagcaggtaggctagtgagagcatgtggaggtttcctcctgactgagctttgctcagtaaaacaggaagtaagggcatacacatagcaggaccagcagagagaagctattggagatctgagaaaagggtgggaaatagtcatccagggcaagtgggtggagtagggtcctgcagtaggattgctgagcagtgtgttgggctttaaactgcctttcatatgaatccacaaatcctactaatattaatgaaagatattaattttcatttttcctgctcccgtcagcttaaaacgaaaagtttctctacttagcccatgaggagtcagaaaagaaaaagtaatgcccagcaaatttctccttcctaagctagaaaggaaaaaataagatattcatgtaaggaaaataaagaagacatggcaacttgaaattatgaagaaattccaaatgttgcatttggtagtgttcttaagctaccataagagatcttcattctattctgggtagggagaatgtacgtggcagttgctaggaatgatcctttgcccgtgatccttcccatgtggtaccccactgtccccaatagacctgagtggcacaaccaacaaaacaacattcaaatatatggaaatgatctttattttagactctttctcatttagcctgttgggctccgagaatgtgaaaaataaatctgaagccttacttttaatagctttcttataaattatccccagtatgtaaaagcccagctcctagatataaccagaagaagggggaggggggaaagactaatgacctttgacattaaaatttaaaatgtcctgcatgcaaatacactttcctgccactcttttgtaatgcaataaccagcaagaattagaattgcaaaaattccaaaagagctacatggaaattatacaacaaagtggtttcacagtgatattgagaaaggaatatgaaatgaatacaagataacatagagacagaatggggtgttacagatgtatgagtgaacgtgcgtatgagcacatgcatgtctcagagagagcaacagataaaaaattatttctttttttatgttgctcttcatgagcaaaattttaagacagacactgttctggtcacatttcaataatgtgacacatggtttctatttacattccaaatgagttttcactaaatgactttcgaaatatttacttgcaagtataaaggagaccctttgaatgtctgatttgaaaaaagaacaaaatcaagcaattatcaacatagatgttctaatacaaactgacactattttcttccatgtcttttttttttttttttttcattcctagacaccacaaaagaccaatgctacagatgtctctctttcggctttaaatacttcaactgtgacaatgatagtgagacagactgcttcaggccctgtagctaggacataataaataattcaaacaagttttgaaaaatcatttggcccatataatataccagctatccgaacatttaccaatgcccgccccctcccctcacacctcatccttattttcattttttgctgcttccatcagcttaaaatgaaaagtttctctacttagcccatcaggagtcagaaaagaaaaagtaatgcccagcaaatttatccttcctttgctaccggcttccattaaattgaaggtgacttcacattgatcctgggttcaattcacatatccaaagagacctcagtgattaacataaagggcagtccaatcaaggatagacacctccatgtgtgtatggtgagcaatttggtgggatgtaaaacataaatgatgtagcatcagaacacctggtgtggatgatgccaccacttgcctacccagttattctccacttcttgccctgagtttttctttctctctctctcttttttaacttagataaaaaataatcagcttcttaacctcccttgcatctaggagtcatcaaaaagatatcggttgatcaataagatcaataagaatttgataggcagggcttccaaaaaagtctgttgaaaagggaagactcagataacacagtttgttagtgtttgccttttgcccaagatccttccctctttcttctgcctgtgatgcccagggatggagtagtcagtttgtagcctatgaggacaaaagtcccatggcaaggcataaccatgcagaaagatagaaggaactgtgtcccgctggcactttgaacttcttgaggcatcttggggaaaataagcccctccttggtctagcagtatgtgacagttaatttcaggtgtcaatttggctaggccatggtatccagatacttgttcaaacatatctggatgtcactgtgaaggtaatttttagatgagattcatcattaaatcagtagactttgagtaaaacagattaccctccataatgtgagtgggcctcattcaattagttgacaattagttgacagtcttagaaaaagagtagcatcccccagggaagagggaattttgccagcagtctgcttttggacttgagtggcaatatcaactgttccttgggtatttattgtgttggcctaacctgcagattttggactgagatctcagccttcataatcatgtgagtgaacggcttaaaatcgatcatctctgtctctctctggagaaccctgactgctacaccattacaccattctaactgggtttctgttcactgaaactgaatgcaattctctctgacacatctgagatcaccacttcatacactgtgtaactgtgtaggtgtctgtgaccctcagcttccagatctacaaaatgggaatatgagtactcctgactccacaggcttgttggcttacacacgagacagaatgtgtaaaagtgctgtgctgtgttaagttacaaagcccaatcgaaatgatagggatcattatcatggtgggctcactgtcaattcacgactgtaagtctgttatgattgtattcacttaaaataataatattcttcaaatctgaccataaaaagtcattatagaacatttgaaagttcaaaaacgcatgaggaagaaaacactcaaccacctccatcattccatagctactgtcatctaccaatacctagcatttattgagttattatatagcaggcaatgtgtgaagcaattcaatgcattatctctaccctgtgaaggtaggtactattttggtgcccatttggcatatgggtgaaaacttgtcaccggacatatagctagtaagtggcaaatccaggattcaaacccaggtctgaattattctaaagcccatgtatgtatccagcaacacatggcgatgagctgtgttctttaataatgtattggctactacaaaattggagtgtgatcaggtaacccttacatcaggaaaaatggggtatgcacattgctcagcatatacacaaatcaagactcatattacaaggctgctagctctcttgtcagggataacattttaatttgaaatgaagtggaagaatgtttcatatcagctactccggttaacactgctttttacttcagataaagatatcccttctgtcaggcaccctgaagtttttctgtaaaaagttgtgttcatttgtttcaaactgcccatacatccatggtctcatttcattttccctatagcccgctgagttaagaggggcaggtattattaactccatttcacaggtgaaagaactgagccctagagaggttaactaagttgcttaaggtcacacagcaaattagtggtacgacggggattggaaagcctaacgcctgacatccagcgtggtatgttttccatcatgtagtgctccatcacctgtcactcccaccattcctgaggggcttggagttgatggggcatgctatcaatttctcagggtaaaactgtcctatctgggtaggaaaatgcacacacacacacacacacatatactagacacactgtaattgcatctgccaaaatggttttataacaatccagtcaaggatacagaaaactcccaggctgcctttcagaaacaaagcccaaaggatcaatttcatcatgaaataggatttcctcagctgtaggtggatgggtaggtggggaggtggatgaactgcattaacaatggaacagtggactgcagggtaaaagctcatttgacattcactgctattaagcagtggcaatgtaaacctggggtagcaaagagcaatacccaggaaaaaatacgaagaaaagtttcaacttaacccttctgtaactttctatttataagtctcagggtattaagtctcattctttagaaataacaaatgcatattttgactcactctgtaagatatttataagaaataaagagcaagggggtattgattaagaaaaaactaggatgagattatagatatattaatatgtgttaatatacaacatataattacatataattaatatataataaatgtacaaatatataatgttatataaatgacatgtcaatatatgaatatatatatttcaagatcatattcttaacctgaaaccaaaaaaagtacaaatagaggtaacatattgcattgtctatttagcattgaaaccaggattttcagatagaaacatttgcctttcctaagctacgcaagccatcagatatttacctcagtggcactggtctcagtgaaacatcttaatgtctcttctctcagttggttagatgaatggatgtcataaggtaaaaagaggaactgcaagatttgaagctcatagaaaaaagactggcactgggaatggcagttaccgggagattgaaacaagaaggcttctaaatatgctgtcaaaaccagcaccagtgacctctcatcaagtgaggggcagcactaaaagctataccttctagaatgatgttaccttgaaaatcatgaggaaatctcaagtgtctttctactacattagcaaaaggaagtttagggagtttagacaccaagagactggaccttctcaaaagggaatttgccacagaatcatagatgttcaaaatgtgaaccaagctttctttcaaataaaagtgaatatcagggcttaaaacagaaagacacatttcatcaaaaatgattaggggcccacgagtgttgactggggaatgagaatagtgggtaaggttagggggaaagccagaaaaaaaggtgaatcaaatatacttacactaaaaatcctggggctccatgtgatccagtcacggtaccttgtcacagagagaaatgtaatcagggatccaggaagttctttacaggtttacttggtgtgatgcttaatattaggtgtcgactagattggattgaaggatgcctagatggctggtggagtattgtttctgggtgtgtctgtgagggtgttgccagaagagactgacatttgagtcagtggactggagagaaagatccaccttcagtgtgggtgggtaccatccgatcggctgccagtgcagctagaccaaatgcaggtggaagaaggtgcgataagctggcttgctgtgtcttctggctgccttctttctcccatgctggatgcctcctcccatccctcctgcccttggacatcagattccaggttcttcagcctttggaactcaggaacttgcaacagtggctcagactttggccacagtctgaagcctgcactgtcagcttttctggtttgagcctttcagactgagccactaccagcttctctctctctcaatttgcagacagcctatcctgggactttgccttgtaatggtgtgagccaactcttcctaatatattcccttatatatatacatacatatatcctacttgttctgtccctctggagaaccctgactaatatacttggacacatgaaaaattattaagaagagatgtctattcttaatgcattaagaatactgtaaaattattctctcctcattgctgcctttctgaaaattcttcatgtggttggcagctgactcaggagcactctctttcctggcacttatccaatggctctaacacccaatctgggcagcctgtccggcttactgtctccatctctccactcttgcttatgtacttcaacacagactctttatttctttacttttatttctgttttctttactttagggaggacctgggagtttaccaggaagctcaaattcttcctgtatagaagctaggaaaatagtgaagattgtgactatccatactcgaataattttatcctataacatctcaacagattttgtctctaagaattctattgtctcaaataaacccagaagttagcactttaacatgggagccttttcaaatggtagagtctcaaggccacatctgactccagagatcatggtgttcctacaacactgagatgatgataggaactacagttgaaaacagatctttctccccacatcaccttgatcaagtcaataaatgttagtatatgccaggtactgggctaggtagtaggaacacagagataagcaagacaagatccttatccctgaagaagtcacagttcagtgtagtatttctaaaattgcattccttagaatgaaagtgacccttgtaaaaataatccatggaccaaataccttttggaatgtggcatgctcaatctccttttggacatttttcatgctcatcctaatgcgaaatgattatataaacttcagttctttactccagcatttcccacatttaactcatcgctgacccatttggcttgcaaaacttacgtcttgaattgagcctacaaatgttaacagaaattctaccattagcttaaaaaacagacaaataacaggcattttaaagataaaataagaaataatgatagcattttaatataaagtaaatagtatttcaaccaaaaggcaagtgaatctgtatgttgtcttaatggagattatatttgtttgctcactacagtttataagaacagagaggatgataaagacaccacaatgatgaccatgcacagagtgtttctatcagcaagcctatattgtgggtctttactcacaatattttatttaattcttacatcccttctatgaagtaggaacttatatttcccattttcctccataaagaaatcaaggttcagagaatttgttaatttgtctgctacgatcatgtgcctggtaagtgatggaagtgagattctaatccagactatttactctgaaaacctagtggctcccaattctagttatatatcccagagaatctactgttaactgatttaaaatgtccattagcagagaaacagattaacaaaattcggtgtcttcacatgatagatgatcagatggctatcagactatctgtggcttctgaacagaaataagaaagaggctttggcaagctctagattagaatcaaagaaaggctttccctcttgttaagcaactcttgttctattgcgccccaacaagagacagaatgtttcaagataggacaccaggtgactgtgtggcctgagctgcccaacctgaattgggtgttgttttatccactgtctattacattgggtgcactcagcagcagctgtctgtatcaaatgaaagtagattacacgggattgtactattaggcttactctggctatccctgttttaacccaaacctaagacttcatggggcattttttatgtagttacctgaagaaggaaaaaaataaagcctactttacagacaacattgcacgataagctagctccagcctgaagtggaccctgaatattataaccccactcaaggtgagtagccctaaaggacattgaagaagaaaaatcccatcagtgggcaaaacttcaaataattacctcttgtggtcaacactgcctggaaaaatagttggcctgaggtattgttccacgttaattcatgggctcatgaatgaggcattaggaagaaaaagaggggaagactgaaagggaagggaacaaatacacagtaaggcttctcaaacttttaccagagtgtgaaaatatctgtctatgtgaatgtagactagaaggtccccactgtggagaaggcactcagtagctaggtaggcaaggcctctttccctgccaactcagagcttaatcagcatattcataaaagctatttagtatctacggtggccaaatacagaggtttgcatgggctgaccaataaggacttcaccagttctggccactgccactcccaaatgtaccacttgctagaaacatcaataaggaaatctgttggagagttagttttttgattcagtgaataccaatgtgctctcccacatttcctctaccttttgtggtaaggtggggccatgtgactagtgcaggccaacgggctacgaggaaacagaaacctgtcatgcctgtgaggggccctggcaaggcataccgcctgacctgcacaccaagtgatgaggtcagagaatgccagattgctctgcattctctgtatagaggaaaattgccccgcaaactgcctgattaatataccaatcctgaatcaaagatacagaaaaataccctgactggaccctccagccacctgggggcatgctgtttgtatggaccccatctatcatagaggagatgaaaatgtatacttcttggaaaagacatatactcaataagaattatttccctgtttgccaggcttctgtgaacaacctcaaatgttttattcaccttgatggtctcccacagaaccttcttgactaagaaactcattttatatgtacatatatttatatgtacatatattaaaaagtaaagcaatttagttggtgctcatgggattccatagtctcacctagtaccccatcctcaacagtggaatggccagttaataacttggctgtggttccagttaaaagacaacaccctgaaaagctaaaggactatcctacaggctgcagaatgttctcttaactagtgattaattatagtgctattttcccataccaagaatatatatgtccaggggtcaaaggggagaggggagagcagtgcctttcaccattacacagaacaaatcactcattttgctttccttaccaggaaatttgaggtctgctgttgtagaggtcttacaactcaagtgaaaaatgcttccaacaatagatatgataaaagaaaaacttcagccgagttaaatttaaaggactttaattgagcaatgaatgattcacgaatcgggcagcccccagaatcacagcagattcacagactccaggggtgcctcatggtcagaacaaatttatagacaaaaaaggtaaagtgacgtacaggaatcagaagtcgggtatagaaacagtgagattggttacagctcagtgtttgccttgtgtgaacgcagtttgaacattcagcagtctatgtgtggttgaagtatggccgctgggattggccaacactcagctattgttacaggtgcatactattaacttaggttttcaattttgtctgttaagctaggttacagttcatccacaaagactcaaatatagaagtatggccttttcaggccatatttagtttgctttagcagatgcaagagtgtttctatgaaattggaagctgaaactgtccagtggacattttggacacctcacaccccactcaaactgagtaaaaagggagttattgtgttgggaggggtcattagtcttgattatcagttgggaaatgaagttcctgctcagcaatggaggccatgaagagaatacctaccatgcaggtaaatcctctggagtattcctgctactgccgtgtgccatggtaaagggttagactccagcaaccccaaatgagcagaagcattgagggtttcctggatagaattactgatggactgtttgttcaagggtaagttagagtatgttaagtcagagcaaggtattataacttgaaagttgaaacatggagaaaaaaaaaaaggagtattattgatatttggtaccaagaaagggatcagagcgaaatttgtctcgcgtggctgcccaatatcctctggatattcttgctcataataatgtttgctccacatcatgaattcttccttttcaaagggaatttcagaaaactcatatcctttgcagctaaggagcaggcatgcggtctgccctcctcttctcaggccacacaagacttcactgtggaagtgagcaatgaggaaaaacaggctatgtgtggacattcatttttccagtataggcagtgagaaaggtatccagatttggggatgttaggataaattgcaataaaattaaatccttcgtatcctagatgttacagtcaggaaaacattgtggtatccagtaagtagatggtgacaattgcctcataagcccagttctaagaaaatgttctgcagtcaacagcatgtcaatggctgttttctgaccagaccagttctgcaacatagttttggacattgttcccaaaagcttagcctcaagcttatttctctgggtctacaatgattcttccaaatgccccatatcctttaataaattccttctctatttaaattagagcccattctattgtttgcaactaatgctcctgaccatattttccttctcccactttcaatacccaggcaaagattgttttaatcattcacaacctaacagttctctctcaggaaagtctaatctagcaatatttttttctgtggaatctgcaacctactcctttacctttaagccataagcagtgaatgaaactgactcctatttccagaatcccacctgcattccttttccaactcaatcttctttcttagcctaaggctagcctatttattgtatgaaatattcttttctgtcagtgaacatggcaacatctttggctaagtcaaaagcctaactcttcatctagctttcaacttggaagcacatccctggacacacctatgctttgaaagtaatatttatctctctctctctctatcccactgttcaacaatcattttgtctgctttttttgagttacactttgcatatcaatactctttctgaaaactcctccaaagtgttaaatatctggcatagtcatttcaaaacaggaacggagtggtctgcatgttaaagaaggcaagaatgccagaaattgtcccatttcccatgttgatcagtgactgtgtaactcagacacgttgcagaggcctacatggcctacttcctgagaggggggtctcactgccttgtcaggattccagtttaagagcacagggcaagtgagaccactgaatacagtcatttaaaaagtgctacaggaaagtatttaaatagtcatcttatagaagggggtgaaaaagcacatttattgatgcagtaattaaaaaaagatttagatccagtgtgtcaattcccatagaatcccacttagcccccttatctatgtcaaagcaaacttagtttcacatcagcagtgcttctcatttatcttaatgctaaggatttatttcttatgcaaaattgttcattttcaccagcctggaactttaaaaaaattcacattctcttcttcaagaatttttattaagccaagatgtcatcaagctgaaaatctcagacacaattttggctctcttctgcaggaaactcagaggagtgcccaatccaggcaacagcagattagcactggcactgctgacaggttcttaaaagtgttggaaagagaagaacaaaggtggtgtacaatgattgacaaagatttctgctataaactaaagttgaaccaataaatatgtctagactctgccatgactatctgtggcctggaagctgcattcttcagaagaaaaaaaaaaagttgcagttggaatttggaatggttttgcccccatgatgtgcacacaggactttgatgagtagtctgatatgcagaagcatccagattatcactgagatagaaatgaaacatccagatgatagattaagtagattgttcacttctcatctatatatatatatatatatatatatatatatatatatatatttgacatcatagaggcataatcaaaatctgagtaggtaaagtcactaaccagaatacgaataccaagttacctgtgtggtttcatggaaaaataataggggaattgacatcatctttataaatgttgtatcaatgagaaaattatgacagtcggggagatctgatctagcccatctgcctcctgtctttagcattcaagctgccaagctagctttgggagacatttactttacagtttaaatgataataacccttccccccaactcaactgcctttgtaaagctaatgagggaccaactgagggaaggagagatgcctggatgctgctaaggtacagacatgaacaattgccagccattattccagagatcacaagatttgcaacttccctaattactcctgcaggcaacatcactattgtagattggccttttgagatactgtttcaggttttttgcatgtctggcacccatggctctacttggacccaccaactgatggttcctctggccagaagcaactcagtgtaagaggacagcttcaactccctatgattaaatctccaacccagccaatcggcagcaaacacccattgcatagccatccctacgccttcgcccaaactacctttgaaaagcccctaacctacaagccttctatgagattgatttgaataataactccatctccggcatggtgtggctagccttctgtcaactaaactctttctttactgcaattccatggtctctgtttgtgtagcaggcaggaagaacccactgggtggtcacagaatttcaaggctgcaaagagtcagactttactcaaatattctaggcaaaaaaaatagaatttaagggttacgatctgcacaatcatggtcaaaatcaaagacacatcgaaacagttaaaacgcaacagttatcccaaggtcaaaaccaagaatatttatttattagtgtaccctgtagctctgtacccaattaagcccaaacatctccctagacttcatctccataatcatatgggtatctgatacccgtcaatgcaattttcttgatcactaatgaaacattccttgttcattgcattagtctttataatcacaatattaaatcattttccctggtgttttcccctagcaacaatttatgagccattacagaatttctgttttttttctatgtcttctctcttctcataagttaaaccattccagtatcttgcaaatgaccagacaactactttaagactttggttgtaactagagcttcctaccaagctatgtaattaagccacagtatctttgctcttctagcttacaagataatcatctgattcccttttgttaaactatttgccctttggccttatagtttattcacttgggaactagattacagtttcccagactatatagctacagagaaattattgtgacttattataagtttaattcatgccaaacaataccagtctgatttctggcttaataccaccttctttcataaagctggaccatcattttgcctttaatcatcttcttgattagtatttttccaagtgtttctcaactcatttcttctatagaattaaaacattcctactggatgggctactcattttaaggatttaaaattttcagtctggatttggggttacacctttgatggatgagcttaaggaagatacgaaaatggcaaaattatcttcatgatgacatcataatggatagaacaaagtaaattttataaaatggtttcacatgccttattccatttgatacttaacagacttgagaactggacagagtagatatagtagttccctcttgtgcacagggaatatgttccaagaatcccagtggatgcctgaaatcctgtatagtcctaaaccctatacatactgttttttccctatatatacatatttatgataaaatttaattaatttattctttttgagatggagttccattcttgttgcccaggctggggtgcaatggtgtgatctcagctcactgcaacctctgcctctcgcgttcatgcaattgtcctgcctcagcctcccgagtagttgggattacaggcacctgccaccacgcctggctaatttttgtatttttagtagagatggggtttcaccatgttgaccaggctggtctcgaactcctgacctcaagtgatctgcccaccttgacctcccaaagagtgggattacaggcatgagccactgtgcttggccaaaatttaatttataaattaggcacagttagagatgaacaacaataactaataataaagtagatgccagcatcactacttttgtgctttggaatcattagtaagtaaaataagggttccttgaatataagcactgtgatactgcaacagtggatctgatcacagagctagctataatgtcactaacgggcaagcagcacagacatcacagatacatgggatgattcatacactgggaagggcagagcagggcagctcagatttcactgtgctgctcaaaatggcatgcattttaaaacttacaaattgcttatttctggaattttccatttaacatttttagatcgagttgaccacaggtaactaaaactttgaaacagcagataatggggaactactgtattactatgcccatctttataaagcagtggtttccaaactgtgttaatgcagaccaaattcatgacattgtttcaaccagtgcagctcctttcatattagttttttaaaaaaacacatctaagtaagatcaccatttgaaatgaatagagtgtatgttggcttttaaataaggaatgtttaaatgcccctgatagaggaagaaaccaaagctcagtacaaatggtaaactcacatctccacctgtaaacaccaggtaaaaattgaaggagcagggacaaccacccaagtctccagcctgtgagacagccaggtgaggaggggtccccagaagacctccaactggcctgtgcaccggggtggagcctcgggaatttcatcatgtttgcagcggggaggagcctggcccttccttttcctgtgtggaacctgggattcaagctgtgggcgggaagtgctctatcagggactcaagccttgggagactccctctttcccctttacttctttttcacccaataaaaccctgctcaccctctccatcggtctgtgaacctaaattttcgtggctgtgggacggacaagtaccctgtctttaactgaactatggaaaagtcctgcaatatttttggcgcccaacgtggggactcgagaaggggtaagtgagatgcaaaccaataattctttttccctctcccttctgagtcttctcatccccgtggccttttccttccttttttgggatggaccggcgagcagcagctgcccactgctcctcactccatgccggggctgggacacatggcctaagtgtcctgcacagcctgctggctggttccccgtcactcctggctgtcccagccttccccttccctggccaagggatgtaactctatcagacagtaattaagcttaaatttgtctccctggtggaggaaccacttgcaaagaaatatgaggttcttcctcaggcacttttaaactgtttcttttctttccccttctctaccccatcagcaagttaacttaaatttttttttcttttagaagatgttgtactaggctagcctccacccacccccaacaactgtcagtgtattctctgcaaagtttcggttgtgaaatcaagcctccatcttgttttatatcctgagggcatggctggtaattgtggcaaggatttgtttagcaaagccttgagaggatgaaccctgtaagattcaatgtctgcatgttttcctagccctttctcttaaagggccccacccagcaactgggttttcttctgcctgcctgtgtgtgtactgtacgtaatgtttgtcaagagaactctaattaatacagcctaaagaaagacaagtgcttgaatctaatattttttaaagggaagataaagtctggtacctttcagttcacatgactttaatctttaagaaatagaaacagtcttaaaaactattggtcaaatgcaggtattatcaaaatgtaaataggtaggctaaataatgcaggtcagatgcaaggtttgctaagtgttttgaggttacaaactgctttttgggttttcagaactatattgacttgccagcttcacaactggtaaggcctggggacacacggaactaaccgcacccttaactaagaaggcaaaccttggctgcagttagcacacaattaaagcaacttaacaagttttagtttacagttaaaaattgctaggagttaattgaatccactagaaatagatttacatgcaaggtgtatgagaacagtaaaatgtgtttttcagtaaaaggttataagaagtcatggaaatgtaaacttttgcctagggttaaggattgttttgagttacattaggaaaaagctgaaggttccaagaagtggtggaagaattgtggaaattaatcttgcagaagaggttctctgtgtgaacatactgactacattcaaccaagggtattatatggtttttctgtaaattgagcgttgaagtaaaagcataacgaggttttcctaaggtgctaatcttaatctgctctttggcaaaatttgtaaagggttataaaaggttttcgcttcttcaaaatttctgagtcatcattttgacaaaataaataacttttggtaatgttgacaaaaggagtcaaattctgtaaaatatttttacagacttattgtgagccacatatgagtgaccatggcccgtgacacagccctcagaaggtcctgagaacatgtgcccaaggtggtcagggtatagcttggtttgatatattttaggaaagcatgagacttcaaatatatttaagaaatgcattggtttggttcagaaaggcaggacaactcaaagcggagccttccaggctataggtaaatttaaacatttttctggatgacggttgagtttatctgaagacctgggatcaatagaaaggaaatgttcaggttaagataaaggattgtggagaccaaattttattgtgcagaggaagctctcagatagcagacttaagagagagcaggttataaaatgcttcttatcagacctaaaagggtgcctggctcttagttgattatctcctggatctggagagaaaggaatgaaaacaaagggggaaggggattctctataaaatgtggatttttcccacaagagacgttgcagggcaacttcaaggtatggcaaggaaatatattttgaggtaaaacattttgatttttttccttgttatgccacagtcagattggaaagtaagtcacgatatacagggttaaataaaacccatctgatgaaaatttatggtttgtaagccatgactccccaggctccttagataggaatttgggcaatattaaaaaaaaatcagagcttagtcctcagtaatctggaattccgtttcataacatcaagtgttttaaaccttgaacatttaacagccttcccaaagtcaaacttcagtttcaaaatcgtcttccctggtacatggcttttcaaatacttcagagggcccccgatgtgtccagaactaagagaggtaaacagaattatttgacatgtttaggtacatgggattgccaaaatgatgctcaatcttctttaggttatagctgggtgaataatgccaatatatgttccaaaattgtatgggatttctaaaattctaatgtctgagtatatgctatcaaccataattaaggtttttatgttaagttatagtaaaccacggagataactaaacttctttgtcagtcgtgtttctaattgtaactaccctggaaattttgctattcacagacaattgttgctttaattctttttcagaagatggtttataataagctataggactttgacaggtgctttcaaatacaggcttctgataactttggatattgtgacactgaaatacaggaaaatgtacaggactcaaaagctgaaatgctcatgattatcaagcaaaacaagagttagccaaatggactgaactcaggaagctgaagcaacctttttgacttttgcttggaatattgctaatccatgtttcatttttcagagtcaaggaaacttattttgaactatttacagcctttaacaattgagtaaggtatactcctatgaacaaagtttgaagcgtgtttgtttctctctgcctggttcctctagaatttggaaactatctgtgaatattgttatggcaatatagttgtttgcatcagtgccaataagaatccatttttcttttgcagcaggacacatttggagaaagtagttattttaccaaggttttgactggaatggtatgcttccctttaaggagtcaagctcaacttgcagagccaataaaagccccatggggaaactggcctcatactgttgtctatgcagtccctgtacagggttcctgacctgtggtcagtaaagaatgtcactttctagcaggtccaagagctccaagtttattgtgggaccttaagaggagaggatcacccaactcacaggtatttgaggatgcaaacccatggctaggctcagctttaaaaggtcttatctgtgattccttgtggaaaacatttccatcagtgccaatccaaaaagcctatgtagaaatagttattcttgctgcactttatgcaaataatcaggccaagtgtaagactaaagtctattttgcaaagcactcagtcctaccataatttttttaacaaaaatgaggactggagagacagaaattatgttccaaaatttgccatacatttgtcattaaatgctaaactcattagttgtttttaagttttcatctaccttttagaccaaccctgcttgctcctgtgaaccaagcagcaatctccagctgcagctcagaaagaacaggagggatgggtaatgtagaaatatggatcaatattctagctctgaacaattatcctgcaaaccctgccaggtgatggaataaatagggtgcccattaccaggaggtttcctttttgggaaagtaagaccaagtgaactaaccaaagccaagcatcacgtatccaaatcctggcaagcataactatagctaccagttatctgggtgtgtcacaagacatccttttctctctcttgttggaggagaactgggttccacagcttcactttagcatttgtcttatgataaggaggccatgcaatgccccatccgagatacatttttgtcccagactgaattccaagcttcacatcaaagccttaggaaggaaaatcggatcttagggatccagaggcaaatgacaacagaagttaaaaggcacagcacaggtgagcgtgactgattcctgctgattaagccaaccccaaacttcctgtttcatggataaaggccacgttaatatccatggcataaatgaggtctacggaactccaaggctactgacagcaggggagatagggcatacgtgggtaagagcggatgattcccacccctaggcccccctgcttcatgggtgcaagttgctttaacacccatggtggcacctaccaaggtcactggaacttggggatgcaaggatagaagatggaaagaggatgctcttccctctctacctcacatacctaaggtatctgctggaagaaaagggaaccaggtatgcctgctcccctctttctagatgggtagccattcatcttcagtctgtatccctttcaaatgcatcctgaacctctgggactcctttaaaaggcaccttctttttgcctttcttctcctctgttctctcttcactaataggtaattgtgtctccatactacaaggcactctcctcagatgcatcctccaaactagaaagagttggtttcccaaaccttaaactggttagcttaggattgggctcaggggaaggggacccagaagcccaacgtgccagcaaaagggtaaagttttttttgccagtcaggcttttggcctccctctacgtgtgcaaactggcaaaaggcctcaggatctttgagctgtccttaccctcccttcatttcgttttgatacatagtttctaataacctggtttgtctgttcttgccttcaggccattaaactctaaacaatcatgcaagcagagcctctgacaatggccctttctgctgtgaacccttagatgggcctctgccgtttccccaaaacagcgccccctctcagcaggaagcagttaaggtcagtcttcatccttatccttaatctaaacggcagctggatgtacctctttagagggaggaatgagacagctaggtgggagggggtccccgaaaaacctccagtcagcctgtgcactagagtagagcctcagaaagttcaccatgtttgcactggggaggagcctggtccctccttttcctgtgtggaacctggaattcaagctgtgggcaggaagtgctctatcagggactctagccttgcagaggctcccggttccccctttgtcttctttttcacccaataaaaccttgctcaccctctccaacagtctgcgagcctaaattttcttggccatgggacagacaaggaccctctctttagctgaactaaggaaaagtcctgcaacacctccaacaactaacaattgtttccagtgcacctccattctccaggagggagaaggccaaagcacataagtggagaatgcacacgttagcccattttcaatagtttaatactttaaaaaatagtagtgttgctgactttcaagctttagcatctacacgtgctagattcacttattgactcattaaactattcttttaccaatgagcttaccatatgccaaaaactatgctatactgggaacccaaaggcacacagaaaaactagaagactatttctgcaccagtcaagaagcacacaaatggacactcatgaagaaactatagacccaaagaaaaccattgacaatataggacaaatggcatatcaagtcctgaggaaagagattagtaaggaggttaatattttaaaaaaaatagaaaagggagaaataatgaatcactggaaatggtcccatcaacctgcagttcttcactatttttcaacttaaaattggatacatttatagtcacttgacctctctaggtcccaatctccccatgttcaaagtacatatcctattgctagctctctctactttgctaagtctattgtgaaaatatcacaatataaaatactttgaagccttttagggaagcttaaggtcttctacaaataaaataacaagaagtaccacttggctgaaaaatgaaagaggtaggacaccaatggtagtaaatcacttgtatcactttgttcagaaattatttcatttttttcattttattgaatatagacaaattatagttgtatatctttatgaagtacaaagtgatactatgatatatgtatacagtctggaatgattaaatcaagctaattaacatagccatcacctcaaatacctaccatcgattctcctaactgaatcattgtaccctttgaccaatatctccccatttcccctactcccagcctctgggaaccaccattctactctctgcttctatgagtttgattgttttagattccacttgtaagtgagaacatatggtatttgtttttctttgctagcttagctgacttagcataatgtctgcttggtccacccatgtggtcaaaaatggcaaaatttcctcatttttaaggctgaagaatatttcattgtgtgtgtgtgtgtgtgtatatatatatatatatcacattttctttatccatttcatctcacacctattaaaatggcaataataaaaagatgaaagacaagtcttggcaaggatatggagaaaggggaacccttgttcactactgatgggaatgtaaatttgtacagagctggttcaagggaaatccaagaacatggctgtgaggcaaggaccagatgagggtattaagggactatcattacagtggaaaaattaaccctatcttttttgagagaagccagttacaatgcttgatgctatccctgacacactctctctagcaacaagttccttttctttcggcccttaagtaaggctataagaagaacagaacaaaacagcaaggagatgaataccaaagcactggccacacttttcccctgtgggcctgtcttattccattcatgctgctataaaaaataccacaaactgtgtattttataaataatagaaatttaattctcacagctctggaggctgggaagtccaaggtcaaggtgccagtagattaagtgtctggtgaagtcttgctctctgcttccaagacagtacattgtttctgtatcctcacgtggacgaaggcagaagggtaaacaggcataaagggcctagctagttcccccaagcccttttaaaagggcaccaatcccattcatgacggctctgtcctcatgacctaatcacctcaaaggctccacctcctaatattatcacactgggttgttttttgttgttgttgttttgacaaggtctccccctgttgcccaggctgatgtgtagtggcacaatgtcagctcactgcagcctcaacttccccagactcaagtgattttcctgtctcagcctcctaagtagctggaactacaggagtgcgccaccagctaatttttgcatttttttttttgtagaaacagtttcgccatgttgcccaggctctcactgggtcttatgttccaacatacgaatttgtctgggggatgggtgacacatacattcaaaccatagcagggccttcaataggtcattagagagagagccaaggaacaccagtgtggctttttgcattgaacaacgataagttaatggaagtttaacatagcccacagtctgtagtcagaggtcagaggagtaaggccttacatgctacagatgcccacaaaggagataagaggaagccagaagaaatagaaatttgtttgtcagtggataaagaacaaggccaaggttttcttaaatagtgattgatgaggccctggtttactgtaacagtgtacttgtgattttttaattttgtaaaaattgtcccagtgtgtaattctctgtttatacctgagtgtggggaaatgaattttaaggaaaaagccctatatttcctgataaatcacttctataactaattggttatttaatgattcatctgtgtaaaaagggggactaatggttttaaaataaaatttcatcaacagttgtctctttcataaggtttgaaaacaaagaaaatggagatgatgatgcaggtgtggctctttaacagaacccacaggggagcacacaggctctggggagagcaaacaaggcaagggctcagaagactaggttctaatcccaatgcccctttctcccggatatttaatcatagtcaaattacttaatgaccccaaagtacagtgatttccttaatattttacaaaagaataaaagcactatggacttttcttcaaacagacatatcacccctggcctcaggagtttaatattcagtgactctttggcaggtcgtgaactgcccatcagtcccagtggttgttatgaatgtcctctgctcatccatccagatcccctccccatctttcttcatcctgactcttcctgggagggtgatcaatatagacctgccaataggctcctgcaccctctagcttctaattgcattctgtccacgggaagccctggtgagagttacatcattccaggattgggagcaacctgtaagaggccccggacagctgtgtccatcctctgaaaatgaaggctgttctcaggtgacctgctctacccagatctttttccttccaggttctttttttttttttttgagatggagtctcactctgtcacccaggctggggtgcagtggcacaatctcagctgactgcagcctctgcctcccaagctcaagtgatcccctgcctcagcctgctgagtagctgggactacaggcgtgccccaccacactcagctaatttttgtccttttagtagagatggggttttgccatgttggccaggctgatcttgaatgcctggcctcaaatgatctgtctgcttcggcctcccaaaattctgggattacaggcatgagccacagtacttggcctccttccaggctctgataaatgtttcttcccctcatctcttaaagcctaggggaggttatggactgaatgtttgtgtccctcacaaaatttatatgttgaaatctaatcccaatgtgatggcatgaggaagtagggcctttgagaggtgattaggacatgagggtggaacccttgtgaatgggattagtgcccttataaggggctgaaaagaccagaattctaccccttcaccatgtgaggacacagcaagaaggcatcctctattaaccagaaaatgggcactcattagacaccggatctggacttcacagcctccagcattgtgagacagacatttctgttgtttatgagccacctggtttaaggtgtcttgttttagcagcccaaatggacaaacacagggaggtaagagcccctaccagcccctgtccaccagaaagatggggatctgaacagaagccagaggtgtaactggaatggactcaggtgttttcctcacagagcagataactaaagctagaattcttgataagaaaaatgggataaagaaataacagttgcaaaggtaagaagcagagacagagttatagtccagaggccaaaaggataattttaagaagaaggagtaggtctgaaagtgatgactgagactagcccttggctgtggtgattaagatctttggtgacaatagaaaatgtaacaataggagtggtctgttgtggtgatagaatctgcagaccggtggaagtccatgggcccatttaccatgccacaggcaaagagtatattaaactcccacgaagagaagtgcctctggattcattttgccaacattcactgtactgatattagccatggacttgcagagggtttatttactattgcagcctggctctctgctgtgtctgaaagttgaccttggtgtcctctaagttttatcccagagaaaaagacagcaattgagctattccccaggcacagggggcaaaatttgaaattgacataaaaccaagattccctgtctgacttgggcctctgggattgtattgctgcatcctgtggtggcaaaaagagtatcctgggcagtaagtgatttcaattccacttaaagcaacaagtatttgctgaaaaccaaccatattcttagtaagaagatgggtgctgtaggagacagagaattaaatgaaatcattccttccctccaggagcaaacagcttcatgctagaaataaagctaactcaaatgcaacaaacagaagacacacacacacacacacacacacacacacacacacacagagagagtacttttcaagattagtaacaaagagattatctacagagataaagacagaagaatccaatgtctgcatgttttgttattcatgtgtataagttttctaactttcctacattcagtgtgaattagtattgaaatcagaataaaaaagcaatatttttttaaaagcctaatttttagaaattgatagtaaaaaatgagacagccctgggctgaagtcccaggcgtccttcttcctaacaacttgaacttagccaagttgcttaactacttggtgcctaaatgttctcatttataaaactgggaagatggcatggagaggcaatgggcattttctggcaagaaactaagaaaaaaggccataaccaataagtaacttatggaaatgaaaaaatcttttaagttttataatcttgctttagttgatatcttaaaacaaaattttgaaagttattaagtcactcataaggatttcaggaagcactgcagtgtaatatgcttaagaatggagatggttcaaatgctagctcggctacttagcaatacctgtcctcaaataagttatttcaccctacctgagtctgttacttcatctctaaaatggagataatcctaaaacgtacctcacaggaaccttgtgaagataatgcatgtaaaatgctatcacagtccttggcatggaataagtgtctaattaacttttatatataattataattatcatctaaaaagtttagtggtgtttcagacaaatctaagagaagataagcatgaataggtatatgtctttttcatctttgtatttcaccagtgctttgcacagggcctgtcacaaagtagggatctgagaaatacttgtgaatgaagaatgaatgaatgaatgggctgattttcctatttgatcaaaagccacatccatatatgactaaatctgagtatataaaagaagataaaacttgtgtttcaattcaatctagtgagttaaattaaaagaagaaagggaggaaggcaaattaaaagaagaaagggaggaaaagaagcaggaaagagggaaataagacaaaaagaaaaaaaaaaaaacaaaacagaagttggccaggagaaagggtgtctccatccttaaatattttactccttattgtgtgatatattattttgtcagcttcttctagctacaattcccaaggaagggatagagagcagcagcttccaagtaatgacccatgtgggtataaagagaaatttttatcatattagaaaaaatatatttatatacatgctaccaactttacctagaagagaagagcaagggattggaaaacaaattagcataaaatccctgctccagctttttacacatacagatgttttcctgcatatttatccatccttctgagcactgctcaaatgttacatcctcagagaagctctcctggacccctcatcctgggctggatactctgtcacatgctctaatagtgtctgatacccttccactagaacagggatcactgttgtaattaggtaattatttgggtaattaattgtttaacatctgtgtccagtgtcagtatgcaagcaagctccatgaaggcagtgttcctgtctgcctgttcaccccaaaatcaccaacacttgcatatgccttgcatgaaacaggtaagtgaacataaatgtgtataaggttggcatccattctttgtgcattctgtgtttgtgaatttgcccactcaataaaatgcatttgtaacctcaacatcgatacttgccacatttctgtggtcatttttgggcatcacagagaagtgaaaaatttgtcacccaacatgtacattccccaagtgaagcagaacaaagcaaagctccaccttcttgctccatctctcatactgtaaacaagggtctttttctgatctattaaatgccaggttgttggggtgggttttcttttgcatttttgtacataatggccccaaaagaacagtgctgaagtgctgtctcttgttcctgagtacaagaagaatatgatgtgccttacagaggaaacatgagtgatagaagcttcattcaggctcaggttaaacagctcaggctgtgtcccatgacttcagtgttaatgaattagctatatgttaaataaggcatctttaaataaaagtaaacatttaaaaagtttacatattaatcaattaacaaaaatgttgtgaagaaacagccagtagcacgtgcctgtagttctggtttctcgggaagctaaggtgggaggattacttgagcccaggagttcgaactgcagtgcactatgattgcaccactgcactccagcctgggcaacagagtgagaccctatctcttaaaaacaaaaaaaatattgtaatcagaggctctcaggaactcaaccctggatttcccctaggggcaatggttcattatttgctaattcagcgtttgtggagactttatacaacaatttcctatgaaaaatcaggatcaactatatatatacatagaatgtatatgtgtatatatattttacatatttgtgtgtatacatgcacatgtgtatatatgtatgtttagtagtttttaaccattttggtgttatacacctgttgtaaaaatttaaggaagacgtggatactaggggctgagggttgccacaaagggaggtatgtacatatatacagccctgtgctatgcatctccagggcaggagacagggtgttgacattcacagtatagcctaagtgaatattcctactccatagaattgttcagtgtggtgacacttcatgcaaataaatacatgtatacacatacacatttgcataagattctgggcatttgtggcctcctatcgtgtacctcaggtaaaaatcctgacagagaaataatagatacacaaatataaatatatattatatatggcacattcaattttacttcaaatgttttacataggctaaaattgaaactaaaatgctttgcatttcagccaccaccaacagggactagacaattccaaaatatatgtatccccagaagaaagataatttgttgtgaaacactggctaaagacattccctaaggtaaactaaacacaggcagaaaactgagagttgaaaaaaaatatatacatatatagagagagagatgagagttgaatatctatatgtatatatagatatgtatatatagagagagatgtgtgtgtgtgtgtatatatatatatatatatagagagagagagagagagagagagacagaggagagagagagcacaacaagaatacgaaggttggccaggtgctgtggctcaagcctgaatcccagcattttgggaggccaaggcgggtagatcacgaggtcaagagatcgataccatcctgggcaacatgatgaaaccctatctctactgaaaatacaaaaaattagctgcgcatggtggtgcacacctgtactcccagctactcaggaggctgaggcaggaggatcacttgaacccaggagacagaggttgcagtgagccaagattgtgccactgcactccagcctggcgacagagtgagactccatctcaaacaaacaaacaaacaaaataccaaggttaacctgccccgtttgctttcctaagagtctaagattctctggattctcaggtctgtatggtgggcagcaatgtaaatttaagcttctctgacatctaagttctttggagacagtaactattaaacacctgactctgtcccttgaataacagacatttcttagtaaagcttttaattagatctgttggttgaggatgaaaatagaaagacaccagaaggaaaaaaaaaattcatccctgtaaatggtcctgtggaaatagtaactaaaacaattatactgttaataattcaatgttggtttaaaactatacaattgtgagttatttatacagaccagagttggcatgtgttgtaccacaggtggatgtgaggtcaccaagaaaccacttcacagttttcccagaagtgtagcgtcaaaaaggtcacttgtggtaaaagatcttttggattagtcttttaaatcaatgcatgaattaaagacaatttacatataaataggctaatactctggctttgaaattaaatggatttttaaaagatttaagtaactgcagaaaaggtcagttaggcagtaagtgtacataatgtgattcttgaaaactgctgtcttgttggtttattaatattttgtattcattgtcagtgttgttctaaaattgtgtgcataattagcaatgcaccaaagtcaacggcaggtcccaaaagtaaggaaagcggaatttacaaatcagtgaaggaaggacaagtctagatttggacatgaaaatagtcaaaattaacctttgcctatatattaatacacattagattcaaatatgtcacaacatattctaaataagcatggcatcactcgctccagttaaatttaccttggcatttagcctcactgataaattttcaactcttccaaaatacaaaagctgcagtagtctcctgagttatcacaacaggatcatgattgtaatttgaaatcctgattccccttttagggaacagaaacctgcagtttttccaactgtaatgaaaggatagagcgaaacttccataggatcaaaccacattccattaccaccactcctctgaacattaatgtaccttaaaacatattgaaccataggatgaatatatggagcaggggcatttttaggagagtgaaactattctgtatgatactacgagagatacatgatgttacatacttgtccaaacacacaggactatgacaaaagattgagtcctaatgtaaacgagggatgacttcagttaacaatagtgtagcaatattggttaatcaattataacaaatgtgtcaatccaatgcaagatgttaaccataatgaatactgtgggcaaagggaggggatttgtgggaaacctctgtactgtactttctgctcagtttttcagtaaaactaaatttgctgtagaaaatcgtctgttttttaaaatagtgaaccaaatgtaataatgcactcaaagactctttttagacaaatggtttataaactatattcagaggagccctagtggtcctttgctggccatttggtttaggagtgtttgggaaaatagagtaggagagaagagggaacaatgaagaaaagactgctcaagctggccccttatctttcacccctgtttcaaacaaagcaacaaccttttcacctgtacatattgtttctccacattggagcccagtaaagaagggtttctcagctaaagagaaaaaaaaaacatgaaaatcaccaatgtatgctcaataaagtatcttgctacataaatcagcaactcaaagaagaaaaagttaaattataaaaaccttgctaataatgtacactaattccctcagctacttaataaacatttaactaaaactttctgcctgaccattattacttcctatgattgggctaagcataagctaaatgactaccttggaagaactccaactaagaagtatttatttcacatcaacaatgaaccagtactctgttagaacatgcaacatgctttggaaagacaggtgaaatacaaagcatcattccagctgtccagaagcttatcatcttacaggacagagaacatgaacacaacaaaatgcagaaacaatataatacacctgaggcacccagcacccaacttgatgagctaaaaaatagatttcaggtcttctgtcaggtgttaacaaattgtcaactctgaataatgtgagggccagtatgaatgagaacagtccaatccccagttaagccccacttttctaaatcttcttctctctttaaaaaagcaaagtgaatgctaacgtagtctatcagtaatggacagtgtcctcataaaaagacatatgtaaaaaggaggggaagtggaaggtaagcagtgcttactattttatcatattcaattgtatacacacctcctctcaaaattggtgtccccctatcagtagttactaacaagttagttcccaggatcttgcagatggtgggctggtttcagacaaaggcacagtggtccagaggatctggcaacctctttcaggggctgttgggagatgccctgacggcagcagaagcagcctccaatgaggatggcttcctgctcaagacctcctcacactcctcttgcataaataaatgatttagacaccgttttctcctctaatagccagcactacaccaaagagaaaacactccgctattgatgacaggagagggctttttttgtaagtgtgtatgtgtgttatgctataaattaccctgttggtgggtgtaaaaataaatatccatgtatatagttgtgtatacacacacacacacacttacacagagagaatatgttacagttaaaatcatgctgtcgacagccactcaaatctagagcaatttatggctctcaatgcagtcacacattcaggataaagacaggatgataataaatactttgaatattaccagcataaataaactgcctgaggagcttaaacatttgcaacatagccttgctggctcacactgacaaccagcagacctgttgccagtgagcgactgaaagatcaaacatgattaaaaatgcaaagatgctgcacccaaatgacatgctttatttgacaatgaactctggactcagaggcaccactgcaatctatgagcaaagtgctttttggtaattcatttgcccactgaggccagctactgaggaatcacaatacaagtcccttttaaagtaggcacagttctttacagccattagtaattccatcttgagactgcccttcgagaaaacaatttctttttttttttttttactgagaattgatggtttgtgttttgtcaaaatgagccccagaagttgttaagaacttgtgtaatacattagctatgagtagccgaataatggtcttcaagtaagtacaggaaaatgaatggctgtgatgaagatggtgggcaggtatccttttactgaaactactaaagcaggggctgaagtcaggttttaaaaaagattcttgtgaccataagacacaggaatgtccagtggaagaaagccagttctagcttggagttttaggaacaagccagtttccttggtgtctcagtatcatttgattctatagtatgttatttcttttatttacatacatatgacattcatgatttctttttaaatatccataaattcaaagtggaatacaatgtcacaatgtcttaagtctcagaataagatgctgagaagaccatgaacaagtgatttctttttctttttctttttttttttgagacagagtgttgctctgtcgcccaggctggagtgcagtgggcaagatctcagctcactacaatctccaacccctgggttcaagcaattctcctacctcagccaccctagtggttgggattacaggtgcctgctaccacgcccagctaatttttctatttttagtacagacagcattttgccatgctggccaggctggtctagaactcctgacctcaggtgatctgcctgcctcagcctcccaaagtgctgggattataggcatgagccatagcgcccagacaaacaagcgggggtttcttaaggaagggcttccaagaaaaactgcttacagcgtggcaagaagtagaacagggaaaggcaagaagccaagcgagggtgtgattcagggtagaatcctctgagggacgttttcccaccagaggcaaggaaactgggctttcactctcactcaccaatcactctgcagctaagagccatcctgggggttcctaaactccaagcacttccagctctcagcagacctagtgaagccagcagctccaattggtcctgcaaagaccattgccgaagcagccattggaaggtaaatacacagaagctggggcagggctcacagatatgttgaaaggtaccagggcagtgctccgacaccttctgctacagcaaagaagcaaatggtccaaaaatcaaaatgagggtagaataaggttggagaattcaaaaagtgcagaaaaaaaataaaagtcccccttctctcacccccaccttccactcacccttcacctagtccttctttccaaaggtaacctttgtttacagttttctataaatccttctaaggaaaaatatacacatatactatgtatctatttaaacattctttttaaaaatatgcagattggacaactgttccactgttctactccttgctttttctcactaaagaatatatcttgtattctagatattatattagatctatatacatattctaaatagagagatgatagattagacagataaatgcaaagaggaaggaagggaaggaaaaatggatggatggatggatggatggatggatggatggatggatggatactacacttcattgatttaaagataaaacagttttccacattttaacatttctgaaataggctgtcttatacttgacagcattttagatttgctaaaatgcagtagatagatatatagctatttatggatggattgacagttcacacatagctctgccacttgagaagtagtgcaggatagtagttaagagtatattaacacattgcttattaatgagatactttcgtacttgaggaataaggacctcttttgatggggctaatattttaataatctgataaattgtttattaactttaaattttcataatgagtccgtaaatgagtttgatttatagttttctattctgtgctgtctctctcagactttggaatccatattacattggcttcataaaaacacactggcagtttttttctttatttgtgctatgggcaattttgtttacttttataattctttgactatgtaatacatgtactgtgtatcaaattcaaaaagtacaaaagggcatgagtaaaaaagtatctctacctgtcttccagctgcctagtcccttcccccagatgcaatcattgtaatccgttgcttttgcgttcctttagttatgtatgacacatacacatatgcacaaggacacacacttttactcaaatgtcggtataatagacacaatgctctgcatcttgcttttttttcacttcatgtgttttgtagattgttccataactatacacagaacctccacatcctatctgatgacttcacagtattccattatgcagatataaaattaattttaccagttttcatttttaaatagaattaacattatcagttccttgaaatgcaaaattatttgcttctgaaagcataaagacctgtggctttttaagatctttgataactgcttcagatttttccgatgttattaaagttctctttcctgttgaatatgtttgggtaacttatttacctgtttaaaaaatacattccttgaagattttcagttacttttgcaaaagttctcctttgaatattttaatttctttagccatggttctttttcctttttcctttgttttttgtttttttttttttaagacagggtcttactctgtcctctgtctgtcacccaggctggagtgcagtggcacgatcagggctcactgcagcctaaacttcctgggctcaagtgatcctcccaccttagcctcttgagtagttgggactactggcatgcgccactacccctgtctaatttttgtattttttgtagagatggggtttcaccatgttacccagcctggtcttgaactcctgggctcaagccatccagctgcctcggcctcccaaagtgttaagattataggcttgagccactgggactgtctgctttccattttttgtttttgtactccctaactttttgagtaagtgaatttcattgcttggcattgttttcaaggtgtgttagtctgttttcatgctgctgatgaagacatacccaagactgggaagaaaaagaggtttaattagacttacagttccacatgacaggggaggcctcagaatcatggcgggaggtgaaaggcacttcttacatggtggcagcaagagaaaatgagtaggaagcaaaagcagaaacccctgataaacccatcagatcacgtaagacttattcactatcatgagaatagcatgggaaagaccagcccccatgattcaattacctccccctaggtacctcccacaacacgtgggaattcggggagatacaactcaagctgagattttaatggggacacagcgaaaccatatcacaaggagacagtatttgagcttatttatgattcttatggatttatttttaaattagaaaacctaatttcttatttttatctttattatttagttctttctgcattttttccagttttttggctgtccctttcttaagtcagatgcataattcctttatttttattcttttttaaatattcaggtgttaaaggctgtatacattttcttctaagcgaggctttagctgtagcccatagctcagatgtgttatattttcattatcaatggtgtctagatatttttcaagttgggtttaaaatgtttctttgaattaagagttgtttatcaaagagggttgttgtttgtttgtttgttttgagatggagtcttggtctgtcccccaggctggagtgcagtggcacaatcttggctcactgcaacctctgcttcctgggtcaagcaattcccctgcctcagcctccttcatagctgagattacaggtgtgtgccaccacactcaactaatgtttgtatttttagtagaaacaacgtttcaccatgttggccaggctggtctcgaactcctgacctctggtgatctgctcacctcggcctcccagagtatcaaagagttttaaaatatccagattgtaaggttttgataaaactgatttctaatttattgcattgtaatcaggtaatggggactttatttgtacttcagcttcttgaaatttcctgcaatttcttcataacttataaaggccatgtgtttgtattacattgttttattatttgatatattttgaaccacatattttagaggggctttcctatcacaaacatatttcaaagttgtttgcaaaatattttgcattttctaatcaccataagtgaagtgattagaaaacacatcagggcttctgtggctcaggatttggtgcttgcctcacatagacacaaccagtaactcttactcttgtgccaaatgatgtaattgccctaggaaaatgtttctacacctctcttgcccactttcattgaagaaatggtgactgaatctgaatgtcaggaagggttgtgggttgtggatatggcaactgcaaaactgcagacaatagagatgtacactgcttttgtggtagggacaggatttgagcagtggaaaggcataaataagaaaaagagaaattaattcatgattaagacagattctggcataaagaaattgcagtagtagtagtagtagtagtagtagtagttagtgctgaataccgtatctattttctttcatcagaatctgctggttccatttcatagttcagaggtctcacaaattcaggcaatattcacagctgtggacatagtaacttaggcatattttgcattattaaacgattgatgctatctttaaatttaggttgcaacataacatacatgaaatctgataccaagtcttcacattggcaactagatgggcattgaacacaaaactagaaattgttttatttttataaaatatttaataagatttaattaaagtgtcataaaaatccagctacattgaaatgtttgatttaaatgttttttattagctaacccattcttcattttgctttttaaattctaatgtataattttgaatattgtgcaagaaatatgactttcttaaaaacattaaaaattaattttaattttttcaatgtataattaatttatatgcttgaggaaaatatattcaaattgtatacattttaaatacaaatgcagtttaatttctaattctttagatcagggatcagcaaactttttctgtaaagaaccagacagtaaacattttgggctgttacaacgactcttctctgtcactgccctagcacaaaaggaatcacagacaatgcataagtgaatgggagtggctagagttggccctggggccttagtttgcagatccctgtattagatcataactgccaatagacaaaaagtatcttaaaaaaaaaccccttgattataacaacatgacaattttactgaaatgaagatgagaaaaaataacttaattggaataaatatataataatttaagaaatatttcagtcttttaaaaaactcactaaaatgtcatcagcccaataacagaacatgtacaataataatcaagagctgttgtctttgatatttggtcaattttcaatcacgtaaaaactagggcttcacctatacatttagattttgtccttaaaaaagttatctcatggcagaggataaaaaacacttctttaatggcttactagctggatttgttaatttttaaatatttagacagatggtatatggcctcctttttgccctgggccccataaaccttagatgtaggcctgaatacaacagtgatcaagagacaaaggccctactgtcttgaattacagtctagtaaattctagtgcacatccattgactctaatttagaccagtcaatcatctattctcacatgcactactgcaatagctttttttttttttttttttgagactgagtcttgttctgttgcccaggctggagtgcagtggcatgttcttggctcactgcaacctcctcctcccaggttcaagtgattcttgtgcatcagcctctcaagtagctgggatcacaggtgtgcaccaccacgccctgctagtttttgtatttttagtatagatgggatttcacccggcctcccaaaatgttgggattacaggtgtactgtacccactgtacccagcctgcaataggttttttattgctctctctatatctattcttgccctcaccaacctattttccacataacaaattaatatgttaaaaacataaactatcacctctttcctaaaagctcttcaattgttttccattacattccagattaaatccaaagtcttttatgattagtattattatttttgagacagagtttcgctcttgttgcccaggctagagtgcaatggcgcaatctcggctcactgcaacctctacctcccaggttcaagcgattctcctgcctcagcctcccacgtagctgggatcacaggcatgtgccaccgtgcccagctaattttgtatttttagtagagacagggtttctccatgttggtcaggctggtctccaactctcgccctcaggtgatccacctgcctcagcctcccaaagtgctgggattacaggcatgagccactgcgcctggcccaaagtctttttttataacatatgaaatcttgttcttccctatcttccaactttatcttgtgcacttccttccttgcccagtattatctggccttttattgtacttctaacatattgaggcatttcttgcctcgggacctttgcacatgcaatcatctggctacagtgtttctcctttccctactcctttttcggggctacttttttcatttttacatctctgcttaaacattttcacctccaagaagacttgtaagtccattcagtctaacatatatgattcttgctatattctgtcactgcatcctgttcaatttccttcacagccataggaagaaaacctgtaattctatatatttatctgtttacttgtatatttcctattctgtaaactctttgagagccaggataatttttattttgtttatcacttccagtgcccacaatgcctggaaatcatacatactcaaaagatagttgttaaaaaagtaaatgaatatcaattcatttgttgaacaaataaatatgaaatggataggcacattctggacctatcgaaccattctagcatgaagcctttattcccagagtgatagcaatatcagggtccccccaactaatgattttcaagcccactcagatcctttattcatgctgtatttccaagctgaatttccttcccccacttctctctgccttctcaaatatttatttctttcactaattcaaacacacttctctcaacaagtctttggtacccttttcagccccaaataataggtcttgatttctacatttattatctgaatcattcactttagtatcatcttacggtgcctaattctttctaaatctaagttccttccatagtgtatgtagtagagaccatgtgcacttaatccagccagcagcatggagtggaaccccaaaacatattgatatcattggcagccttagcctgtgttccccatctgactcttacatcccactcaggaaagcagaccctaaacaaaggcttacaactaggtagtttattttgggaaaagaaccctagataatcaaattgaggaacgagggagagtaaaacaggggaaaagggtatcttaaatcagattccctagaagtacactctgaaatgggtacgcttgtacaagaaattgattgaaatagtgccctcaggagaaacctatggggaaatgagggagtaggatgggccagggaagaagccacggaaagatatggcttcagctggagtccagccatggcccaaacccagagtatggacaagagtatggagtatgaacagcaccacagagttattccccttgacagcttctgttagtccttggctgtggactgcccttgaccaggcataggggatcctctaaggtatttctggggaagttcatttccctcaatagagggttaattctcctgagatgagttcagctgtgagaccttagtatccaacactctaagcagctggggcatgggtgtgttgacccactaatggtggtcttggtaggggaccaacagcatcctctacagagggaaatacaatataagtatacattctcaagtcgataacaactacaggcacctagggctcaacctgctggaatcttccgagaaaacttacatgcttcagatgtatatgtataatgtgcttcagacatgtctaaacaaggcatggaagagattatttatccaccaactcccagtccccaccagtcaggggttattccgtgggttaataactctcttatacttccaggttgccagtctcactcccaaggtggtagaaaatagggatgaaaatagggatgcccaatgccacttaggcaagaggcttcaggtcacacttgccctaacctggtttccacagcgacagccctaatacagaaagggagacaagaggatgtgagatgtgtcacaggaagtgtccaatccactaactacttgccctagatctttggagaattaaataacctgtcctactgctatgcatgacagaagccctaccagtgggggctagttggccttcacattggctcctggccttctcattggctcatcttaggtgtcttgggctatctgcctgatacacattttcagttaggcacgtcatgtgaccttacagaccaaggttatgcaaaagagaaatgaaaattaacttattaatcttatgacagtattgggctctctgtatttttctcagggtccctgacactgatggtattatctcattctttggtgatgattatgtgtggaatgtttcatttaaaaattccagtgttgtctctcatgaaagcctgatacggtaggctctatatacatactggtgatgatcgtaatatgtgtgtagcacaaagtagtccctgaacaacatttttaatggcaaacagtgattccttcccccaacaaattaagtaaaaatgataaattcctacattgaaagaaatcggcaaaacagaacatttccttcaattcacataatcattaagaagtatcattcataaggggttagaaacatataatatccaaccttcctgtttaacagagcccagcaaggactcaaatgcacagttcattactgtcattatgagagaatttctgccaacaagttacagtcaggttactatcattcaatcatgttgctaataggactaatttcatggtaattggcatattctagaccagagaagaactcaaatggttgtggaatcattaatgatttatgctttcatggtaaaaatgacaatctattagtttaccagatgctggatcaagccatgggccattaacaggagggtgttctcagaacgttttcagaacaaataccagctactttattttcagcttgcagacataatcacatgcatcccctatcagatccaccactatactgtcagatacatcataaattaaaggctccatgggctcattattggctcttattcgtaaaagcaacacgttgccctggcaagacccaaaatattaaatgggcatttaaagaaactgcaaaatgtgtagttttggaaaaatgaaatcttccttaaaactatttacagtactcaagttttcaaaatgtccttcatcctcgattttgcctcaatatttgtttttttgttttttgttttttaataaaagcaaagaaaaaagaaacaaattcctgccctgtcaggaaagcttttaggccgagtctcttaggaactgggtgtcatttattagtaaacctaatatgctgccttcagaagaacagaggtgccagcatcaaataaacaggcttaaaaaaaaaaattccaggaaacttaatgtacactacgttagtaaccaggacaactcttgtttcccagcaatctatggcatagatacgttggtatgagataaagcctccatctttcctgaatcttcaaaacaaatgtaaagctgattaaaattcctcttctgtcttgcctatgtacaaggctgctctcccaataccaagcaatcctatttggagacaatgggatgtttgccaaaccaaaccgaaataaataaataaataaataaataggagagtttctgttttcaactgttgatggcatcacccttgccatttgtggtgatcagattatccacctagaaagtgtaagaaaacaagtcttccggttagcacttactgggcaaagggctgagtttcaagaatcacaactgaaatcggtggggttgctctttgttaatgggaaaaagcaccatgttaaagtgaccagggcctggtgtgtgcaccgcatgatctgtgagcatgagttgtgtgtgcaacatgcttcctcgtgattaccgcctatacggacagtcactgtgcattagtgcattggtagccagccgccgccaaaaacaggatggcattcttccatcgtgattagaggttttgtgagcattttgggatgggggacactttctcagtaaagactcttccgccccattcacgttcattcagctctttctaggggaaattaaaagctgcagtgataatcccttaaggacaacttggaagagtataaaaggtgcagtgtataagcaattggatgagaaagccttttatgtggaaagttactgaatgggtggctgagggtggtgtgagtggggagaaagaggggcagcttttcttttctaaggtggggagcagcggggatatcatggcacttcagttccctttaatcatccagattcctacgctgtccctgcccctggtgtcaccttgttttgcagtgccagctagctcctccctgccattttcccctcaaagagggagaggggagcaatgcgatttttggtaaggacccagtttctcgctgaatgccaactcagccagctggcaccgaacaggccaagccttcttcagaagaggttagcaaaatccaaattagcatggtccattttaaaaacttgcttttatttaaagactgattcatgacaaacagtggctcccgtactgaggtctggcaccccaggggctggcatccaaccaaacacatgcaactaattgccaccctcggatgacacgcaactaacaagctccattttgaggcagtagattcactaagaatgtaaccccggaaggcagcggaggcagaaaagctcctttcataaccctgtcctaggctaaccatggcagcagagagcctgaaaaacacttttgtttcattgcaccaacaatttagctccacggagggctacaaacacggctaacttgctgaaaagtgatcaagggcactgcgatccccctcatggttataggaggcaggggctctgcttttctctttgctcaaggaaacacacaaaattgcctactatcttgaaactccgcatcttgcaccatttgcaaatctatcgacccccagtacttccccttatactttagttcagatgctctcaggcttcctttgtacaagcaagggctctggagccaggatgcctaggttcaaatcccagctccaccattcattagtaattggcaagtattttaacccatctatgcctcagtttcttcatctataaagtggagagaatattagcacctacattactacgagtaggaacgagtcaatgtaataatgtacataggacaatgcctgacatatcatcactctgttatgaaagctctttgagtctgagatagctcggccttatgaagaaaaaatttccctttgcataagctgcattttagtcaaagttcttgcttccctgtaaacttctagagattcaacctctaagcctttgtttaccattctttctcctctcaactgtccttcctccattgcacagccctgtatgactaaatctcatcatcctccaaaaccattcttcaatgccacctcctccgaggagacttctctgccatcccagctgccatgaatccctgcactcttggcatggccatggcaatttctgcaaacaaatgactgtgttttacttgcctgttatatttccttttctagactgacagatccttttgagcataatccacgagtaactagcacatagtagatactcaatgaatatttggtaaagaagtagatggtcagatgaaagaattgctctgcataaatgagtagctttatactatggttatgctgggcattactcaataggcaggatgggggaatcgtttcttaaggactttcatagttgctttggcccaaattaagagttgtatttaacttgtcatcaactgaggctcataaataaaatctatcaaagaaatatgtcaattaccaccttagtcagcttgggctgccataacaaaacaccaaggattgtgtggcttaaacaacagaaatttatttctcacagttctagaggctgaaagtccaagatcatggtgtcagcagattctgtttctcctgaggcctctctccctggcttgcgtatggctgccttttcgttcaccatgtcacatggtctttcctctgtgtgcttcctcccctagtatctcctcttcttcttcttataagggcaccagttgcattggattaggtcccacccttatgacctcatttaacattaattacctttatttttatttttattttatttatttatttatttttgagatggagtctcgctctgtcacccaggctggagtgcagtggcgcaatctcggctcactgcaagctccgcctcctgggttcgtgccattctcctgccttagcctcccgaggagctgggactacaggcacccaccaccacacctggctaattttgtttttgtatttttggtagagatggggtttcaccgtgttagccaggatggtctcaatctcctcacctcgtgatctgcccacctcggcctcccaaagtgctgggattacaggtgtgagccaccgtgccctgcctacctttaaaggggtaattaaggttacctttaaaagttgtctccaaatacagtcacattagggattcaggcttcagtgtatcaattcaggggaatacaattcaggccatcacaatgacatatacatatagaagcatgaatattctgtatattacttaagtgcataggaggaacttaaccataggaagtccacaagcctttgctccttaagtcctggcatccagatcttcattatgttagcaaaagttcagacaatggaaacaaatgtggcactcaaatacacaactattttatctagatgaaaaattaagctttctttggaatttgtgggattcagttggggggctcagttgcttctctcttagaggcaggaaaacatcagcaccccaggcagcagccacaaccctgtctcctgttaaagccattgcctctcccaagaacaaatgcaaattcccagctaaactcctgtgcactttctaggaggaggctcactttggtccttctaggatcaatttatctgaatcttttcttttgaaggcggacctgcagctttatgtagccctgaaactctgaaccagcttctcatgccagcaccccttctttagtcacttcataattcaaattgctgttatcagcatacactatttgtactgatttgactttttcacattgttttaaatcactaatttcctattaggcagattcctcacatcaataccataagctaatggctcccatggtatttgttcatatctttctcttaagatacttaacactttttacctggtaggaggatgatttatagtcatatgtgtctttcttgccagaccttttaactacttaaggttagaattgcatcaaacccattgttttatcccaaccagtgcttaacatgatatggcacacgtagcagagtcacagtaaaagtttgctgtaattcacatagactttgccaggagtgcatagaaggattaagcatcagaagcaatgcaatcgcaaaggtatctcgtaccatcaaggggtgaggccaacatcttagaaaattaagatcaaatatcatccttcatttttaatttaaagcttctagccagttgacccagaaacatcccacacctccaccatgacttaccaatttgtctgaaataataaagaggaaaatgagaggctattagcgccacttccattctccagtcaatcattgttctaaattattaatcagttgaagtattgccaagaaattttcaggcctctctccaaaagtgtaaagtagtcattttcaagtgaacaattaactattttattcatctagaagttgtagaatttatagacaagctgatttctgtggattttcttccccccttttggatgctggtggaggtaagagaggtctacatgaactacaaatagtttcctttccatcactcacttattaataactagaatcctgtttaaaaggaatgtactaaaatattttctaggctgaagcaggaggattgcttgaacccaggagtttgagactagcctgggcaacatagggacaccctgtctctacaaaaaaaaagaaaaaaaaaaagaaattaaattagctgggtatggtggcatgtgcctgtggccttaactacttatgaagctgaggtgggaggacgccagagcccgggaggtagaggctacagtgagccatgattgtgccactgcaccccagcctgggcagcaaagagatactctgtctcaaaaataaagtaaaataaaatatttcctgaccagttcagcatttataatattgttcctaatagcatgccactcctgactgatcattgctggcaaaagcaaagtgatcgattgtcaccaccctgtttgtccccaggattaacttggtaaagaagtacagccatggtttctgctttcgtggagcttacattctagaggagacagtgaaaaagaaaggtaaatagacaaatgaaacaactacagcaaattttactaaaaaaaaaataaaataaaaaaaggaaaaaagaggctaagataaagaaaggggaggtgtaccttaaataagatgtcgataaagacctcactagcaggaatcatcctccgtggatcaggagaatcctgaaactggggacctcataggcagtccaatccaaagtgtgaataggccatgaacatttttaaaactatatattcagttctggtcatctattgacctcagagacactagatttccagtggcatccactactatgactgcaattgctgaggggtaattttctgagccagagttgtagcatgcaatttgccttgtcattctcatctgatgctcattaatagtcccaacttttatgtaaggtatgtgctttcaaaggtagtgtgatatgtggctaaaaatattgatttttttcttttacacttttgtttcttttaaaaggaggaaaagtgagcactaatttttttatttcaactgtatcttttgaaggttcattatgcatatattttgataatcttgtctatgagaatgaaccctaggacaattaaatatcctttaattttgagatgtgtagtctggaaatacctacatggccgtcctaggctttaggttcattttctttgagaggctcaaccccatattatatcagatatatttacaggtcaaaaggcaagattgaaacaaatttagtttaaagatcttaactggcttttatttgtgattctagaatcagacaaaacctcactgtataaaaaagaatgagtgttccaatgagctgagcagaggaggtttcctttacagctggaaaagggatgaagaaagcagaaacaaagaaccaaaagcaaattggttgtttccaagttactttccttgtaaaggttaaagcagagggacatccttatcatattggctacaactggtctagttgaggatttggctactagttctcccccctgatttcttagaaggtcagatgaaaaacttggttttggcttggtggccaaaacttcagcatgagtaattctattttggtttggactgttgagcttggttcagtagttcagtccaaaccaatggacttctataaattttattcaacatacacgaaacagtttttgtatgtgagatctgtgaaaaatatttttatacttttgcatttaaaattatttgcttatgtataatttggttaatttaattttttaaattgcctaaaatttcccagtaatcaacatgcagtttcaggaattcttaagaactgagaaaagctaactcataaaatgtctctaagagtagacattttaataactattacatttagtaattaatcacaatagcataaaatttcatttattgacatatcattaaatatgacattgttcagattgtgcaatttctgcatacactgaaatcaaagtagtttttctctctctgttagttctgaatattttcataggcccttgaaaaatacattggccctagtcattagttcctggtacctaaagattaaagaggcaatagaatatgtgtgtattcccaggtcttacatggcactagatagtgggggtcttttccccctaaataaagtggatgctattataaccatgcatgactccagttagacccagatgaatgtaccaaaatcactaccatttaaaaagcataaaaaaccttgccctcaatttactgtgatttgcaaactctcctctgaagtttcactgaaccccacttataaatatcatcttgcttctttagcaaattctcaaaccttagtacataagaatcacccagagctcttattaaaaacagattcctgggccctgaccccaaagaatcttatttaatagatctaagtggagcccagaaatcagagtttttaaccttctgaaaccttaaaggttgtataagcctttagaaaacattagttgatgtgagcagggttgatgataacagctggtaagattagtcttgacttgagctactgaacaactcaagtccatttaggctagtctctctcaaccctggctcatactagaatcccctggggcttttaaagcactttacccccaaggattctgatttcttctgtatgggcattggtattttttaaagctaccatataaacaaattgagaaaccctaccagcctaagggcatttctgtcagaaaggattaacccacacactgcggtgatgataaggcctaacactcctacaaaatgcaaacactgaagcagagatttcgcaagactaaaatccatctggagctcttgattcccagtttgtgtcagcctcaacacacccaagttggccttaacagttatggcacaagaaaatgagcccttccctttagttttcatcagctggcagaatgatttagtagctctattataaaagcaactccattataattacagtgtttgaattataaacaaaacaagaaaaatacagaaggaatagtcctttagtcaaaactgtaaaacagaacaatttctggctgcagttaaaagcaaactgaaatattaagagtaagctctccagccctttgattcttgcctctttcccataggagcgacactacacattttttcaattaagcagtttgacaacctgaagaaacccacagtgcatgatttaatgagcatatactgtgtgcatggtaatcggcaagctgacagtttgctcatttcaaactgacaagagagcactacacattagtagaaaggtttcttgggtctcttttcattaaataagctttacagttgaggaacattccaactgtattggcaaagctgtcactaatggtccccaggcaaccttaactctctgtcactctccaagtcctcaagtcttgatgaagaaattgcttcttaaaaaacaaagcacaaaaacaaaatatagatatttaaagttctctggatgttgtcaggggcaaggtggagctttctgagccatgaatccactggtgatttcacagtacatgaattctaacccagtatgtgctggttcttcatgcagatcactttataaactggaattgtttttagaaataatgcccaaactgttaaattattcaatagtttagaaatgattcagtgtactggaaaaaacataggccttggtgacagagagataggggttcgaattctgactaaaatacttctctgtggccttggtcaaattacatcatttctcaggggctcagtttcctaatttatgaaacatggacaataacatctgctttgtatgaacaagatcgtaaaagtctttcgcacagttactgacaacacaggcatacttaaatagagactagtttacccacagaaattcagagtatggggttttaacaaagctaactatagtctgactgtcctgagatttctaccatgagcctttattggagttctataagaagaaaaacagtaagctaacattcactcacaaatgggattttatttaatcctactaagattctgaattttgggtgttattacacctgtttttataaaatctcgaaataagaagggttcttagaggtcatatgaggaatttctgacattttaacttttctgattacaagaatatgaaactactgtttccctctttgctctgcttgtcagaaaactcgagtgaattctcatgctaaatgtatgtttgcaactctgttagcagtagcggttagcagatttgtttcctgattttctatacatatgttagtaaccttacttaaaatagtttataagctaccctgaaggaagttgagatttcttagctaactagtaagatccataacaagaatccatgtcacctgactccaggctaggacacctcacatataacatggaaatgacatagaaaaccccagaagcaagtacagtgaagccatagcttattgcttgggtcctatgccatgaagatgatcaaacatattagccttctagttacgaggaaaaaatatggaagcttcagggtccttatttctaaaatagggataatatatatttctaagatcattgtaaagatttagagagaatattttcaaaatcagccagtgtggcattcgatacatagtaacattttaaaagtctgaaatgttgactctaagaaataattgtagttctactaattacaagtaaaacacaaatgcatagacccttaaacatgatttagaaatcatttatccctccaaacttcacgcactgatgtaaaattctgccccaggctaggtgaagatccatacttgctgtctttctctcatgtcacagagtacatggagatctggaaaagttgtccataaattccaaattcttaatataaacatgtctattggaaatacagactcttttttttttttttttgagacagagtctggctgttgttgctcagtggagtcatcttggctcactgcaacctctgcttcctggagtccagtgattcttttgcctcagcctcccaagcagctcagattcccaagcagcatcatgcctggctaatttttgtatttttagtagagatggagtttcatcgtgttgcccaagctggtctcgaactcctggcctcaagaaatccacccactttggcctcccaaagtgggattacaggcatgagccactgtgcccaaccagaagtacagaactttatcaagaatacacacatgtgacattttcaggtttaataatttatacttcagggtactcacaaaactgggccaaaatcatggtctacctctatgtgaaataccaagtttccctatgtctcacagccatgactccactggtgacttcacagtacacgaattctaacccataaattgactatatccagaatgtagccagacataccataaagatgttcatttatcttcaagggagtccacaaaaatagcactgtagttcctcatatgcataccctaacaaaaatgagtcagtggtgtttccccagagaaaaacgatgctgtgcagtggaagcagctttggaaacagacagattcagatttgaaggctggctctgctatccattagttgtatgacattggacaacatagtatgaacctcttagagccatagattcttccactggcaaatggaggaaacactttgaacttatataactattgtaagcaggggttatgttatgatttaaatgtcccctccaaaaattatgttaaaatttaactgccattgtcatggtatggagaagagggaccatcaagaggtgggaccactgagagatgattaggtcttgagagctctaccttcataaatggattaacatcattatgaagaaagtaggtttgttatcatgagtgagttattataaaaatgagtttggccctctcattggctcattttcattttctcctgcccttctgcttgcctccatgggatgacaagcacaaaggccctcaccagatgccagcaccttgctgttgtacttcccaacttccagaaccatgaaccaaataaatttattttcttttaataaattgcccaatctcgggtattctgttatagcagaaacaaaatggactaagacaaatgatatttaaaatatttaaccattagtatggtaaaggcaccaaccagcataggcttaatgcctgttctggtgcatactaattaaatatgaactccatttgaagaattttgaaggcatccaacttgatcctagatcatgggaggtgcttaaacatatacaacgcattaaatgaagcaaacacgtgttgtaaaacattacaataaaaaacttagcagcagttatactgagatctctatactctccaattacattttttcacctgtgttgtttttattccatgattttattaaatgattgttagcttaaagtgatgagccacttgcgtcttttgactcatgattgagacagtcgtcaaaaaattctagatttgaaaagacataaagtgatctcacttggaattttatcaagtctatattcatgtataatccttatgtcttcttaatttaatgactcctttattatgacacactcttcttctttatctctgataatattttttgtcttaaagttgagtttgtctgatattattatagccactctagacttcctatgctgtttccatggtgtatttatttccatcaatttattttaaacctatctgtgtttttttatttaaaggctatctcttaacagaacatagctgttcttgcttttttatacattctaatcatctcagcatttttttgaatatttatttatttttgtttgtttggtttctttgcccacaaaacttattcattttgtcaatcatttgaaagtagcttgcattcataaagcccttgggcttaggtctttttaaaaaaaattcattcatctgtttttatgtgtttattttttcaagtttcattttagattcagggggtatatttgcatgtttcttacctgggtatattgcatcatgctgaggtttgggatatgaatggtagcattacccaggtactgagcatagtactcaccatttggtttttcaaccttttcccctctcccttcttccctgctctagtagtccccagtgtctattgttaccatcttcacgtccacacgtacccaaagtttagttcctacttacaagtgagaacatgtggcatttagttttctgttcctgcattaaattgctaggataatggtgtctggctgcatccacgtggctgcaaaggacatgattcgattcttttttattactgcataatatcccatgatatacatgtaccaaattttctttatctgatccaccattgatgggcacctaggttgagtccatatctttgctattgtgaatagtgctgtgacaatgaacatgcaagtacatgtgtctttggtagaatgatttgttttcttttggatctatacacagtaatggaatcgctggatcgaatggtagttctgttttaagttctttgggaaatcaccaaactgctttccacagtggccgaactaatttacattcccaccaacagtgtataagcattcctgtttctcagcagcctcaccaacatgtggtttttttttgtttgtttagttttgttttgtttttgttgttttttttttttttactttagccattctgactggtgtgagatggtatctcatggtggttttgatttgtatttctctgatgattagggacaatgagcattttttcatgtttgttggccacttgtatgtctgtctccctttgagaagtttctgttcatgtcttttgcccactttttaatggggttggtttttgcttgttcaatcatttaagttccttatagactccagatattagacctttagtggttgtgtaatttgtgaatattttctgtcatcctgtaggttgtttactctgttgacagtttcttttgctgtgcagaagctctctggtttgattagtctcacttgtcaatttttggttttgttgcaattgcttttgaggacttagtcataaattctttcccaaggctgatgtccagaatggtgtttcctaggttttcctctaggattctcatactttgagttcttacatttaaatctttactccatatggagttagctttgtatatggtgaaatgtaggggtccagtttcattcttctgtatatggctagccagttatcccagcgccatttattaaataaggaaacctttctccattgcttttgttaactttgttgaagatcagatggttgtaagtgtgcagctttatttctgggttctctagtctgttccattggtttctgtgtctgtcttgtaccagtactatactggtttggttactgtagccttgtagtatagcttggagttggaaaatgtgtgcctccagctttgttctttttgtttaagtttgctttggctattcagtctcttttttgattccacatgtactttataatagttttttccagttctgtgaaatatggtagagtagttttataaactacctgtataaaacctgtagattattttgggcagtatggccacattaatgaaattgattcttccaatccatgagcatggaatgtttttccatctgtttgtgtcttctatgatttcttttagcagtgttttgtggttccccttgtagatatatttcatctccttggttagatgtattcctaagtattttatatacttctattttttcaggctattgtaaatgagatttccttcttgatttggctcgcaagttgaacattattggtgtacagaaatgctactgatttctatacattgatttaatgacctgaaactttactgaagttgtttctgagttctaggaggcttttggtggcgtctttgagttttttaggaatagaatcatattgtctgcaaagagagatagtttgatttcttcttttcctattaagatgcattttatttctttctcttgcctgattgctgtggctagcacttccagtactatgttgaataggagtagtaagagtgggcatctttgtcttgttccagttcgcaagggtaatgctttcagtttttgcccattcagtatgatattggctgtggttttatcatagatggctcttattatttagaggtatgttcttcagtgcctactttcttgaagttttttatcatgaagggatgttggattatagcaaaagctttttctacatctagtgagatgattctaaggctttttaaaaatcctatttatgtggtgaatcacatttgtatttgctcatgttggaccaaatttgcatgccagaatgaagcctacttgatcatagtaaattaaccttttgatgtgctgttgaatttggtttgctggtattatgttcaggatttttgcctctatgttcatcagggatattggcctgttgatttctttttttttattgtgtgtttgtcaggtttggtatcagggtgatgcacagaatgagtttgggaggagttgctcctcttcaattttttggaatagttcagtagaattgtaccagctcttctttgtacatcaggtagaattttgctatgacactgctacattttaattagtgattagtccactgacatttagtctgattactgatatgattgcatttagagctgcaagtttattatatgttttctgtttgctcctccacttcttgtttttctttttcttccctctgcaacttttggatcatttttttcttaatttaggattctattttatctttggattttcggtggtttttctaggaattaaaacgtatattcttgatctttcacagtctacttagatttaattttatactatctcatataaaattggaaaaccttgcaactgtataaatccatttgccactgcctccattctttatgctataaagtcatatggattacatctgtacatattacattataaacaccacaagacaatgttataatttttgctttaacaggtcctgtgtagttaaagatcttatcatgaaaaactagtcttttatatttacaatttccaaaattttttcattccttcttgaagacttaagattccatctggtgttatctcactttatagcctgaacaatctttcctttagcatttctgtggggcaggtctgctgataataaatgctcttagtttccttttatctgaaaatgtactaatttgcctttactcacaaaggatatttttgctacacatagaattccggattaacagtgttttgcttttttttttacccctcgtttgtactttaaaaacatcatttcactttttctggcctttataaattctgatgagaagtcatcgttcatttaaagcattgttccaccaaagataccgtgccatttttctctggctactatcaagattctctctttattgctggtcctcaccagttggaatatgatgtacctatgcacagttttcttcaaatgtatcccatttggggttcactgcatttcttgatctatgcatttatgtatttcaccaaatttgaaaatttgggcccattatttcttcaaatattttgttctgtttcattctctttctcttctccttctgagactccaattacatgtaagctagacattttaatttctgttacacaggtccctgagtctctgtttattttttttattcagtcattttaagtctttttttctgtctgttcttccaaaagaaaatttctatggatctatctttaagttcactaacactttcctttgtttcctccagttgctgtaagtatactcaatgagtttttatttcaaatactgtatttttcagtttcaggatttctatttggttctttttgcagtttctgtttactaccttcttattcattatgagtttattttcctattatttgtggagcatggttaaaatagccactttaaaatctttgttaattcccacatttggctcatcttggaattggtctcagataattgctttttgtcttcagaatgagtcacattttattgggtttccatatagcgtgtaatttggggttgtatgatatgcaagtattgatgttattgtatgaagagcttcaatcctgttatagttttctgaagggtattgatttatttgttttagcaggcaattagttatactcaaatttaaaactatcccctgggtagcagctcgaatctcagttcagttcttttatctttgtgataatttgtgtctgctccatcaagaatatacacatgacatatacctcagaattacatgacgtgatctcacttggaattttatcaagtgcatattcatctacaattcttacttcttcttaatataatgatttactatcatgaaatgttctccttcatctctggtaactctttttgtctgaaagtttagtttgtctcatattaataaattcaagggtcaaccagaaatttgggtagtgtttatatacagatttgggagcttcccctctctgcctctcttctttccaagattctgaattcattttcctgtggctatgattgccctgaaccctgttctttgggtcttcaaaccaaaaacactgtgagttttctattggaggatggccacccgaagtgacattaattttagcctgttctcactctaaaagttgtaaaatgggaaactcactctggaccgacctgtgcttccaagttttgaatttcagctcccctccagaatctgtctgcttaattttattctctaatgcttccaggtaatttcttttttcttttcttttttttttttttgtttttggtcttttggtactttatagttgatatctgtgagaatttcggatccagtagaacttacttagccatattggaaatggaaacaagtaaaaacatttaggaaacattcctttgcatttcctaacacctctcctcaaaatacttaacctccgtccattccctcatttagtgacatttgagtttggttttaagtagaaatagaagccaggctcagggcttccttgatcatcttgccaagtacatgagaagacttggaatgaaaacacagcataaagttaaatgatagaatgatagaacatcaatcaattctagctcttagactggtggcatttaatctcaaagcaatgaggcttatacagaatcatgactaccagtgattatctacatggtactttgccacgttattttaccttatttctttggtctcagatatctctaaatcctgcctcattgaaaactgcaatagataatatgccacgagaaacagaatactgaaaatcctaaaatgccaacccagagttggtaattgcacaattccttctaatcataatcattatggcttccacttcttgaaagcttctgtataccagccaccttgctaaccactttacattaattgtcagttaatccttcacaactattctttgagcagttcccataactagcttcattttacggaggaagtaaccagagttccgagaggttgagttcactaagagcacacagcaaacagtagaactctgagtcagtctttgtaaagagaagaaatagcaaaggggttttggagacatcaggcacatactctttactattaggagagaagatagaagtctttctaggagtaagtagggtttctaaaacttaaatagtctacagtcctttttgtcagtaattattgatattaaaatgccacccttccagaaacaatatattttatattgacagcttttatgtttaaaaagaaccttctagccgggagtgatggctcacacctgtaatccctgcactttgggtggctgaggtgggtggatcacttgaggtcaggggttcaagaccagcctggccaacacggtaaaaccccatctctactaaaaatacaaaaattaggtgggcctggtggcgggcacttgtaatcccagctacttgggaggctgaggcacaaaaattgcttaaacccaggaggtagaggttgcggttagctgagatcacaccattgtactccagcctgggcgacagcgagactccatttcaaaaaagaaagccctccttcagggcttaaaacactaacccaaacaataacaaaaggatcaaataattatatgtaaaggctcatatgaaaaggcacataacaccagtgctccattttacctcatttcatttactgcctttaaactttgttttccaggtaaaccatctaaacaggcaggtgacctgccagagaaaaatctggcacattaggaagtaaagatgcctgcctcatcccacaacaagatgcagcaatgtctcacagttctacaactctaggggcaatcctgcccaactttgcaaattttgcataaaccatgggtttcaagtgactttggaatgagagggaaagggaaggcagcacgaaggataagctggctgacattgtaaagtggatacaggaaactgggacttaaccggaagcaggaaaaggaatatagtatctttgtgttctggtacataggattattcaatatacatatttattatacatgttaaattgtctgagacccggaaatgagagatactgttaaaggagtaaagatgagatgaggtaacagaaaaggagaggagtaaatatgagtcctaaggaggggttacatgagcacagtcccctgacgacatgctagagattaccagattagtgcattgctcctactttcttgctattattattattattattatgggttttttttggcagggtctcactctgtcgcctaggctggagtgcaatggcatgatcttagctcactgcaacctccacctcccgggttcaagtgattctcctgcctcagcctcctgagtagctgggattacagacacctgctaccacatccggctaatttttgtatttttggtagagatgaggtttcaccatgttggccaggctggtctcaaactcctgacctcaagtgatccacctacctcggcctcccaaagtactgggattacaggccctttcctgctgtttttaaaaatacatattcaacatatccggtgaaatcattcaaagatgcatacagataagtgattattttactctaacgtaaagcctctttgtaagacctacccttcactgtctgtcccagcatatgccctaggacttcctctgaccatgaacagtaccatgccactgaaggagatctgtttcaacagagcctcctcctgctgctcctaactttatttccattccactagcttctcaaagtcatgcaaaacataacaacctgactttgtaactgtttaaccttactttttacacgtaaaaattattaaatatgtgtaactgctggggggaggataatataatggcatgtcagtcaggtaacaggtaagctacatttcatggaaaagaaggggaatgctttcttcagaaagtgaagtcatcattcttttatttaactgacataatatttataccccaatttttaaaatggcagctacaaatagaagtcgaaagagggtaaattctccaagggaatctagccctgaaattttaccattttaaaagttctattttacaagtacataggaacattactactattataaggatactcacagcaggtcaattatttcaaactctttgaaaaaaaaatcaaaattaagtaaacctacctttcagaagactgctacctcttcggagtcctcagtggcaggatgcacagagcttttatagagggtctaagcaggcaggtattcctaggatacctacaccaaggacaagaaattcagatgattatttcagcagtgatccagatggctctaggtacaatttcattaggaacgttcaccatgaatactgagcattgccacacaggtactgttaaaagcgcagaatgaaggtacatatgtgatttttgcaggcattgtcattaatctgtacattggagactgtggctcaaaagggtgtaagtggttcatacatgatcacacaagaaaaggggcagaaccatgccttaattattcatttctgattcctagtccagggttgtttcagccacatcatctgatcctcctcaagaactggaaagtcctggcactggggctttccattttgcaaaaagatgaggctgacccgtgagtctggtgggaagagtctttctctggttttctggtggtctatgccaagtcacctgtctgaagtgtcctgtgtggccagtttactcactttcccttgaaactctggtgtccacagaatctgaaggaatctgacaagcaaagaaacatgggtttttttggtcccactggcctgagtttgaatcctagtaatgtgtttactacttctgtgtcctatgtagctgctcaacatcactgaggctcactttctatctctatcaaacgggtataataatatttgaagggtacatttatgaagaggattttttttttctaaatgagaataaagtatcaagtacagtttctggcacatgttagatgctagggcaaagtgaaagccccatgacccaccttacttgcagggataaccccaaagtggacaagtgacagggaggctattgagaccttgctgctcataaatcactcaatgacaatgcactaatcccctaactggctggttcctcactgctctgacctctacctctgggtttccttcatgtacacttctttgaaataaaaatatcataaacaccaattcattccctaggatctcatttagaggtaatcgtttccttttttaatctaataatcttggtctacatcatgttacatggtcagctcaatgtagtaattgaaagcagatgatcattcatttaacaagtatttattgagactctactaaggtgtcaggcactattctctatagcagtggacataatagtccaagatcaggccatcatgctgcctaccttctggtagaggagacaaacaaacaaaatacatatgtaaaatacatgagtggttaaatagttctaaggactctggagaaacacaaagtaggaagggagatggtgagtactatgggttgaattctgttcccccaacccctccccatcaggaaaaaagatatgttgaagtcctaaccctcagtacttagaatgtgaccttatttggtaataggattgatacagatataattatttaagttaagatgaagtcatactggagatcggtgggcaggcctctcatccaatatgattggatataagaggatgaccacgtgaagacacagagacacaggggagaaggaacgccatgtgagaataaaggcagagattggagttacatagctgcaagccaaggattgccagcaaatcactagaagttaggaaaaggcaaagaaagattcccctgcagatttcagagggagcatggccctggtgacactttgatttcagacttgtagcctccagaactatgagacaataaatttcggttgttttaagccactcagtatatggtacttagttactgccaccctaggaaatcaatacagtgtgtttggggagattgttgcatttttgagcaaggagatcaggaaagatctcactgaaaaggtaatgtctcagggaagatttgaggtgcaggggacaaccatgatgatggctctggatgaagaaattctaggcagagggaacagaaagtacaaacctcccaggcaggtgcatgtttgtatgttagaacagcagggaggccagtatggctggaatagccaggggagagtggcaggaaaccaggtcagagtgatgacaaggagctggagggtgctagaccttatgggccactctaagaacttaggcttttacttggagcaaggtgggaagccattgcctacttctgagcagaggtgaaccaagatctgacttacattttaataagctctctctggctattcggtaagaataaactgaagaacaaggccacttaggaggctcctgcagttatcctggtgaataaaggtgctagccaggtagcacacaggagagtgaaaactggtcagtcctatgcgaaatattttgaaagcagatccaaaaggatttgcaatagattgcaggtagagatacgcctgacttcttgatagtacatagaattaaattagaaaccgtaacaacttaactgtactgatcatctgaataaattatcttctcaaatgccagaccagccaaagatattagcaacaggtttaacagacagggaataagtaaccagaatatataaggaactcctaaaatcaacaaaaagaaaaaggtaaacaaataaatattttttaaaatcatgattcaaagaaggaacaatggaccatggacataagaaaagcagctcaacctcactgatatggtttggctgtgtccccacccaagtctcaccttgaattgtaactcccacaattcccatgtgtcatgggaggaacctggtgggaggtaattgaatcatgggggtgggtctctcccatgctgttctcatgagagtgaataagtctcgagagatctgatggtttaaaacatgggagtctctctgcacaagctctctatttgtctgctgccatccctgtaagatgtgacttgctcctccttgccttccaccatgattgtgaggccaccccagctacacggaactgtaagtccattaaacttctttctgttgtaaattgcccaatctccagtatgtctttatcagcagcatgaaaactgactaatactctcactaaacatgaggaaaatgcaaatgaaaataatgggattctactttatttctatcagactagttaacatgaaaaagactgacacaattcagtgttgtccaagatatgagaaaaaatagcatattattctagtttacttccagcggaatcatgaattggtatattattctattgagcaattttactgtattatcaaaagtgacagtacacatatgccacggcatagtaactcttcttggggggtataccagggctaagaaacatacacataaggggacatatattaaatcagtataacaaaacttggaaatgacctaaaagtcacccttaaaggcaaatcagtaaataaaatatgctatatttatatgattaaaggacatatggctgttaaaaagaatagattggttttataggcatcagtgtggatgtttcataaatgtcatgggcagaaaagcaacacaaaggaaaatgttaacatacaaacacaatagtatgtattcattgtaggtcggggtccccaaccgccaggcggcagaccagtaccagtctgtggcctgttagggaccaggccacacagcaggaggtgagtggtgggcaagcgagcattaccgcctgagctccacctcctgtcagatcagcggggacattaggttctcataggagcaggaaccctagtgtgaactgtgcatgcgagggatctaggctgcctgctccttatgatgagaccctaacgcctgatgatctgaggtggaacagtttcatcccaaaaccataccccccacctccccatccatggaaaaattatcttccacaaaaccagtccctggtgccaaaaagttggggactgctgctgtggatacacatatatgtatgtaaaagtataaacaacggactagtcaaatacatcccaaatttatggtagggaattttaggcaggggtacaggcagcaaagaaagtggagggtggagggaaggacaggacattattggtgaaaatgatttggttttatcaataacttctttaaaaaggaaaaaaacaacactggaagcaaatctgaccaaacaaaaacagatactcgttttgggatagtgagagtacagatgatcattacactagtttttgtgctcatctgtgcttttttgttttctgcgagtaaagaaaggaggaaagggagggagggatgaatggatggaaggaaggaaggaaggaaggaaggaaggaaggaaggaaggaaggaaggaaagaaggaaggaagggagttaccagttctggactgcacttaagctaatcgctaatcatagatggggatagatgaggttagtttttttgttttgttttgttttgttttgttttgttttgagatggactttcacacttgttgcccaggctgaagtgcaatggcacaatctcggctcactgcaatctctgcctcccaggttcaagcgattctcctgcctcagcctcccaagtagctgggattataggcacgcgccactacgcctggctaattttgtatttttagtagagacggggtttctccatgttggtcaggctggtcgaggttagttttttaaggatgaaactcaaaactatgttttaataatcagcgtgaccattggtgattcctagcagactgtctcagcgtggagggctgaatttcagttcagcccgcagagggaaccatctgtcatttggaatgacaaggagctctctgccaggggaacaccagaacaccggaagcagccatggtcttcactgcatccccactggccctggaaccaccaacactacaggacacaggaacacacaaagtaaaccaagggtacaccatggacatcttttcaacctttttaaaagcacattgcaattttctagaatcaagggaacaatatgcttgattagttcttcagcagatttggcaattttgcttgtcatatttctctctttaaagcaagttggtcattaaccttccatgttctaggacttgagattaggttttccccccacaaaatgaaaactttgcttaaaaaaaaaagagtttgctttaggataattcatttttgctgctaataactgcaagatcctctttgagccaaggaggtcattcttgaaaggggctagaattgtgaagaatgttccttctcttcctggagagagagtctgtgaaggcaaaaaagtttgcaggaaagttcagtaatcatgaagtgaaagcccaaagtgacctgaatacttcctcctgggtcaatattgtatgtttaaaaagaaacaaccaaaccttcaaagaaaaatctggccatccccaaatcccaatacatgaaactagaaggcaggaggcaccagtagaatgctggctttgctctcattgcttggcctccatcacagttacaatagttgcatatcatccttttgtacgtgtcatcctaaaaatgggatttggattggtttctaacaataaaacgagcaaggtagaaaaggaatattatgaataagttaccaatgtaaatatgctattttgcgcctttgaatttgagtgttgataaacatgattccacacatggaaattagacttttcagagctactacactgaatcatttaatttgtctgagtaagtacttataataatgtggctgctctgcactgcaataaacatcgggttttcaaatgaacaaatgaagtatgtgatactccttataaatggaactgcagcaaagggcgttcagctagggagctgtgcactaaaatgggatgggtgataagaacatctctctccagctccactgatagtgaaaggaaagaatcatatggcctctgctgctacattttctgttcctggacagaagcaaggctgaagcctcactgtgaaatgatgggggactgttgctattttgggttgtcacagggtaacttgtcacactactcaggacacatgaggacagataattctgttcctccagattgtggacttgagaatgctttagtaaaatagcacagggatatattttggatagtggttaaggacatgggtttgaatcctgggctctaccaaccaaataggtgcatgattgtacccaagtaatcatcagtcttctccatgctcattttcctatttggtaaaataaggataataactttggcttcctcattaagttattagggggattcagtgagataatttatgtaaagaacctggcacatgattagaattcaccttttttaacattatcattttaacattatcatcacatttttaacattatcattcaccttttttaacattaacataaccattttaacattatcattatatatgtcatcattattattatatttaaccttactttcattttaatccattattcaattttccttcaacgctcattaaaagcacaactcactacattgtttagtaattaattacttttgttcatttaacaaagtatttatactttgttatatgtgccaggcacatatgctaggggctagggtacataggtgatctaatcctcctggaagctattagaggagatgggcatgagtcaaaggctcccataggaagtgaaacctttgaaactcagggaacaggtctaaaagaaaggagcaggctaggcatggtggctcatgcctgtaatcccagcacgttgggaggtgaggtgagttgatcacctgaggtcaggagtttgagaccagcctgaccaacatggcaaaaacccatctctactaaaaatacaaaaattagccaggcatggtggcgggtgcctgtaatcccagccacttgggagactgaggcaggagattcagttcaacccgggaggcagaggttgcagtgagccgagatggtgccactgaactccagcctgggcaacaaaagtgaaatgctgtctcaaaacaaacaaataaacaaacaaaaacaaaggagcagatcactctaagagatactaaaacaaaggaacttaaattaaacctgagacctgaaggatgagaaggagaacaagggatggaatgatggctttcttgagagaaacacaacaatattcaaaggcatggagtatacagcactttatcattgttatcaaaagtcattgcaaaatgatctactgaatagctcaattaaatctaacaactatgtgacaagcacctactatgagccaagcgcagtgccaaactctagaaacaccatagtaaagacagatatgatccatgcctgcatccttacctcccaacacctactactatgtttgaaaaccacaccaaagtcaatatttactttgtaaccaataaattacccctctgggtttgatcacagagagatttcacctgcatggaaaaactggaatgctttctctggtcagacaaggaatgttacatatgccaaataattccctttcttcttagttgctggatatctacaaccaaatttagtttattccatgggcctaccaacttatactactaaagatggccatgtttctctttcatgattaattgttctattatttgtagactacctttaatttagtaaacagcctcagcctcaaattatttggaaagttattagaagaggagaaaaaagtaaaagaaaacaaggaaaagagatctcaagtttcttgagatctgggaattgtccaatgtgctttctgtagtattcgtggtacctaacatggtgctggatggaaagcatttaataacttctgattgtcagatggatgaagaatataaagctttcctggttcaacttgggctccattagaaggagggaagaactgaaactcggtagatcagaatatgcctccccacaacatccttctttagcataaggattattttgagctgattattttgagagactgcagctacaggagaagatctgaaaacagaagagaagttacctttttgtaaaaggattttacatctataaaggaaatttctactcataagggtgtctccctttctataccaggaagagaaggatgaccaaatcactagagactcttaccaatggagaagacaccaacttaaatctgcataacaaaccttactcatgtttaccatacttttcctgggcatccctccacaactgactatcccccatacccttcttttttttctttcagtggacaatggtatttgagcctgatctcaaagccacctctttgagatttattcatatctctgggtatcttccacgtgtacatgagatacacatatttttaacttctgtttgtttttctcttgtttctgggtctatcccaacctaaggaccataaagggtaaagagaaaattatttttccttccctacacttacttttctctagtctccaggttcagaggaaagaactcaaaaaagtggctgaaaagtttagcatgattttcattgtaaagcagcccaataaccaaacagaagcaccacataaaccaaaagaagagagtggtaagtgaaatataaggtaccattagagatttctctcagggaataagattcttgtaacaaaatatttacctttcttattctggtgctagtaaaaataagagaaatgtcacaattttaattaatgtctaagcaacagggaaaaatattaagctactttatgacaaaatggaaatatatttgtaattctatatcctaatgttctctcagttattttggaaaaactattagtcctttggtctcttctacattaggagagcaaaaagctataatatggcctatctggctaactatcgggaatcggagaaatcaatttaaaagaaatttggaagacacctacattatcgatattagagcaaagtagagatctgccttgttcacagcaaagcaatccaattcacacacacacacacaaaacaaatgttgcatttatggaagtattaaaacatctcatccttgtccttagcttaacatattaatgagaatttctgaattaatctccaatcgtgaactgtgtctaggtgtgatataagggcagtaaatactgtgcagcttgcttcaggcatgttttatgacagattctctgacagatagaaaatctttaagattaaattatttctgtattttcctaagaaactcatcagtactaacaagcataccacttccccaactagttgataaacagaaaagaaaatattattaagtgatggcacttgaggaaatagttaaaaggagaaactcagaacataagattgtgattatatataatgaggagattctcaaaatggcacagaaaggaaaggaacgagttgaagctgaaaaacgtatgtttttaggaggtaagttattccataaagcaattactaaaatgtgagagttcttctcatggttctcaaccttatactctgaaagagaacttcttataatgcaagactaagagagccaattacttcagcaccaaggtacatcctaaatctctggacttggcagttcaaaaaaactcttggaaaatgttcttctaaaatcttcactaacagccctgactttagaaatgtagactctaaaaggatgaataaaaactaaccaattagatagcaaaatggagaagagagagcactgaataaaaagacctgccagagttcgggttgtacctctgccaccagcctcagacttagttcatatttacaataaaaccataatcataaaaattaataattatggaacacttagtatgccaagaacttttcatatattatctaatttaatcatcctaacaacctatgagggagacaccacataagagaaaagcagttgaagagtttgtccaagaccacccagctgctctgagtgatgggttaggattcaaacacgatttttttggaccccagagcccaacccttaaccactcactctgcagaatagttcagaaacctcctaggatgatctaaaaggcttctttcaacaatagggcgctaagatttatgagacatgattgtataatggaaaaaaatctcaggtttttgaagtgactttgtagcccagttgagcagcttcttctctaagcctcagaatcttagataacaacactacttaccttacaagctggcctaaggatcagagataatactagagcccttagccccaagtaataataataataataggcagcatttatataatgctcattatgtgctgggcaccatctaaacatttttttccccacattaaagtatgcaatcttcacaatgaccttaaaagtactattattttgtactttttatctaattgtataagaatacaattagataaaaagaaaaaaaaagagttctattgttttgattcctgttttaccaatgaggaaacagaggcaaagagagttaaattacttgacctaaatcacagttactaagttgcagatcttggattctgatccagacagaatgactcactggacaacccaaaacatattggaggcactcctactgatacataaagaacctccttgccatgcccaatgtctgtgtcactctcacccaaagtaacaaatttaacataaacttgggaggatgaaatacatagggatgcccagataacctgcctactgtcattccgcagattgtgcctttaaaaaaaccaatttcaatagaaaccagcaagaaagagatacatcaggtatgtcagacatacgtggtcacaactattttttctccttcctggctaatcactccctttgtgttgataatgtgctgctttaaatcaattcataaaaaaaaaaaaaagcacagaggcaccataaaagtcgtttttcctgttttcaatctggaagaaattcagtctcttattcattttaaaaactattttaataatagcttttacttaacccaatatatcaaaaatattatttcaacatgttaataaaagttaataagagattttacgctaagcattcaaaattcagagtttactttacatttaaggcccatctcaaatcagactaacctgattagtctgaatgctcagtagccatatatgttgctagtggctaccatattagacaacacagttctagaaagattggcttagaaaagccctggttgttgatatttataggtctctttccttgggctggtcaaattccccagaaagatatctttcaatctcctgccttaggggtataagcctgggtgccattgttctgagatttaagtatgggaaagagcagaagccccatcatattgtctttcacttaagccccgattttcatcattatacccatcctcagctatgcatggtgactccaatcacgagccctgtagttggtccaacccctccagtcttcctcctggggaagtagggagggaggcagttgggagaggcagttcccaggctatgcgggttgggcaagaactctggggactggttagcagttatttgtcattctttcaatgttcttttaatattccttcattcccactttcatacatttacagtgccatgaattcctgacacgttctagaatctcagtttagattttaccgtttctctccccttttaaatcagtccctggccttttaaggcagcttctacaattgtattctgtgaccttctcctctatgatttttgttcatattcccctccccttttttaactaacattttttatttgaaataattgtagactcacatgaaggttgtaagaaaaaatacagagaaggtccatatgccctttatccaattcccttcaatggtaacatcttggaaagctattacacagtaacacaaccaagatattgacaatgacacattcaaaacacagaatgtgtccatcccagggatcctcttgttgctctttaatagccacacccacttccctcccactccaccccttcttaacttttaaccacaaatctgtactccatttatataattttttcatttgaaaaatgttatacaagtggagtcgtacagtgtgtaatcttttggttttgtgtttttttcccctttaatctattccctgaagattcagtcaagtagtttcatgtattaataattcattgctgagtagtattcgatggtatggatggaccacagtttgcttaaccattcacccaataaaggacatctgagttgtgtccagtttggggctattacagataaagctctatgaaaattcatgtatgggctttggtgtgaacataagcttttgtttacttgggataaatgcccaggagtatgataagtgcatgtttaattttgtaagaaactgccaaaccattttctagagtggctataacattttacattctcaccagtaacacaatttctctgcatcctcaccagaatttgttgttatcattatcttttattttagttatttcaatatgttcatagtgataactcattgtggttttgatttgcatttccctgatggttaataatgttgaacatcttttcatgtgcttatttgccatctgcataacctcttcagtaaaatgtctggccatgtattttctaattgagttgcttggatttttttactgttgagtttgaaaattctttatatattctaaatactagtcctttgtcagatatgtagtttgcaaatattttcttccagcctgtagttattcttttcattctcttaaaagggtcttaggccgggcgtggtggctcacacctgtaataccagcatttgggaggccgaggagggtggatcttttgaggtcaggagtttgagacctggccaacacggcaaaagccagtctcaactaaaaagaaaaaaaaaatacaaaacttagccagccacagtggcatgcacctgtagtcccagctattccagagcctcaggcaggagaattgcttgaacctgggaggcagaagttgcagtgagccgagatcgtgccactgccctccagcttggggaactgagtgagacactgtctcaaaaaagaaaagaaaagaaaaaaaaaaaaaaaaaaactctttcacggtgcaaaagcaaaagttttaattctgatatagtccaatatatcaccaatatatcatttgtttcctgttatggattgtgtttatgtgaaatctaagaactctttccctagccagagattccaaagatttttctctaatgccttctccttctaaaagaagggttctttattctgttccgttgatctatgtttctgtcactccatggatagccacatagtaactatgcaatacttcttgaaactgggtagactgattgctcccactttattatttctttttcaaaattgttttagctactctagttcctttgtttctgtataaattttagaataatgtcatctatatatgaaaaaaatcatactgagatttttgataggaactgctttaaacctgtatatcaatttgggaagtatcggtatctttactacgctgtgactttcaaatcatgaacacaacatttttctccatttatttacatttttaaaatttatttcatcaacattatatagttttcaacaaacaagttttataaatgttttattggattcacataagtatttcatatttttgagctaaggcaaattgtactatatttttaaaatttgtgtccacagattcattgctagtataaagaaatacaattgataatttaaatgtctatctcatatcctgccaccttaatgaactcaattattagtttttcatttgtttgcttgagatagggtctcactctgccacccaggttggagtgcagtggcacacaggtattggcacaaacacaaccttctatagcctcaacctcctgagctccagccatcctcctgcctcagcctcctaagtagctgggatgacaggcatacaccaccaggcctggttcatttgttgttgttgaggagagatgaggtctctccatatttcccaggctggtcttgaactaggctccagcaatccacctgcctcggcctcccatcgtgttgggatgacagtcatcagtcactacacccagccacttactagttttaagagttggttttgtgttttttcgtctttgtagatcacttagtgttttctgtgtagaaaatcatgacatcagcaaatattaacagttttctttctttccatctgtatgcctttcatttccctttcttgccttattgcactgattagaacttcctgcactatgttgaataggagtggtggaaccagccttgcactgctggactagactccatttcgtcgtggtatattattcttttagcctgaatcctgtttgttaatattttgttcaggattgttgtgtctctatttatgacagttattggtatatatttctcttttttgcactgttttttctgtttttcatatctgagtaataccagcttcctaaaatgaattgcgaagtgttctctcctattttctggaagagactgtataaaactcctattaattattctttaaatgtttggtaaaattctccagtgaggccatctgggcctaaatatttattttcagggagtttttaaatgattaattcaatttttaatagttatgggcttttaaatattatctatttcatgataggtgaatggtaggaatttgtgtttttgaggaagtggcccatttcatctaagttatcaaatttatgtgtgtagagttgttcatggcatttctttattatccttttgatgtctacagggtcaatagtgatatctcctctttcattcctgatattgtaaccaaatgcaggtccagatgcccactgtttacagagtccagttaacaagagtgaggtctagtagaaagaaagtcattttactaaaaccagtaaaggggaaatggtcagattcccgcccaaagcaatcactttgattttgggggaaggcaggggtttaaaaagggaaaacttgataaggaaggcatgcaagaattgtactaagtataatatctgtgtgtcttgttctggtagctatcttgggtctcagtctacctggatggtgagtcaagacatctgggaatatctttacttcccctttattcctgaggatattttcacgggctgtaggacactgctttgattgttgattattatttcattcaggactttgaatgctttaagttcctgagcagccatggccaggtttttaactagccactttgaagtaatctctggaattttgcagctgggtctccaagcttattccgcctgtctcaagattagcccctggaacttctaagaaggcacagtaattagatactagtatatacttagacaaatgtgaagggagtatatatggtgaaaaagggagggacgtggagcctatttctaggctgaggaaaaggcttctgcagtttttcaaggttgtatcttgaaaaccaagagaagagaaaaaaatgttttaaaatgcatttggaagttaagttgcctagttacaatattggtaattggtgtcttttctcttttctttgtcagtcttgctagactgtcagttttattaaccttttcaaagaaccagctactcttgttttcctttgattaaagtttgcatgatacatcttttcccattattttactttcgtctattgttatattgaaagtgagcttctcatagacagaatatagttgggtcatattttttaaacaattctgctaatctcttccctgtattataagtggtatatttagaccatttaactttaatgtaattattgatattttagaatttacactgccattttattttttgtttattttctgtttgttctctttgtggttttctgttttctttgcccagacttcttataagctatttgaacactttttggaattctgttttgatttatctaaagtgtctttcagtgcatttctgtatataattttttaaaggtttctctaggtattactttatatatttataactaaacagtttactggtgtcatcattttaccagtttgagtaacatatagaaaccctatctccgcactttgcatccctttatcttccccatttataatataattattttaaatacttcctttacatgcatttacatccacatcagaatattgcaatttttgcttcaaacttcaaacacaattagagctctcaagagtacaaatgtttttgctatgtttttttcttcctttctgatgttgaagagatccatttttaattgtcttctttccaattagataactcttttcttttctttcgaggcagagtctcaccgtgtcatccaggctggagagtgcagtgatgcaattatgcaaattcttttagttttccggctgggcgtggtggctcacgcctgtaatcccagcactttgggaagccgaggcaggcggattgcctgagctcaggagttcgcgacgaacctgggcaacacggtgaaacccgtctctactaaaatacaaaaaattagccgggcgtggtggtgggcgcctgtagtcccagcgactcaggaggctgaggcaggagaatcgcttgaacccgggaggcagagcttgcagtgagtcgagatcgcgccaccgcactccagcctgggcgacagagcaagactccgtctcaaaaacaaaaacaaaaacaaacaaacaaacaaacaaaaaacacaaattctcttagttttccttcatctgataatatttttacttcccctttattcctgaggatattttcacaggcaataggatactggcttgactgttgattgttatctgcattcaggactttgaaagctttaagttcctgagtctcagcagaaactcaaaaataatacatgtaggaagagctaaaaaaatatacaataaaccggatcctatcgaatttaaatgtcaccaggctacaagaaactgattctggcagaaaaaataaacatgtgaaaaataattacaataatgtgtgataagtgcaaaaatgcaggtatgtacttgtcacgatgctgacacacagagagaatcagcactgcttgagagaatcagtgaaaacttctcagagatgtgtgaaccaggttctgaaagttaggtagtaaaaggacttcctgggtgaaggggaacccagcacgaaagccctgagaaaagcggaaaagatggtacatttgagaatctgtgagactgaatgcctggctgaggtatagaacacccattggaacaagcaagagatgcagtagaaaagacagctaagggaaggatgctgggctagagggcctcatcctctactaaggagtaaactttatcctgtgtaccacgaggagctaccgaacagacgaaaatggtgagtgtaatatttaaagcaatgattgctactataacactctttttaaagtagcttttccatgaattattaacattatctttagtctaatacgtatcaaaatttagtttatggactggtaggatgtgttaatggccaataaaagtaaaagactcagccgattccctgccttctacactccattttacacacactccatcctgcctgccgaatgacttcagtgtctctgtgaccagtgagtgaagcagcatgcaatgagatcatggctagatggcagcacattcagtgaagtgcttcagctttcctgttgcttctgattccctggcatttgtcagtgtctgtcaaaacattaacatttcttaatgtatattttgcattatttactaaatgaaaattttccaatgacagtggctgagaaaaaaaaatcagatttacatacagtatgtcaagttcacattcgatgccccagaaatgcccagtccccaaagacctctagggactgcagctcatttgttgtccctctccctctcccgtttattatgctgaccctctgcccagccacatagctcaccccacccccttagaagcatctagagttggctctagacatgaaatggaatagatttctgcatttacataactgctatcgcacttctggtgaaaagtagtttcagaaaaacacagaaaaaaataaacagaagaataaaaagtgtctatgtgataacataagggcttatttaactacgtctttatttcctttacagtccaactattttttttttaaaactgcatgccaccttcatgctgcctctcggaggggacttgatcttatttagacccggtggcgagggtccttcagctccgtgaggagctctctagcactcagtcctctttagaggaaagatatcttcagagcctaaaggccttgaaagaaatgacacatttttaaaaacagaaaaacaagcatgaaagtggcccatcagaaatgaaggtgtgaactagaatacaatagacagcgaggaaggagccaaaaatcctcacccaggcaggccaggatatatgcagatagggaggaaattgggaggcattcctttgctaataaagatgatttttcttctaattttcacatctttcatgatgtatcttttgttttttgttttctctctatgactgctgttctaaaataagtgggctttaagaatatgaactacagtccgcatgtttgccagccccatattctgcgatgaacttgacatgtgaatgaatcaattctgcagaggtgaaaagttattcctacaaagtccccagttttccttgtgagaaagatccctacttacctgtaaacttgttaattaaatgtcaaaggtttttatatcaaggacaataacacaagccaacctgggaatctgcttgtctgaaataggtaaagagtgtctgtgtttatttagaattgattgtacactttccttcattctctacatagattttattttctccccacattcttctttttctgtattgccttgagggctttctcttataattatgtgacaaattatatctgaattatgttcaaataagcaaggagactgaggttttctgttaaaaacatatggcctatcagtaatgaatgaagttttgcccatatcatgacatgactttattgaaggcaccatctcatatatgcagttttcaatgtggtgtctaacagatttgtgtaaaatgtctaaaattaagcaaatgcaattatatgagttagtatcatcttatcatgtacattttgcttgataatagaaaagcaaatgaaaagtttattagcttattacaacagtctgtttttgatttttactttagactctattcctctttattttctcctcttctgtttcgggtcattattttatctggagaacccaaaatccaattcttcatctgtatttaccacatagatctttagattctcttaccaatccaacagatttctgaatatttaactaccctattgtaagttgtcttgtttagaagaaatggaatctaagattgtggcagtaaaggacaagctgtcaatgtgttaaataaattcctgttgaaaagtaacggcatgcactgtgtgttaacataatttattagaacaattagaacccatccttgttgtcttttaattagattattccctgttctggtaattacactagacaagggagaataatagtcttgggattctaaaatcatctgtagactatgtggaaagagaataaataatcaataatgctaatgtaccggaaaacttaaattcccagaaagagatcttttatcatgagcaatcctttgtataaacagcattatttctcaatgtctatgcttatcttgcccaaagttgaaaagtgaagacactggacaaataacagatatttattttactgtcagaaacctggttgggctgggccacctctggcctctagtggctcagacattgcttcagtcccttgcaaaatgccaacaagaaaccgcaaatgaaggatttaaaattccatgcagagcagcatatctagcagtctgaatgcctaagggaaaggatgcagggcttttaagttctggtcctaggtgaggaatcataaagttcctcaatttaaaaaaatatatacaaatggacaaaaatgtcttagaactgagaaggctactaaatattaaaaaaaaatttctgatatttccatacatgaagatgttatttgcagaaattaataggcaggctgtatgtcaggaaagtttctggctctcagggatgggctgaggcctttagatgtgaatcgaactacatctctggttttatgtttggaagaccacagggaattccagtgctccaaggacgctccgagggcctacacaactgtcatcaagcatgttaggacatcctagagagtagttcccaaaacttctaggcttcagaatcttgacaaagtcatgggtgggcatatcctgccctcacggataaccctacagttgagtagaaggatgctggaatgcacagaattgacaccagtgaatctggagttctctgtagtaatgagcaacacaaatatctcaccaacagtcccactgttatccgagtctgccttagtcaatgtaaactcctaatgagaccatgtctagacagtattgatctcccaccagaaaaaaaaaaagaactcagagtgtgacttcttttctagcttagcccaaatgacaccctaaaacatgctctttcattcactcattgctaacacttttcataacctgagatattttatcaactaggcagccaaggacccataggcttcttcgcaaggtatatgtgatattttttatatttaaaacatctttgatattcaaatagcagataagaaagttacttaagcttattaaagaacctagagaaattaaatgagtgtatatatatatatatatatatatatatatatatattttttttttttttttttttttttttttcccttgctaggcaaaggagacaggcctttaaaaaatgaaagtccacataagattaaggtgtgatcattcaagttaatgtgggcaagatatctaaaggagaaatcattagcttaagctatccaaaggattttacacacagtcctgtggtttaggagcagaggatcacccgtactactgtgctatccatcccagctgggaagacatggttctttatagaagtaccccttaaaattgtcaggggtgctattaagtacttagggttccccactattcttatctccagactggtcaaatctaccaggcatctttctgatatatcagatagatacaatctatcatagatataccaaagatttatttgcatctgagtgtcctgtggtgaggcattccacagcaggctgtgcatcaggtctgtctgcagaaagtaagaaagaaaggaatacagtttaaaattcacgtaggaatggagtttaaaaactccccaggcaatgtgaaggtgagttaggactgggaaccacaagctaaaaaggagaaccacagagaattctttctgactttggggctgaaatgaagctgaccgaggcattcaggtggttccagaggctggaaagtctcatacgacaggtttttttctcacaaaagagaagtgaaataagtaccttattatgttccaacaatatcaagatacaaatctatcttttagaaaaatgctaaataaaaacacagtcagagagagacttccaccactataaatagtttcttataaatgccacctagagacaaaattatcatttctatgatcctaaccaaaagagccttgcatgtcttggaaatactttgccctctaaagcaaccagaagaacattccttcagtctatgtgttcttgtgctggattttgaaacttttgagcatttgctcccaaagtgaaatttaaaaggctaacagcagggacacctggataactagaaaacttacctattgatatcacaggctgcttctccaaatggactgtatataatttcttgcaagcatagtaaaaatcctatacttgcttgaaatgaaatgaaggaaagcctatcatgaatttctttttctctgtgttaatgaaagacacgagcacaccatgataagcaggagagaatgacctagtgttcatccttctcttcttgtccaacgcaggtaactataggtgggctctgggtagagtatatgattgctgcatatttctaagaaataaagttaatttacaggctacctcaatcctgacactctaggggtaaggcaagcatgcatgtatgtatttctggtaatcaagagggagaaatagcagtgaaaaatagagcttggatatatatcttaaagacatgccactgatttcaaaatagggcaagagcacttatgatttaatataattttgttggaaaaagttaactctctccaaggaaatacagagcttagcaaataccttataaataatacaaaggcatactatagtgtttagtagaatcttattcacccattctgatttggacaaatgttaaatgagacaaacaggagaaaagtttattgattaggtaaccgattaaaattttggtgaaaagcagaagtagtaagttccagaaacaagaaataaatcatgtatatcaacaagaggaatgaaggcattttgtgcaatcctggggaatagattttcttaggtatttcataaaatcattgactctagggcaggaaaaaaccctacacacataaacccacagcattctttttcctgcctccacagttgtaaaggcccgatgataaaacctgtttcctaagacttccccagaatgtgattcaacacattttctatttttttaaaaaaaaatttctgccacttaatttcatgtgataattttccccaatgactaaccaaatatgcttcactattatataaatcaattctttcttaatgccacaagtgaaagtgcaaaggtagctaatggttttcttctcataaaaatcacactttggctttttcctttcatatgtaattaatcatatttgtgacaatcttccaaacttacttgaaatttttctgaatccctttcaaatcaggacaagaactagaaatgtctatacaggtttaatatgaagtaaagaaaatgtttttcattttcttgatttatttctgaattcagcttgctcttcattagcgctacatagctgmcttattattcgtggtcccctatgaccccctgatcattttccctgagggtgcatatttattcactaactatgttacaatcatgtgatctgctggattttttctgatagtctactctagatttgttctaaattaataaatcccattatttttggcttctactacttctatttattaaattcattctgaatatgaagtttattttcaaaggaattcataattctttactccrrgcttggttctaacaatgaatttaataagaattgtatttaatcaatgtttaaatatattaagggcaaattttgtaaaaatgttagtgttccaagctttccatttccccacaaattaatttttttagcctttccccttaatccactttcttaaaaaataaaattttttttgtgatgcagaattatgtgaacaataagaaaaaaataattagaaaggtaggagtaaactaaaaacaaacaaacaaacaaaaaaaaaaaccaaaaaactaaggctgcagacttaatagaactaccatagctacttaagggtaaatgattaagagagagacaacgtctggcttctgagcagagcacagagagaaagatcaccaggaagaaaaaagataacagggaattttaaggacagttgccatgtgtaatgcataaaatagttttcaaaattcttggagaggtaaaaataaaatttagatttattttttaattatttcacttgcgatgctatcttaagattgaaccacatggggccccagaatttatttaggttatacaaatatcctccaattctgatgctgattatttcatatgcagacttcagttacctttacatgtcataaacacacataccccagaaataaacttgatcatcccataaattttcaagagctctcagcctgctgtaaatgaaatttcaccattaactcacaggtcgatgtctgggacaacctcaaagactgcttgagtaattaataaatttatatgaaaacattggagtgaaaatgtctgtcagtgtcaaatacataagaggtaatggctgatacatagtaatgcagttttaaaccattggcaacatatctaaacaaaggtatcagagaaaaataaaagaaaaccttgtaacttgtatgataagcctcttgcataagattattaagaaagtcataagcacttacggctttattccttttctatatagatagattgcccagaaaaacgtggactgaacctcagctggaatctgagggctctgcttgtctttaacagcttagctacattgttagagagcaacactacataatacagcatgccctattcttaaggcaatacataaaattttaaaacctgaagctaaattaaaaggttatcacccttctgcctaatgtattatatatttgtaaatgatatctgtctctaaaaaagatgtaccacaaagcaagagcatatgtgaaacaataagagagaatgtaggagttagaaacacatttaggtatgtaggaaacacaaacttcaagacattcccaaggatctaaataacctatacacaaatatagcaaagtcatatcctaagggagaggatttgagttctaaagccggagcctaaggtaaatgttgcatatagtcaaacttaccattgaagatcactttaatcacctgtagggtgcaagttacattgctttgtgtattcaagactgacagtgaatatttgagaaaatcagttgagttagaataaagaaggaagcaaagaaaagtccacctacagatattagggtattcaaacaacctcttctttaagaaactagcaaatctccacctctgagtttttatcaggtaggtgatgaagtgcaaagctgtaaaccctccaacagggcttattccactgttttaatattcacatttcataacttggacatatgcattaatggatgtatttgtcattgttaagattaagtaacataatctttctttttttttttctttgagatggagtcttgctctgtcgcccagcctggagtgcagtggcatgatctcagctcactgcaacctccgcctcccaggttcaagcaattctcctgcctcaggctcccgagtagctgggattacaggtatgcaccacaaagcccagctaatttttgtatttttagtagaaacaaggtttcaccatattggccaggctggtcttgaactcctgacctcaggtgatccacccaccttggcctcccaaagtgccaggattaaaggcatgagccaatgagcctggctgataaccttatttcataagcaaaagcatcatccacagggtctggtccagagcagatactcaatagggtgctacattttaatctaactcttgtttcatcagacccacaaacacattgctctttaaaatcctgtagagaagaatatgacaacctgcaccttttctttccaagatggcatttccagttagggtacctctgaacagctgttgcttgcacattttaggcatggtgaagatctacacctgatgctgggttcctaagtgggcatatggtgaatccactgcacacagaagcacttctttatgcttggatcacattgcagaagattggacccctgactggggctacctttcccaagccttaacagcacatcaggctcaaatcacagggctatcaaatgaggagatccccttttccaaaaaaagcatccctatcaactctcccaggaaagcacatgaactcatgttatccattcattcttatcttggaaaatacacccacaagccccttttactgccacttacagtaggatgccacaaaaattcagaaactggaatccttttccgtcccttctcctttccttcctccctttcttcttttcttcttccttaccttgaaatttctgcctgtggtaaaaccacaggaagaaggaaagtcaaatgaattttcctattagtcgacatttctgtgatacactcattttttttggtccccgtatgaactccctccagggtatttctttatgggaataaagtatgccaaatgaaataaagaacttgaagcacaattttatccttgacatatgtagagagaatatgttactcctgaatttatggtgcaatgcaactcagtcacttccttttcctctttcccctagtttgcacttcctacttattgctgcataccatcacaaatttatggagtgccaatggctgtggcctctaggcagctcccaaatgactgaatccagacatcattgtcttcagttcccctttggcattagtctattttccatccctcttcctttattgaaatctgcttccaattatttttcataagatggtttagctttcttttatttcctttaagttgaaactcttttatttctacctttcatttctatgccctcctgggccttaagcacagttcttctacatttacaggggttttcatttagaaactattgagaactttactatcaaattgtactttttaagataatttttttgcaattttaactaaaaggagatttttagacttttggaaagtcatggctccaggtctcagatctcagctgtaggttttatcactttgcaagatgatgactagagttacagcacattctttcaacccatgcccaaaacttcaaagatggccacccttcaacccctgaagatttcaactcagtgttttcagaaaattggaggtccaggctttggagtcagacagatatgggttcaaatccagcctctggcacttaatttgaatacaacctagagtaagtcatttaactttcctgagctttgatttccttatctgaaaaataagaatatagatacttacctcaccatattgttataaagatgaaatgaggtaatctttgtaaaatatacacaatgtctagcaggtggtaagcattcaaactggtagctattttttattgttatgagttaaaattttgtatataatggattttttttccaagaaagctcatcaagctgaccttaagtagatgttactcccaaataccacccaattccatgtctacatacttgagaagttactaaacactttaaaattgaaattgaaaactagggacaaacatagatttgaaaccaaaggaataggtaatcagttataaatttggatataacattatgagcctctatttcagaaaatacattccttttaaagtatatttactatagttatccatgcagactgaatatttttatcaatagttgcaaaaccatttcctgaaagggaaaaccatgtaattataactagattttcacatgttaaccttttatataagggaagaacaagaagtagatatttgctaagagactgggaagaaagggaagagaagggagagagggagagacagagagaatgagaatgaaagcaaagaaatttgacaaggaatactatttggcttttggcccttccgtgtaccaacgtagatgtgtgattataccatttaggattgttgtcaattctttccataggaacagactgaacaatgagacatctacctctcaacccaaagagaataaaattgtcatttccctacaggacttttgttaatacaaaaatgaaatatatatatatatatatatataaaattattatgatttcaaaaataaagccaaatatctaaatgaaaccatgaaaataattagctccgatccaacagagtaagtgaggtttttactttggaagataagtaaattctttcagagcatgagaatgaaaaattgattgattccgatctgatctctaaaaagagcagtctgatttactttggtatcaaacagacctgcttctaaatgccatttctgccatttacctgttgggcaaatttcttacctatgcacttggagtcttcacccttaaaataggtatgaaaataggtagaaaataggcttgccatgctttctctctctctccctatatcccatgtctctccaaggagcaattcctaatgtaattgatcaaattcaagcatatggagtcttatttactaagtggcatggtcactatacaataaacgtgacttcccccacttctacttcttctcttctaagttgaaaaaactctaatctctcaggtcaggctaactatttccttccctctttcctgccttctttctaatttgaggcaatagcatccatgagcccaggcgatgtcagggattcttgtttttatctcaacactttcattcttccccatcccctcacaggcccccattcagaattcttaagcatgctatttgcttgagggggcatttaggaagtcccatttaagacctctgccagctctaatcttatctcttcagagaggccttcgctgactatccaatctaaagtacctacctttatcagtgttctacactggaaggtattgggcacaggtgcaactaataataaagtgggtggtactttgttgccatttccatgttagggcctttgtgtctgcacttctctctctctctctctctctctctctctctctctctctctctcatgctctgcatctttaaatcactaaggtctcagctctaatgttatctcttcagagaggccttccctgactatccagtctaaagcagactcctcattcccaccaactcactccattacattaatcttttattttgttaatagctctcattgcatcccattactttcttctttatttgcttgttgcccatccctacctccttcccaaacacacttattaaaacaccatgaagacaaaaaggtattgtgctcaccacttgtttatccagagccaggtgcctgtccaaagtagatgcacacctgccatgtcctatggccaaccaggtccaatgaattcctttataaagctcctctcctcagctgacccagaacaccagctgctatactgaaggctttcacactttcagatgaggtgtctttatcttataaatttcttttctctaagcagaatttatataacctactcattactttgaatagcatcttattcagtataccttattggtatttttcagtaaaccctggtataaggcacacagctaagtgaatgtccccacatacctataagagagtggctagatgcctttcttacccacagggatggtttcaaagaaaccttttacactcactcccatatacacacatacacaaaggaaagctcacatttgcattccagatcatctccaggaggagggaggagaaatactcttttaaaagagcaaacctaaaattataatgctcttgaaaacattagtagttaacatttactgttaagaaagccacaatcccagaccaaagatagctgagtggcatcttaaattgaagatagtttttaagtcagagcttagaaagtctcttggaaatctctttaattcccccacagaataaaatatggtacagattctcaggaggtccaatagaggctttcctctagcattagaacagatccttctttgatcaaggatcagatgaagtcattggtgtgaatttactaggcatatattttttcatatataacagaaaatgtcaacactggaatctcactcagcactaagatgctcacactaagaggttcaggaaaatgagaatgactcccagaacccatctcacattttctaagaggcatatattcattgaggggaacgtctaacagaatgacctatattatttacatcagtacttcctactctcacttttttggccaattctgtgtgattaaattggcaaaagttcaatgcacacaaggtgcaactcaattatatttaagatcactcatttatgtcataaagtctttctcaaaaaacaaaagatgccagccccacagaactttatcatgtcacatagaccccattaatgcagtctatcaacaatatagacagattattatattcagggaagttccctcaagaattgccttacaagttcaatttaaaaaatcaaaataaaacaagccagtactgagtctttctatggtatagttaaacttgtaatattttatacatattttttgaaagtagccttgatataaatcctgaaaaaagaaaaaaagcaaagtccacatttctataagtgtcacgatgataaattttatgtatcaacttgactgggccatgaggtgcccagatatttggtcgaactttattccgagtatggctgtgagggtgctttggacacacttttaatatttaaatcaacagatgcagtaaagcaattgccctccctaatgtgtgtggacttcatccaatcagctgaaggcttgattaggacaaaaaaaagctgaccctcatgcaagaaagaggaaactcctcttacctgatagtcttcagctgggacactgattgtgtcctgcctttggactctaactgaaacactggctcttcctgggtctcaagcctgttgatcattggacagaaactacaccattgggtctcctgggtccctagcttgccaatgccagatctggggacttgccagcctccatagtcacaagagccaacttctcataataaatctctttctatacatatggatacacacatcctactgattctgtttctctggagaaccctgactaatacaaatattaaacccaaataaaaacccaaatgcaagtattaaacccaaacccaaatccaaagatgaacaactttcttcatcagtctggcacctaactgcatgtctctttatgaagtatgtaatattttttcatgagctgccatatgtcattccatcactcgctctagaactcttttaggcacttaaaactttgtatattatattaaaatttaatgtatcaagaaaggatatagtgagaataaactgaaaagagtagttactaatgccaaatataaggcagtcttgaaaaaaagaaatattcctctgtaatctcagtactttgggaggccaaagtgggaaggctgcttgaaaccaggagtttgagacaagcctaagcagcatagtgagaccctatcccctaaaaatcaagattttttcaaaaaaagaaatattccattttttcagtaaaaatattaaacaaatttcaaaaggcagaatggacagcttatacatataaacatatagggatatgaaacacatagttaaatatctacctatactttttatttcattaatttaattggatacttaaaaacatgtactttactcaaattcttatgtgagcatctcaacacatggtttattcaaattctgatgtgagcatctccaccatataagagcctcctttttagccctccaactgagttttccagagttttccacaaaactccaactgagttttcttcccttggttcaaaacaggacactccttgaatcatgtatgatggtgtttctgaaagttgtctctgaaggcacaagtacctatttatataatattagcagctttttcttctaaataaaaatatttctttgaacaggtatatattttgatgtctatgatgtatttgtctcttgtattgctttttaaatagacttttcaaaatcgctgtttggaacaacatccaacagttggaattgtgaagtcatagcccctggaatcatgactaactgtgttcaatttccctgctcctcttttatggatcctagcagatgaccttcacgagcacccaaaacaaaccttgggtgaagccacttcagcccactgtgacttcctaaagcagtatttgaaaggacccaaatataaagcaaggtcgtctcttctgagggataataaattcagggggaagcaaacctcacctttgtatttgaggatatctggtgtattttagtgcaattctgcctttaagataaagtgccagctgacttaatggcagttgtgatctctgcttcatttcatcttttatctaatgatccgctagttagtaaacctgcaaatcctgaaagaaacataagtactctttttctttgcagtgtaatcaccaacaataaagctttatttttttgcattaacattcaactgcaatgtatttaaatgttccacatacacaaaaacacctgatttttcccaagatttgttaaacatagtccctttggtgtccttagtaacactgcaaagatgtcttcatgtaaaacttaatttgagtcctgattaccttactgtgaaaaaccgtaaacaccaaacaaaagtaagcataatatccaaatgcctaaaacataatacccaggttgaaggaagtgtaaatgttcagattcaccagtgggactagaatgtaaacttcttgggttgtggttcctccaaatcatctggccacctgggtatcatatcccacaagcatatggtaacactgatagagtaagctcaaagtgttccaacaccaggacatttcatggccacatcagaccaattgtatttttcacttcctctctttccctaacttttctcatacaaagcttcctacatttcctttggcacttagtaatacttaaatgcatcttcactgtcttattcagtgtttttagctttggaaggtgtatcacttgggattgctttcagatgcattaattgcaatctagctaaccaacagcccaacagtgatttaaacacagaaagctttcttttccggatatgcatgtgtgcatattttgttttgtttttcatgcaacaagatgtctgaaggtataatctgacactgagctggtatctcatggtgtcatgaatgccccagcctacttctattttttttttttttttcctctgctgtccttcagtgaggctttcactttcattgtcatagacggctgctggatctccaagtttgacacattctccctaggcaagaagagggggaaaggcaaaggggaaagaggatgccagccaagtcagtctctttctaaaagctttccagaaagttccatccagtgacttccacatacatctgcccagccacaaatgggtcatacagtctttcctaactgtaagagagtgtgggaagctggatatgagctgagcattgctgctccaaacaaaatcagatttctgttaggaaagaatggatgtaaagtggatcttaggaagggaacaaccaatgcctaccatacacaagtatttgtggtgagcagacatggctaagtgcctcttcctatctagggaggttcagggaattactcaagatctcttttgtgccagggaactagggagtcagtcatctcatttgctttcatttcctcatctctgaaatttcctactatggtattcctcttagaacaccatttagaagtgttatggttttctgttcttaatccaaatgtgacaaaatgtattctccttcttctctgataacaaaacccaaattctgacgggcagcatgtgcttagccttagataatgaataatgactggtctaacccaatcatggcgatactatgttcttttgccattgattggtattcagtagtaggcatgtgacctagatctaaccaatgagtggacatacactggggggactcatgaaagatttttcacctttggtaaaaagtcatagttgcaagaggagaaagccttttcttcatatgcctcttctttcctgttttagatgctgtcatgttaacgctttgtgcttagagctgtagaagccgtcttgtgaccatgaggcaatagccaaaagaggaaagagcctgagtatgaaagacactgggtcctttatgatattactgagttgccaaactaaccctgggatcctctacctcctgttttctcatagtaataaatatccctgtgatttcagcactatcactttaattttctgttacaggcagctgaaagcattcagaactcacatactatcttaacatcatcttccatgtgttatgggccaagagtatattcaagagtgactacaaaactacattcattgtcgtatccctgtgggactcccttaaagttctagtgttctgtagtgtactttccacagcctagaaggatatatgtttccctctctccagccctaaggaactcttaatttaagactgacaagatgaatgagttacaatgagggtgaatccaattcaaaagacgtaacaacaagcaagaaaagcaaagaaccttgtaaacacccatgttatggagtgtgagagtgtaagcttaaggaggcttttattttggggagaagatgcatcacctctgtttgaatgagagaaattaagttgtaattatgatggtgtttcagttaaattatttgatgtggaagacaaggagaccattcccaacatgttatttagcaaagaatatggaggagaggcagaagactgtgatggaaaacgttcagaggccatcaaccaaaatggtaatgcattcgaggcagataaagttgcttcttgctagacagaggtggggtgagccctgacatacgtcttcaaaattgcaaaaggcacagatctgggggggaaagggggttgattcaccaaatctcagaatagcagaatggcaataaccctactccaaggcttccagttttcctcagtttaactccttttgcatactgcagccaaagagattttttttaaaatgaagatcactcagactgtgtcctcttcctcttaatctccccaaaggaagaaaaaaacaatgatcaatggcaaatggcagttgcaatgaagcaacaccaagaacgagcttcgtgctcgggagagaacattgcatatcttcctgtggtttccagtgctctacacacttggggaaactcctttaagtaatgaaccacagaaatgacccctggaaatataatcttcaaagtgatcttttaaagatccaaatatttcctgttcccactctgcccagagatcttcagtggctcactactgcttccatgataagatcctaaaaccttgtcacaatccacaaggccttcattgtccatccctgcctgcctcactgtctttatctcccaccacactctgccttctctatgctcccacctgacaacttcttcagtgcgtggaccctattgtactctctcaggcctcaaaaccatgtaacatcctggacttcctcttcactggtctaatgcctactcatacttggcttctgagattgtacttcactccacatggagattatccacaaccatgccccactccaaaaccaggttaccttcccaatgtgatatacttgccatagcactcagcttccttttttataatactcatcacacttgtgattgattgactctcttctcctttacattgtaagatccataaaggcaaggatcatgtctgtctctttctgatgtgtaacaagcctgaacatacatacaataaatggccaggtgtaatttaccattgtgtggatgccatcttgggaggggggattctaatagttcaagggcatgtatgaaaaacagactcatggtaaaataataagaatagaaaaaagttactcagagtggtttaatggctggggtataccttttactattttacttagacatcaaaggaaaatcagtgtcctccctatcatgttccatgattttgtacaactgagtttagagcacaagctaaggtatcagacagcatttgacagcccagcttcactacttatcagctgtgtgaggtgatataatccctctaatccctataaaccttagtttcctcatctttaaaatggggataatgacaaaagcttttcaataagggtttgtgaggattaaattagataatacatggaaagctttcatcccagtgcttgccacagagttagcatgcaataaatgttataaagagttctttattgttctgcccatcaacatctgagacagaatataaacacaactgctcctgggcctggtggctcatgcctgtaatcccaactttgggatgccaaagtgggaggatcacttcaggccaggagttcaagaccagcctgggcaacaaagcaagactccatctctacaaaaaatgaaaaaataggtggatatggtgatgtatgcctgtagttctagttacttgggaggctgaggcaggaggatcaactgagcccaggagttcaaggctgcagtgagccataatcatgcctctacactccagcctgggctttttaagattccatctcttaaaaggaaaaataaatcaactggatcactagcctataagagcttaacaattgttaggtagtattactatgggtgttattgttttgttatttgtggcaaaaagtactagtgctcacctgagcacatgacttccttatgatcaggtaggtccatgtttgtcttggtcactactccagcccagtgcctagcacagtgcttgacacatggtgtgtatgcaatgaacacttaatgagtacttaaagatctaaccagtatgatagtgcagattctcttgtaagcaaatgaatagagaaaggcagtattccacagagaaggagacaggaaaaaagaacaggcttgattttactaaaaagaaaaacacacttttaagcagtaaaattagaagttcccatttcaatggcacaaaatagagaactcactgagaattgtgtgctataacatggtcaaagcagaggccgataatgaagggagcagcattcagaaccatcacatgtatggtcagctttcagaccctgaaaactcgattaaaacattccaggaaaccgctgcactttcattctaaaggaagattgtgaactctgttcacatattacaccccttcatattgctttgtctaccagtgtggccttttatgaagtgagggcttctttcttctaccttgctccatgacaatcaaacccaaaatgccttccacccttaaaaggaagttttggtaagtgccttattataactatcacatatgacacaaggctcaccactaatcggagacagatgagaatgaattacttaaataggacagaaatagccattcacttcaagaaggtcccagtttcttgaaagtctgtggcattgagaccatttacagtttgctgtcaagattcctagcagtgctcattaccttggctagcaatccctctggactacagaaaacttatctgaaatatatataatcacaggctgcaatgcctaagtgcaacaggatgatttaaaaagcaccatgatagtgttcccccaggacattcatctctccctgtctattcatctttgatccagacaaaaacttggaatgcaatctgtatattgatattccctaaaaaggatttcaccagctctttaggaagaattgttttagcggctctggaagtctagaacattctgcatttgtggtatttacagcttttgtttctatttcataaaaataaagccccactaagagcagtattcaattcctatcccaataggagtatcgaatagtggttaagcacatgttttttggaacgaagcagacctgtgttcatctctgggctcctcatagacctcttcataaacttaggcaaggtattcaacctttttgagtctcagctatatcaggtaaattactatgcgtgcacagaagagcttaataaatgttagatgttaatggtattaatattgttttgctgctgttttcagtttttctagcagagattattagtattcacccatgtgcacaggtagaccgcatttccacccatgcacacaggtagaccgcatttccaagcttcagtggagttacgtgggtccaaatgactgagttccgatcaatggaatgtggcagaagtgatgtacaccctttcctggatgggcctacagaaatcctctagactctactcctcactctccttttcccttctcaggcaccctgaaggctacttgttaaagaatttagagctacaggatggaaagaacctggatcctacctaagaacctcctaggagagccacccttcagaaacatttgcagtggattctgaatacgatttttttttttttttttttttttttttttttttttttttgccgagcacggtggctcatgcctgtaatcccagccctttgggaagctgaggtgggtggatcacttgaggtcaggagctcaagaccagcctggccaacatggtgaaaccctgtctctactaaaactacaaaaattagccaggtgtggtggcacgtgcctgtaatcccagctactggggagactgaggtaggagaattgcttgaacctgggaggcggaggttccagtgagccgagattgtgccattgcactccagcctggtgaagaagtgggactacatctcaaaaaaacaaaaagatacatatatatgatatatctgatatatgatatatatatgatatatctgatatatgatatataaatgatatatctgatatatatacatatggtatatatgatatacatcatatgtatatatggtatacatgagatacatcatatgtatatatggtatacatgagatacatcatatgtatatatggtatacatgagatacatcatatgtatacatgagatacatcatatgtatacatgagatacatcatatgtatacatgagatacatcatatgtatacatgagatacatcatatgtatacatgacatacatcatatgtatacatgacatacatcatatgtatatatgacatacatcatatgtatatatgatacatatatatcatgtatatatgatacatatgtacatatatatgtatatatgatacatatgtatcatatatatcaggtatatatgatacatatgtatcatatatatcaggtatatatgatacatatgtatcatatatcaggtatatatgatacatatgtatcatatatcaggtatatatgatacatatgtacatatatatcaggtatatatgatacatatgtacatatatcaggtatatatgtacatatgtacatatatatcaggtatatatgtacatatgtacatatatatcaggtatatatgtacatatgttcatatatatcaggtatatatgatacatatgtatcatatatcaggtatatatgatacatatgtacatatatatcaggtatatatgatacatatgtacatatatcaggtatatatgaacatatgtacatatatatcatgtatatatgaacatatatacgtatatatcatgtatatatgatacatatatacgtatatatcatgtatatatgatacatatatacgtatatatcatgtatatatgatacatatatacgtatatatccatatatatgatacatatatacgtatatcatgtatatatgacgtacgtcatatatatcatgtgtatatatgatgtacgtcatatatatcagatatcatatatacacatatatcctatatgtgtatatatgatatatgtatatatgatctatatacatatatatcatatgttctatgatatatatgatatatatcatatatgatatatatgatatatatgatatatatgatatatcatatcatatatgatacatatgatatatcatatcatatatctttcttttttttttcagttaagctactgggttttgacgaagctcattacagcagttagcctacttcagggtttctcagcctgggcactactgatattttggactacagaattctttgttatggagggctgtcctatgcattgtagggtgttgagcagcatccctggcctctatcctgctagatgccagtagtaacctctccagtagccatgacaaccaaaaatgtctcctgacattgccaaatgtcacctgcaaaatcgcctccgattgagaaccagcagcccacactggccaaaacatcaccatcattgctatcatcatcatcataggatattgatagtctagtctctcatgttccccttgaaatcactgcaaaaggactcaaagttccaaaagaggtccagcccagtttttttaggagaaaaaagtgaaatgacactaaaatttaagaaaaggtaagggatcaagcagtaaactcaaagttataggagaccaaaaaacaaagtaagaaccaaaataaatataatccttttttaaaaaagctagtttgtgtagtcccagctactagggaggctgaggcaggagaatggcgtgaacccgtgaggtggagcttgcagtgagctgagatcgcgccactgcactgggcaacagaccaagactcggtctcaaaaaaaaaaaaaaaaaggccggtttgatcactttggtaacctagaataaaatgattaaaacaaaaacaaacccaaatatctgggtctaggaatttcaatgtgtctaacaaatgcttatagaatatctaccatgagataagcattgggctgaatataacttggtaaataaaacagatataatccctgccctcatagagatgaaaggtaaataaaaatatggagttttttgtttttgtttttgtttttgttttttaagacagtgtcttgttctattgcccaggctggagtgcggcagtgagatcatagttcactgcagccttgaactcctgggctcaagtgatcatccgtactagctaggactataggtttgcaccaccatgcccagctaatttttgtattttttttatagagacgcggtctcactttgttgcccaggctggtctcaaactcctggcctcaaggaattctcttgcctaggcctcccaaagtgcttgggattacagtcatgggccattgcacccagccaaaatatgatggatttttcaaacagcttaaacacagtcatgaattgaccactgcaataggcagacttctaaagatgtccctgcaggattcccatccctgggccgggcatggtggctcacgcctgtaataccagcactttgggaggctgaggcaggtgggtcacttgaggtcagaagttgaagaccagcctggccaatatggtgaaaccccctgtctctactaaaaatacaaaacttagccaggcatggtggtgagtgcctgtaatcccagctacttgggaggctaaggcagcagaattgcttgaacccgggaggcagaggttgcagtgagccaagactgcaccattgcactccagcttgggcgacagagtgaaactccctctcaaaaaaaaaaaaaaaaagattcctgtccctggttatccaattaaacactagattaggtgctgccatgaagagacttagcagatgtatcaaggttactagtcaaccgactttaacataggaaggttatcttgaattatctgggtatgcctaccctagtcacatgaggttgtaaaaacataagtggaaggtggaagaatcagtcagagtgagaaagcagaagaggatgcaggagctatgctgcagagggaaagtcagattccaaacacaagaaagaaaaagataagatgaatcattgatggttctaaaatgtaggaggctctgtgtgaggaccagaaagaggcctgagggagctaagggtggagccctgcctaacagacataaagaaaatagggacttcagtcctacaaccacaaagaaccaaattctgtcaataacctgaacgagtttggaagttggtttttctgcagtctccagtaagaaacacagcgctgctgatacctcgattttagcccagtgagacatgtattgggcttctgactgccagataataaatgtgtgttgttttaagtcactaaattcatcatagtttgttatgacagtaatagaagactaataaaccattatgcattaaatatcacagaaaagaaagggtttaagaaaataggtattaaagtatgccttatcaccttatcattcatcaatctgaggtttactaaacacttgatgggtgctcattagtggaataaattaatgcactcatattttcattcatttgttaaaaatatgcatacagtgcctcctctttgatggtccctgggtgaggtattgaggttacagtagtgaaataggtattatcctctgtttataacagctcataatggaagtggaggacagaaacatgtacattcaacaataatgcaaagaacataataaagatattaacatcatcattataaaactatcagtaaaagtgtgaataagggagtacagaataataattacagctgacatctattgagtacttgtctcatttcccttcacaacaagcctatgagactgtattagtccattttcatactgctatgaagaaatacccgagatgggataatttataaagaaaaagaagtttaatggactcacagttccacatggctgagaagacctcataatcatggcagaaggtgaaggaggagcaaaggtacatctcatatggtggcaggcaagagagcatgtgaagaagaattgccctttataaaaccatcagatctcatgagacttaatcacgagaacagcatgggaaaaacctgcccccatgattcaattacctcctacccactgggtccctcccatgacatgtggggattatggtaggtacaattcaagatgagatttgggtggggacacagccaaaccatagcagagacagacccatgattcataccatcttgcagattaagaagctgaggtacaggcaggtgaagaaaccagcctaaagttactatcggtaagtggtggagctggaattttaacacaggaggtccaactttagagcccatggttttaaacacttcattgtgctgtctctcattgcagaagggtgaggaggcctcacagaagggctgagatttgggatgaataccttcatcaagaaaaggaggagccagtagaagaaactgcattggtaaagccagagattcaggaagaaggtggatggtgtggcatattctggaacagggctctgtattggcaaggaggggtggcagatgaggttggagcctaagttgtcctgacttgaaagacttgaacctctcagcagtttgaatttcgttctaaagctatcaaaagaacctattcaagagcatgatacggtaaatcatcttcagcaactcacatatcatttttaacattgtttcaggggatattagtggacactcttaggaacgcagtgtatagcccacaagtataatgacacttattaatacaacttagaaaacaccctttgaaaatgcatcaaaaccctaaaagattcgattaactctatggaaatgaggataaagggtagatgcatgtaagaatccagctgtcttctatctacaaagctcttcatatccacaaccacagagacactgctcagcttctgaatcgccttagttcacaataaaatagaaataaatcataataaaataaaatagggaataaatctatctgttggctttgagaaaatttctcagtagcaacaaaccaactgctcaaatcagaatcccccaaaataaataaataaggtacctaagagggaatgcatgtgttgaccaaaaaactaaaaaattctcccatttctgtctgacgttgaaaaaaatcataggtatttggcattttagcctatgctgttgaatgtggtagccactaattatatgtggctatttaaatttaaataaggtaaaattaaataaaatttattttctcagtcccattagccccatttcaagtcctcaacagccatatgaggccactggccactgtactggtcagcacatgtatcagacatgtccattgttgcaggaatatctgttgggaaaaaaatgaactacttatttagataaaagtagtgatttgttagacatgcctaataaaattcagtttattttaagattatgtaattaaattcagacttacttataagagtctgaattttcattttaatcgtttgtatgtatttcattcctcttagtatgaagagagtctatatcaagagactctctatggagacaggagccagtttgtattaggccccagctctgtcttgggctctgtgctaggcatttcatatctgttatgctacttaaggctcatgactccctgtgagataggcatgcttattctcatttttccctaaatggggggctgtgacaaggctgaagcaaagagagggcacaacatcttttcagggttaacacttgagaaacatctatttcttcttaagtagctctactgctgcttagagaagtagagtatgtagacaagacagttaaattttccacagatggggtttacttagagggagataagatttcttttgcacacaattgtagatttttttttaaatggtcaaaatcctcctgttctagcagtagctaagaagtgactcggggaagcattcaacaagtaggaaagaagtctgctcagatggaggccctgaatcagagatgcctgtcatctgttcccaaaggctccaaactcctgccacaaatacactgagggttcctctctctataacttcttctctttattttctctggaaggaatgtacttgatacttatttttaatctgagtctccttccacaaaaagtgtagaggatgtgctacccagcccctaaagttttgcctcttggtattcacacttgtgaagtcattttccatgtggaagagggctgacctgtgtaagcaataagatgctgcagaaatgtatgacttctgtggctaggttagaagagccatgagtccttaaagctttcccccttttctctctcttgagtggctgtctctggaggaagccagtcaccattctatgaagttactcaagcagccagtggagaggcccacatggggaggaactgaggcctcccaccaatactctccatcaagctgccaggcatgtggtaccttagaagtggatcttacagccccagtcaagccttcagatgactatagagccagaaccactctactaagcctgtcccaaattcctaactcaccaaaataacatgagatagtaaatgtttactgcagttttaagcagttgagttttggcataatttgttatgcagcaataggtacctaacccagagggtttttccagctttgcctatgggcaagtctacagatgaaacaagctgcttttcatatttagtgctctctctcacaattatcaggagatataattatcttaccatccaggctgtgattcttgcacacaagcaccaagtcatccattattgcagtctcccttcccatgcttgatgaataactgggttcctgtgatttttcctcttttctttccccattgactgttgaaattgtttgcctcaactattgagtcccttctcttcagtttgcctccttttcttttcctcctacatgagcagaagccaggaaattgaatgtattcgatcacaaagtatgcatgaccctcagcaacatgagcctacaatagtctttttaatgaccagaggaaggttgtgaggactcttagttaatttgttatgaacacccactcccataaggaagctgctatgtatttgtggaataaattaaataaaatcagcaaatttgcttattatctatttcctgccctttgaacacaggtttacccataaactacatttgttacacactaactgaatatggaaagcactatgggtaatgcaaaaaatatagcttgtctgttttcagtgtactcataagcaaatataggagacatcacaaagatgcaaatatgtattcatattcacatacatgcttaagtagacatttacatatcaaagacagtgaaggctaagggccaaatgaatggtacacacaagtgttaacagatcttcaaaagaagatgttatggctgtgagctgaattgatcagggcagcctttatgcaggaacaaagtcttcagaaggtttaactatggcagatactattacagatactacttgtttcatccagttctcctttagccccaagcatagagactcctgcacatctcagcctcttatgagtgggcaggatcatgtgactagctctacttagtggggcacgagaaaaagtaacatgtttcatttcttaagtcaaagaaaaaactatgtttaattctccaatctttctcccccaaaagttcacatgctctggggtaactagaggatgttagtggctccctcagcctgggtctatctgaatgactacaataagcagagccccctgacaactttttttgggcatgtaccattagcaagaactaaacctttctttgtgataggccactgtgatctggggactcatttgttactgcagcataacttagtctctcctaactaaaacagagattcccaaagatggagaaaagcagagcacagtagaggtagcttataagtcatgtcttatatgacctttctcaatgacaaacctgtgtgctcaccaagacatagcttgttatgacatatctgaatagaattgaaggtttttaaataaaaacataagaaggttggaaaggcagcagaatgagctactgcctgtgggtgatctttacacatctcagaataacaggattattgatgccttggccagaagcattcctttccctctgttttctttttctttgagattgcaagccatatatttccatttggaaaacagtatttcataacctctaaacctaacatgagtcctgtgaaaccctagtctacagttgaatggccaaaaataaagacttgaaattccttcaaagctatcccattttacaaggcaatgctttctctctctaccaagaaagtgttcctgcttgatagattcccctctcttgctgtatattacacttactgctctcctgtcactccctattctcttcctagttgtttgtgccttattaaattccacattttgaaacaaccaataagaatcagaaagcctgaagaagccctttctcatacaatcagagctccctttttatctaggaataaattatattttccaatcaattcatgagtgggattcattgacaatatactctctttgtaacatatttctgaatgagtagtaaatggtcttcaataaggatatggcgatacattttagctaaactgtttcataccgacattaactcccctgttaacttacttaggagtctaaagacacaatcaaatagctgtttctgactattattctcaaagcgaagctccaggccgtaatctcaggacatgcatgaaaatatcaagtaacaactcaaaggcccatttcagcttcaaatacctttgaaaattcgtgagtttgaggagcagagtgggatagcaggcgagtggaagaggaggcttctgagaaacttaattatctacattttagaatgtttcagtctttggccttttaatactgtagtatagcctggcttctgtcattctgaagggatttcccagcttaacaaaatcccaaggaaccaacctcagattggtctcttacctaaggaaagattctggcaacacaacaggaaggatttggaaaatttaatgaagattttgaaatacccctaacacacttaaattaaagataatacctatttcacccaaatctcctaaccccctgtggaagatcaattctaatttttgaggacaattattcatgtgttattggcttgaagtacagaatgtattagtaagtctcttcagttctaagtaacagaaaccaaatcaggctaggttaaaattgaaggggcatcattagaaggacccaagagtgtctcaaggactcagaggcaaagatgcagccagttccccccagtgccgggaaccagaaggtgggcaggaactcagggaatacagcccccttctatctctgcttctcaattctcatagggaaatatggttgtccacagatctcaggtttacctgtcatagttctagccacatgcaaggaatgactgcatatctctgaattccaaatttcagaaagtgagaccttggggtgggagatggggcacgcttggattcggtgtctaactctaattcaaacaacttttgccacggagccatgtagtagccaaatatgtttctaaggcccaagggaccactcttacaaagatggaagatagttcactaaaaagaagacatgctttctagactccacagccaccccagaagtgccaagataaataatagggagccagagtttaagcaagggccaccatcactgcaagttgtctcatccaacttctccctttataggaattgacatgacttcaaatattcatgtctgacaccaacgaagaggaatgtctgttcttgagctctttttctcggttcccaaggggccctcagtaccctgctttaccatttagtgtggattctgacaaaagaacaaattaagtactttgatttgattcttaatttttccttataaagacttgcaataaatattgtgggtacctagaaataatccaccatagtgcacaacacaatctgttgacttaccttagcttccattttccttcttggtctgacatataaattcaccttgctgctcaattctgtcacctactattttcagcatgtatgagcaacagtaaagtgcatgcccacagaactcagaaatgagaaaactaatattgctctgttatatgcataatggatcaatacagaggtatttaaacacacaaagaaaaaaaaaaacaggtcagcaagacttgactttcaactgatagagaatattaacatgtttatgggtagaaaaagtggtcagttgtagaaaaatatacaaagaaaagctacaaagagatgttggcagtggccatttaagctctgtctagggaaaggaagcctttagttaatggccttcaagtattctaatgtagggacacggcacccctactgtggaaagagatgcaggaggtggaaggtagctaaggccttggagtttcagttccacaggcaaggctatccttatcatgagaactgagcagcatgaagctatctgtagtctgacagtcatattgtatgttgtgtcaaatgaaaacatagcatcactcaattccttttgttctcttctcttgctaaacacacaactatctgatgctctggcttcccatggacctcaggcctgcttagaggatggaatgcaatagtcccactagtctgtgcagtgggccaactgctggttgtaaaatcacaaaggggccttctaggttaccgcgtctcacaaacttgggtaatgtaattccgtcttgaagagagagtcccccatgggtaagaccatggaccatggtaaatgagtgtaccccaggagaactgcttgggaaatagtcacttagcctattctcctggtgatgccccagacattgtcaacatggaccccttggagcatttcctcgttgatgtctacatttgttaccttactcttaattaaattttctaaaaagatggcacaataggagcactgagaacatgatttttaggaagaaaaggaatcccatgtaaacccgtttccatctgtggttcttgcctttctgtccttatccatagggcagctcattcttgcatatctgcagctcttgcatgcctgccattttgtatcttcctttttctcgttatatcagaagcattataataagttacattagaacccgttttgcatattttaacattgccttcacagtgaaactatagagagctttatggtggcactctagtgaatattctgttctgcttctgttacatgactaccttaggaaaagtctccgagaactcctgtctcccatgattatctctcctaatcaggctttctactatcaaactactcagcaaaaggaactcaccaacctatagtgctaccagaagtctaataacataacactgtcaccacaactttttcagcactaaacatgatcatttttaaaaatagtaagtttattaggtatataatgatactttccaagttccagcctgtttataaaggactctgtataaataaggaaggggcccaggaatggtgacatatttaacgtgtaagtcaggatgctaaatgtctgactgtatttgtttatttttttctgaaatggagtcttgctctgtcacttaagctagagtgcaatggcacaatcatggctcaatgtagccttgacctcccatgctcaagtgatcctcccacctcagcctcctgagtagctagaactataggcacacaccaccatacccagattttttattttttgaatgtatttatttatttatttatttattttttgtagagacgaggtcttgctttgttgcccaggttggtcttgaacttctggactcaaatgatcctcctgcctcagtctcccaaaggattgaaattacaagtgtgagccactgtgcccagctcctattatatttttaaaaggaatatactgaggaaaatacaaatggagttcaactgataaaaagaaacctctgtaatatgagcaggtgaatacaatttacaagatcatacttcagtatgaattcagtaggaattgcatgttttgcctgctgtgtgtccctaagggtgacacactcctgaatgggactttagtttgccataagcctgctttgttttgtttgtggtagaaattccatgctatgaggaaatgctttcatttcttttgatatctcatgagcgcttgttgcaaaaaacatttgtaggcaaacagcttcacacatattaaaaacttgtagcagaaagttaattccctaacataagttgtccagctcagggctctataatcctgtaattcattttggttccaataaatacgtactttctgtgagaccctttggggaaagggtaattagatatttcacatcagtgggatatctttccttcttttgctccccctccttctttccttctccttttcttctctttaattcttctacccagaaaaattctcaaggagcaaaaatacattactctctgcatttttataagctggccagttttgcttcctggcttttgaacagaaaattatgcctcaaaaataatcccacattattctctaaattcattttcctcagtcattagcccataacggcaattttccttttgaaaataaagaataatgatcatttattgagacaaatcctcaatcagaatgattcaaagagaatacaaatttaatgatcaccctgagaacccaagtaatacatctcaggaaataataataaaatttatgatggccttaaaattgcttaactcctttcaggaaaccctgaattatagggtagtaacataaccaaggactggcaacaactcacaaaagtctagaagagttttgcctttgagttcatagacaaagatgcttaaattgttccccgttcaaaaaataaagattatttattatttactttcctgtgcaccggacactcctgcaacatgactataactcttgcgttcttagatttgatcttcaaggtctctgaatgatgaaaaaacttgtagggtagcatgccaaccaacttgggttttttgtctgtttttgtttttggaggaggggaacaaggcagggagagagggagagggagagagagagagagagagagagtgagagatcacactaccaggagcttcataaagaaacctgcaatgcagaaccaaagtggatgaaagcaaaaggatacaacttttccctccagatgattttactgggaggaagaaagatttgaaactattgagtgctttttctgataaccacctatggctctctccaaagacacacatgtaaagttgggcaagttgttttctgtcatgtcaggaaaatatttagtagcagtcttacaaaagtaagcactcagcgccgtcccagggagctgtggatttgctgtgcagccttgtttccttcaacaggttcctttgttgctttgtgtgttctcccgacaaagggcctgcccttcttctacagatgggtttaccattctctctgaatgaagactattcagaagtacacaaaccaacaaaccatccaagctgcctctatctgatggtcctggtatatccagagtactaaatagtggcctacaggatgggaaattcacactgactgactccacaggagactgagaaagcttaactggctgatagctgtaaagtcctttgaaggaacaagcactgtttaaaattctaagtagtaatcttataatttgctaatggaaagaaatataacccagctaatgtgtgcctcccatttcagagagtatgtttcaacagcaaagccctttacaatatttagataaacttcgatgtatagaaagtgcaacagcaaggtaaacagcagggcttcccgctatggcattttaaaatgtggtgggtgaaatttgtcactcctaagcaagtgcctatagtaaaaataaaatatcactatttatatggtatgtgttaaaaattgtccactctccccaactacaccagatcaaaacctcttgttttttaaattatgaaattattgaactgtattgagcacacccctacttatgagttgtgtaacctggggcatgatattgaacccctctgagtcatttcctcatctatctagacaaggctaatggtaatacctacattgtagggctgtcgttagaattttaaaataatttaataaaataaaggctagtatttattaaactctaaatacatgtttgctgctatcagcagcagcagcatcggtcggcaatcacgccaacactcctcaaagaaaacagttctgaaaaggctgtgtgcatcctaggtctgaagattttcttggtctaaagagtctcttgggctagtgaccaaatccttcattaatttcaagagctctgggaactctctgaaactgaatgtggaatggtataactactggtctgtgcacatttttctagaaaacctcacatctttcatcacattaagaggttaagaatcattgccatatgtagtcattagcttacctttatctactttctacttctaacggagaactagagtcctgtttagaacaagtaaccaggacagggacagaagaaggagactatgcatctgtcactcttgctgattagtctccaccctctcccagcttctgcgggcctcctctcccaagagttgcgatcctagacccacctcccatctgcagtctcaacctatcctcttctaaggactaatcatggcatatggcaggagagatttaagactagctaggtcaatgctctaagctcaacatcaagtcacctctgaggcagggtgttgtcatggaatgatcatgacctctgaaataggaaggtctgtgtttgatttggcttgaccacttactggacgtgtgaccttggaaacgtttacttaatcatgtcttttgtcacctataaaataaatacaataagatttacattgtgagtctatgagagagaaatgagataatatagagaatatttttaaaatgggagcatatgtcaggcaacagtagatgctcagcaatgttcttttcttacctgggcttcaacctggcacccttggtcaccttcccaggacccaaatccctctaggaataaactctggcccttgctggcttctttattcttcctcccacctacatacttgaacccatccaaagaaataggtctgactaccttggaaaccttttctgatgcttactacttgtccaacattcatttttctgtaccatgtgtgtagatactggattccccatcctagaattctacccacctcttgggctaccctgttacaatgtgtgactgactatcctactcccactttccaagttaaccacttaattgaatggctgcccatcaacatactccttaaatgccaagttagttctgtcaaacccaatccacagacaagccttatcctcaaaccttttctgccctctgccacagtgctaactggttcattgtgcttgttcagcatgcagggacctttaatttaatgggcctctcccatttttcacatatcatgaaagttatcaaatttaggttaattaagtttaagacatccatagttattcgagtgaaaacttgaaggcagcataatggataataatggtaaaatgataatttttgagctcttagtagatgccaggcatagtcctaagcagtttaaatatatttttttcatatgattttcataacaatcctacatagtagattatgatcattatctctactttataggtgaggaaactgagacttagagaagttaagcaaatggccaaaagttatgcaggtagtaagtagcagacatagaattgagaagacagcccccattctaaataagtatgaaaaatttcagggtgtcaatttttagctaaggaaaacttattcatgtgtgtgtgtgtgtgtgtgtgtgtgtgtgtgtgtgtgtgtaaatgaatagatattcatttacttatatatctatttcccaggcctcaatgcaatcagagatctctgaagaagtgaccatattatgaacataaatttttgacttcataactttacagtgataaataacctcaggttatcaggatcctaaccttaaaccacctgagattttatcactgttcctttagtaagcaagggatttttcaaccctgagacagataaaaaatagattgtatggtcaatgaaatccattatattcatactttttggttgagtttaggtaatggaacaatctgagaattttgtatcaagtatttgtgatgtttaagaggatttatcatatttaagaatctgacagattgcccctgcaattagaagtacaattgattactgacttctaattttaggttaaaaagtttaacagaatttgatgtttttaagtagtactgagatgtttaaataactgaatttattctttatgagtctagtatatttgattcaaaacatggcttcaaagcttagaaaggttttgcttgttaaggttgtgagcttgtactgccaagtattcgaagtgtttacaaagaaagtaaaattgttaaatgtgtaaagttattttaaaatattgatgaatacatttaacaagtaaatacaaaagtgtatttaagtagacattattcttttatggcattcataaattcataaattgcacaagataacctgagttgctctaaatgcttttcaaacttaagtttaggggagcaacatcagcaagatggctcactagaaactccagcactcatcccttccacagtgacagccaaaacaatgaataaacaactacactttaatgtacataactgaaggagagtgctagaatacatcaaaggagtaacagaaaccctggtgagcacagaaactcaggacagccacaaagagaatggaaggaaacatcacaactccaccaccctatccccagctgagatgagccagaaacccagaggaaactttccctataggaaaaaggcaagcaagaggattccagtagcctccaccaacaccttggacacccacagtcctcactactggagtccttgtagtcttcactggcactaagtccagctgagggagctgcctacaggccacacagccacactcacctcagagaaggaactaatactgtgctctattccctgtagcccacatggcaactgtgctatatcatcttagaactggaactactgctgaagtgtgattttctctgagggtgagcaggcttgacacccctgcctccataaggctaagctgcctccaaaccaccccaaaccagtggccacagccaagctgccagcagctgttaatgcctttccccatggagccaaacagtgaaaactgctctacctgccctccctcaccttcacctgccctctcccttcacctgccctcttgtgctagagatgaagcaatacattccctcctggggaaacagtgctttggcagaacagctccatctgcttctctccgctgcaactgtacactgcttctaggggtctgagccaaaatggcacagtatctcccaaggaaatagtgctttggtaggaccctgtatcccaggtaaatggtgcctgggccacacagaacagtcatgcctgagttaaagtgtcacattgccccttggggaatcattgccttggtcaagttaaacaactgtgcatcccagggctgagctgatgtagtatcttgtgtcccaaggaaacagagtagaacatgacctaagacagtctaccctactggacaatctagtaccctgctttcctgaagctggactagcccactagagtctgaactgctaagacctgctgtttcctggggagtggactcatcactgtgctactccctgccctccaggacccaaacaatacccatgctcagtcattctagggtacttgctgccactgcgcctggccacatggagtctgggatacagatatgccccaccattccaaggtctaaatttaccactacatagttcttcattctcagggacctaagctgccactgaaccctattggcttaggctcctaaattatagctgtaccatgcatgctgtgctcaaacccctaaaactctgcttctttcccagagctgagccagggctgtatcctattccccaggggtagaatcacagctacaacctgacccactgaatcaaagctggtaggggctgcctaacagtcatagattctggctctgtgggaaacctatatttgacccagctacagagagtgaacctgtaccccaggacccaagagccacaataggcttgtgaaactctgatattagcaccctgactccatagccacttcaagtaccaatccctggaactcaaagcaatggaactgcttgtaggccatgtaagagggatcctcttgtttaattatccccattgtgaggaaaatcagaataggaggaccccaaaagccctgccactgaggacattaacaacctatgttgtcactgccactaccatacccctttttttttaattatactttaagttttagggtacatgtgcacaatgtgcaggtttattacatatgtatacatgtgccatgttactgtgcggcacccattaactcgtcatttacattaggtatatctcctaatgctatccctccccctgcccccaccccacaacaggccccggtgtgtgatgttccccttcctgtgtccatgtgttctcattgttcaattcccacctatgagtgagaacacgcggtgtttggttttttgtccttgcaataatttgctgagaatgatggtttccagcttcatccatgcccctacaaaggacatgaactcatccttttttatggctgcatagtattccatggtgtatatgtgtcacattttcttaatccagtctatcattgttggatatatgggttggttccaagtctttgatattgtgaatagtgccgcaataaacatacatgtgcatgtgtctttatagcagcatgatttataatcctttgagtatatacccagtaatgggatggctgggtcaaatggtatttctaactctagatccctgaggaattgccacactgacttccacaatggttgaactagtttacattcccaccaacagtgtaaaagtgttcctatttctccacatcctctccagcacctgttgtttcctgactttttaatgatcgccattctaactggtgtaagatggtatctcattgtggttttgatttgcatttctctgatggccagtgatgatgagcaccaccatacacttttacagcctaagtcattcaggcatccacagttactgttgacactgaatgcagctgaagaaactgcatagatactataccactgaacctacctggaaacaaagtcaccacacttttcctaattagcacactaagatccaactacaggtgaaagtctttctctgcaaaagccactctagaaagtctggaagaggcaatttttccaccaaatgcatagacattgatgtagaaacacaagaaatatgaaaaagcaaagaaatatgtcaatgccaaaggaacaaaataactccctagtaacaaaccctaatgacaagaaaatcaatgaattgccagaaaaggaatacaaactagtactcttaagaaactcaacaagatacaagaaaatacagatagacaattcaacaaaatcagaaaaagaatttattatataaattagaaattcaacagagatagatattataaaaaataattcaattaataaaataaaaaatacaataggcagcttcaagaacagacttaagtatagaaaacaatctctgaacctaaaaataggttatttaaaattacttagctagagagaaaaaaaaataagaaagaaaaagagtttttaaaaaagactacaagacttataggacaccattaagtgaacaaattttcatattatggcagttccagaaggaaaagatgtattaaaaaaaaaacctaatttaattatctaatagctgaaaatttcacaagtctggatagagatgtgtatatacagatccaggaaactcaaaggttcccgaatagattcaagccctgatgcacattatagttcaattgtcaaagtcaaagacaaagcaagaattctaaaaacaacaagagaaatgtgtcacagtacatttaagggaatccccattagactaacagaagactttcagcagaaccttatagaccaggaaagaacagaaagctacattcaaagtactgaaggaaaaaaactgtcagtcaaggatactatatccagcaaatatatcctttagaaatgaggaagaaataaaacgtttctcagagaagtaaaaacagggaattcatcaccactagaacagttttacaagaaattctaaagggactcctgcatctggaagcaaaaaatgattatcactactaagaaaacacacaaaagtataaaactcactggtagaggctgagcatggtggcttacgcctataatcccagaattttgggagtccaaggtgggcagatcacctgaggttgggagttcaagaccagcctgactaacatggagaaatcctgtctctactcaacacacaaaattagctgggtgtggtggcacatgcctgtaatcccagctacttgggaggctgaggcaggagaatcacttgtacccaggaggtggaggttgcagtgagctgagatcgtgccattgcattccagcctgggcaacaagagtgaaactcatctcaaaaacaaacaacaacaacaacaacaacaacaaactcactagtagagcagatacacagaaaaaaagagaaaagaagcaaaacttatcactacagaaaatcactaaaccacaatgataaataataagagaagaaagaacaaaggatatgcaaaataaccagaaaatagttaacaaaacgacagaagcaagtcatgacttatcaataataaccttgaatgttaacagaataaattccccacttaaagacatagactgacttaattgatttaaaacaaaagaaaacaaaaacatgatccaactatatgctttctataagaaattcacttcactactaaggatacatacagattaagagcaaaggaatagaaaaagatactccatgcaaataaaaataaaaagcgagcaggagtagctttacttgtatcagataaaacagactttaagtgaaaaaactgtaaaaagagacaaagaggatcatcatataatgataaaggaatcaattcagcaagaagctacaacagttatatatgcatccaacactggaacacattgatatataaattaaatagtattcaatccaaagggagagatagaccccaatgccataatagttggggaccccactctcatcactggataggccatctagaaagaaaatcaacaacgaaacattgagtttatactgcattttagctcaaatggacctagcagacatttacagaacatttcaactgacagtggcagaatacatattattttcatcagcacatggaacatcctcaaggacagatcacaaaggccacaaaataagtctcgacaaatttaaaagaagtgaaatcatatcaagtatcttttctgaacacaatggaataaaactagaaatcaataacaagagggacttttggaagctctatgaatacaacatgctcctgtataaccaaagactcaatacagaaattaagaagaaaatttaaaaatttatgaaaatggaagcacaacatatcaaaacttatgagatacagcaaaaacagtgctaagagaaaagtttataacaataaacacatcaaaagagtagaaagactttaaataaataatctaacagtgcaagaacaaaaatgaaaacaagaacaaaccaaacccaaaattagtacaaggaaagaaataacaaagatcagaggagaaataaatgaaattgagactaaaacttacaaaagatcaatttttaaaactttttttgaaaagataacaaaattaacaaaccacgagctaaactaaccaagaaaaatgtcccaaataaataaaattagaaacaaaaagagagaccttacaactgataacccacatatacaaaagatcattagagactagtacaaacaactgtacacccacaaattggaaaaccaaacagaaacaaattcctagacaacctaacaagattgaacctagaagaaatagaaaacctaaacacaccaattacaagcaacaagttgaatcaataattttaaaaatgttctatcaaagaaaagcccaggacctgatagcttcactactgaattctaccaaacatttaaagaagaactaatgcccatccttctcaaactcttctagaaaataaaagagaagggaattctttcaagctgattctacaagaccattattaccctgataccaagccagataaggacacaacaaaaaaaggccaaaatccctgatgaacatcgatgcaaacatcctcaacaaaatactagcaagttgaatccagcatcacattaaaaagaacattcaccatgatcaagtgggatttatcccagcgatgcaaggacggttcaacatatgctaatcaataaatgtgatacttcacattaacaaaatgaaagacaaacaccatatgatcatctcaatagatgcagaaaaagaaaagaaaattcaacatcccttcctgataaaaaccctgaacaaactaagtatagaataagtgcacctcaacatagtgaaggccatatatgacaaatccatacctaacattatactgaacagggaatagctaaaagcttttcttctaagaactagaacaagaccatgatgcccactcccaccactgttattcaacataacattggaagtcctagccagagcaattaggcaagagaaagaaataaagggcattcaaaatggaaaggaagaagtcaaattgtccctgtttacagatgacataatcttaaatacagaaacccatataagctgtaccaaaacattcttagaatgagacaacaaaatcagtaaagttgcaggatacaaattaacatacaaaaatcagtaccatttctatacaccaacaatgaactagtgaaaaaataaagcaagaaagcaaccttacttacaatagctacagaaagaaaatataaaatacctaggaataaatctaaccaaggaagcaaaagatctctacaattaaatgacaggacactgataaaagaaattgaagatctggttacaaaaaaaggaaaatatcccatattcatgaattggaagaacttatattgttaaaatgacaatgctaccaaaaacaatttacagatttgatgtaaaccttttcaaaataccaatatcattcttcacaggattagaaaaaatcctaaaatttatgtggaaccactgaagaccccaaatagccaaagcaatccccagcaaaaagaacaaagctggaggtagcacattatctgactttaaaatatacaagaaagtgataataactaaatcatcatgttactggagtaaaaacaaacacatagaccagtggaacagaacagataaatcagaagtaaatcctttaattatagcaaactgatttttgacaaaatgccaaaaacattgagtgtgcaaaggacagtctattcataaatgatgctgggaaaactggatatccatatgcagaaaaaatgaaactagacctctgtctctcacatatacaagaatcaaatcaaaatggactaaataattaaatgtaaggcctcgaactataaaactaagaggaaaacattggggaaaatgcttctgggcattggtctgggcaaagattttttggataagacctcaaatataaaggcaacaaaggttaaaatagacaaatgggattatatcaagctaaaaagcatctgtacagcaaaggagacaatcaacagaatgaagagacagcccacagaatgggagaaaatatttgcaaactatccatttgacaagggattaataaccaaaatatataaggaactcaaacaactcaatagcagaaatgctaataattcagttttaaactgggcaaaagacctgaatagacatttcttaaaaggagacatacaaatggacaagaggcatatgaaaaaatgctcagcatccgtaatcctcagggaaatgcaaatcacaaccacagtgagataccatctcaccacagttataatggctactatgaaaaagacaaacaataacagatgctggagaggatacagtaaaagaggaatgctagtgtactgatagtgggaatataaattagtacagccattatggaaaacggtatggaggttcttcaaaaaaactaaaaatatctacaatgtgacccagcaatcctgctgctgggtatatatctgaaagaaaggaaatcaggatattgaagagatatctgcatacccatgtttactgcagcactattcataatagccaagatatggaatcaacctaagtgtccatcagctatggatgaaaagataaagaaaatgtggtatatacacacaatgaaatactattccgcttattttatacaattaagcctaaaatatattttaaaaaataataaaatcctatttgcagcaacatggaactggaggtcattatttttatgtgaaataagcccaacacagacaaatattggctgggctaagtggctcatatctggaatcccagcaatttgggaggctgagggaggattatttgagcccaggagtttgagaccagcctgggtaatatggcaagattctatctctataaaaaaattaactggctgtcctagctacttggaagaccaaagtgggaagatcgcttgagcccagaaaattgaggctgcagagggccgtgtctgtgccattttaactttactccagcctaggtgacagactgagaccctttctcaaaaaaaaaaaaaagaagaagaagaaaaataataagaatgacagacaaatattacattctctcactcctatgtggaagcttaaaagtgtggatctcatggaggtagaaagttgatgggtgctactagagcctggaaagggtggcaagaggggtgaagagaggttggttaatagatataaaaagacagctagatagaaggaataagttctagtgtttgatagcacagcagggtgattatagttaacaataatttgttacatatttcaaaatagctgcaagagagaatttgaaatgttcctaacacaaagaaatgataaatgttcaaggtgctggatatcctaattaccttgatttgatcattgcacgttgtatgcatgtactaaagtatcacatgagcctataaatatgtataattattatgtatcaataataaaaaacattaagtttaaaatatatctttaataaattaaacttttgttaaaagcccaaattatagtaaataaacccttctgcatacaaaaagtgatctattagccactgaaaatcttataagagagtttttatgacagacttatgagcaataataagtattttaaaatataaatcagatcatgtcatgccttggcctaaaactcttcattgtttaacagttactcttatgagaaattccagtctcccagccaaggtctatgaaactcttcaaaattgactcttgtccacttctacctcctcaccaattatcaacctcactaccccagtcactttggccttttttcctctttctgatacatcatgagcttattatggcaacaagtcttttatatttgttaacttctctacctggagtacttttcccaaaatattttgcaaggtgggctcttgcttgacatttaactctcagctcaaatatcacctcctccagatgcctcctctaattgtcctttacaccaataacctctgacacattcatatgttttacagtcttaggaatatcctcaatgcctgacttaccatattcatttattggctcccatatttatttccccctctcccaaataaaataaaagctcaatgagagcaatatcttgtctttcctaaaccattgcttggcacatattaaatgctcaataaatatctgttgcacaaatgaataaacttaaataaataaaacacatctttgccttaataccaagttatttttaaatcatatccttatgtaatatcgaatccataagactcaattatctggggtttatttgacaaatttgattatcttatttgggggttaataccatgaatggctaaaaataggccaattgccaagcagagcacacaagcaaatatgatccctccccaggatgcttgccatccaaattacaagcattgaaaaatcttggcaaggcgcctatgctaataagaaagtgatccaatattcatgagaagaacttgaaaaactattatttttgcctgcaatcttcttggcttttccataattaatatgtcattatcatcagaaggctaagagatcaagagtggtaaaagcaacctttcatgtaatactcatagggacaatggtatttagcaaatatcacattgacttctggtaagagaaataatccagaatctgtggttgctagaaacctagtatatggaaaaaatagaggggcagttggcatcaagacagaaaggtagggttttaaagctgatctagaggtagaaaaaaacacattctagagattcctgaagaaacaaattccaagtactcattgtcatgaaaaacggtatgatggagtcctaccctctgtctgtattgttcttttttaaatagatcttcctggttaggtcaggaagaagctattcttgaatgccagttaatacattcctccatttactcaacattctatccctacaccaaattagctcagtagaaaggctatctagactatctactacctaggtcataatacattagcaacctgtacaaatgtcttttcagagtttcagtttatagcatgccgtggtttgttatccagggtgaatctaggaaacaattagatctataatctcacagcaaacttcatttgactatatttgcaaatgttatcaactatgttatttttttaccatcatatatataacgattgatataaaaagtttttcttacagttaggaaaaatttgtctctcctgacaaagtggtattcttccttttgcaactaatggcagttatgtaacttgcttctcttagatggccttggccatctaagaagctcagagcagaactaacttgtttaggtcgtctagaatgacttcttccgatccctatttttctctgcttaaacttgttgttcagttctgttaggacttttgttttgttttgttttttacatatatgccttttctcattagttggttaaaatacgcttttaaagtgtataagataaaaatagtagagccagacacggtgccttacgcctgtaatcccagcactttgggaggccaaggtgggcagatcatctgaggtcaggagttcgagaccagcctggccaagatggtgaaaccccatctctactaaaaaatacaaaaattagccaggcgtggtggcacacgcctgtaatcccggctactcaagaggctgaggcaggagagtcgcttgaacccaggaggcagaggttgcagtgagccgagactgtgccactgcactccagcctgggcaacaagagtgaaactccgtcccaaaacaaaaaacaaaaaaaaagagtaaataattttgaaattttaagctcccttttaccaaaaaagggttctgacttctggccagaatgtagtaaatgtcaagaaatcagtcacagctgaggtagtgccaggaatttggtgtgggggacaggaggagacaagcaaagactatttaaaaacaatgaattttagcctgtctataagtactcttttctatgaaaacataaaaggaaatttcccttacaaatgttgattgataaacatgaacgtctatatggaaaataatgcgatatctgagctaaaaggactcttagtgaactctgatccaatctccttgatttgaggatagggaaaagtgtaatccctaaaagattaaatgatatttccaaagaaacaacaagttggtaattaagtccggcctgaaatctggggcttctgcttcccaggttatgagctttctaacactccaagaactgtgaaccctggagggaaggttgtaatctgactttaactcctgaggacatgtggatatgcccttcagggtccagggacatttgggttgcacattaacagttaaaatatgctaaagcaccgcattttctccaactccattcaatgcctaaggtttattgtttgttcagttttagccaactatatttcctgagtgtttcaaaaggcagcaaggtggcgaggatacaagggaaagccgctacacattcaacataggaatacaaagattatagtagaattctacgcatcaaattccaattcaaatttcttctggggtcagtgtcagtatctcccacttcctcctgacacatcctgagctgaagatcccttttaaattttctttctaagaaaaaaaaaaatataggtttattgatctcctttaaatgatagctttagaataacatgtcaaattatttctgtttcttgacttattctaggaaaaaagacaaagaaataagatattcatataaatgaaaagtttcacagccggcaaccaactaattggtatatatttaaacacatttaagatattacttgattacattcaataggcataatgtccatataagaacaatggttttgtttggaacatataaaagtgatagttctgtaacatgtatttatttaactttttattttgagataattatagattcacttgcagtggtaagaaataatatagacagatcttttgtatccatcacccagtttctcccaatggtaaatcaagatattgacattgatacaatccacctcagatttcaccatgttagatataagttctaaatttctcatcaaagaataaatatgccagtatgttcaattctttgccttctacttttaaacttaacttcctcgtaaagtaacctttttcgattacctactccaccccgactcattccaattcctactccaccccaactcattccgatcacctactccaccctgactcattctgattacctgctacctgctctgccctgactcattctccacgctgcataaccattttttttccctccaaagcactcaccccctcactctctttaaattagccaattggaattagtttcgcctgcgtggtctaatcctagccaacaggggaacgacacggcagcaggggccatgtgcctcagggataagaacaccttcccctcccttgtccaagtgtgcgctcaccattgttccatctgtaagggcgtacccttctgtagaagtaacttgccttgctgagaattaaaagaaaattttatattcgatgccgtttcttttgcggcaccgaaactttatatataacaaccactttgacattcatttatataaagatcaatttttaatagctacaatctatagagcacttctatatgccagaccaactgctcactgatgaacaaacattcttctagttcattcctacaaaaaacaatttaccagtggaggcaatagtgaggactgtagcttagaagctttcatgctacaatgtagtatatgctacagtgtagtaccctatagctgtatgggtggttcattttaaaaattgtatatgcagccattcctcaataggctcaaaataaatattgacagaaataggtaagtaaatcaaaagagaaaatcaaagccaggaatcaaaagaagaggcaaattgggttaatatgattcaatttacgtctgggcttcttggtagacaggacaaaaaggtaaacagaatgagatatgcaatcctttttgtcaaaaggggaaactcatattgatcctttaagatatagatgtttaaaaatatgtctatgtctgtgcacatacccttatgctagctccagctcagttttttaaaataatcttttcagtcagagtttatgaacatccaaataaaactgtgtcaacacatgcttaatacatcagtaaaactatttttaataatgtactctcctattgaatatgggttggttttctgacttgctatggcccattgagtgcacagatgtcacagtgttctacttccaggtagtccttaacaaggctggcagcttctactttgaaactttccaaaaaattagcttccatgatgtaaaaaaaaaaaaaaaaaaaaaaaaaaaggccaatccagaatactacatgataaacacttgtgaagagactgaggtcatgtgcacagcaccaatgcacagatacgagtgaatccgttgatcttccagggcagcatagccgaaagctgaatgcagcctagtgattgacccagcctacaccaaatggagcggaacaactacccagccaagccacgccccaattcctgacctacagaaccttgaaaaataatgaatcactgttggtttaagcaacagaagttttgaggtagtctattacacagcaatcaataactgaaacaataacccaaactgataacctgaaaattcattttgtaaacctgcatctaaacttggtacaataattaaacattttctgtgcaagtagtccctcttatatgactagaatgtgtggaatgcctaggagcagcttttccaaatgaattcatcaataaacataaaacataaaatgaactgctctagttttcccagagattctgcctagaacagactgccctaggacagatgattaagttagtttgggtccaattcatgactacataacatggagttagttatgtcttaggctacgtcccttcaggcaacttggagcctcccagggttaaagaagctctgccaaaactcaaaatcaatagggccatttaaatgatgacatccccagtgggtaaagatatttgactccacacatcaatggcatgagctactgtcatgggcattcgtcaataggttgaagatctcattaaagctttttaatttctgcttagtggtattaggatttaattgatgccaaagacactgcctgtcactatacagtgatgttgtggcagtcagtagagaatgtcttacacacagtcctagaagaccttcctagaaaggccagggcagttctactggctgcatttcctggcttgacaggctactgctactttatagtagctctctctatgttgttctaccttcccatcatccgtgcacccatcttcttttaccagcaacccaattttctgaaaaactactccatctttattcttagtccatgttgctcagaagggtttgattctacccacagcttcaggcatgggcacaccacccagatcaggttgatcaccctggacatataactcaagacagtgtcaatgagatcaaaactttgaactctcaccaatactattggaaatgagaaactctattgtttcccactgggttgctaaactggtagaatggaatgggtatatataactgacagcctttttgccattccagggagataaaccctaagaacaaacaatgcatagatcacttgatcttctggatccagcagttctagaagtcatacgtgtctatattttttcagtatataagccaataaaatatcattttcatctaggctgttttgagttgtatttgctatctcttgcaatcattctcagaaactgccaaaagatgggctgctgcacaactatgggatgatggaatgccatttattttctgggacagtgcaatttattacaatttattacactccctttctgagccatagatcagaaagtacccgggcgttaagacaacagcacttcaaaaaacaatatcatacttgatcttcataaagttaagtgagcaaacaaggaaactaagacattaatgagacatgtggttcaaaagtcatccatcaaatcaaatatggcaccaagactggaaaccaagtcttcatgaaatgcgaggtttctgttgcttgaatcaatggaccttaaaggtgatttggtcttatggctccccaatgtcagtccatggattgggatctgttgccagagtatgttcaaatcatcaatagtccacagagtaatgagaaaaataaagaaactttgataggttttaatggagcaatttcatttcacttttaaagcctgaaatttcatccttccaggtttgtttggttttttcttttggtgttaacatatcctctttttgaaataatagcaatagtagatgtaaatcatcttttttggctaaatataaagtaagcaagcccatagcctcccctggaaggcactgccattgtttccaatactctcagctttaacactgacagctacccttgctctctttctcactgacacccaccaactcaaccagccctctcccaccacacaccctttctcaggtcacctctgtgctctccacccttggagctttacctctgggtaattcccttgtcttttgtaatgtatattagagtgtatattagagtgtaatgtatattagacgtctataactcctgctattactctgctcagcaccttcttaggacagaagcagctatcctttctcctgagaaggtgggaaaaaggcaaattatgcatacttataaataaatatttgttggtctcaaacaagtaaatttataaacattgatactaacattactggaagcataaaagcattagaaagacattaaatgccctacagtagagtgaaaattaaattctgccatctaggagaatagtatttagtcattaaagttatgattataaatactttgtaataatatgcgtaaatgcatatgatataaggttaagtgaaaagatacataactacaaaatacaactatgttaaaatatccatgcatggattaaaaaaatacagctttaactgcatagtggagttaccggtaatgtctacttttatatttatagaaatctctgttgtccagattttctgcaatgggtacatatgacttttgatggggttcagaacatgctaccacaaaacatggcaccttggcattttgaatattttaagctgaaggagtctgagaaacagcatgtgctggaaggactctctgaagcaggtcagaagccccttgtgtgagaggtccctccctaaacccagagaaaaggagcatccttatctctgaagatggagggacacacggagaagaaactccaggaaccagccttggtaagtttcccctagtttactacacttagttcatatgcttttccacaagtttccactcttcatcaaacctagtataaaagcactcaggtttaactgattcatcagattttccttccttatgaatgctctagtgacacataaaacttgtattaaatacatttgtatgcttttctcttattaatctgtcttttgttatagagccctagccaagaaactaaaatggttaaagggaagatttttcctacactttaaagtgtacaaatatatatttattaaagttagttccaattattatgtagccaatatttactgattactctactctgtagatgccaagaaagccatactctttcctgatagtttcctttgtgtgacaagatttgccacagatgtaggcaatgttggtattatacttttcttgacagctagaataacttctgctaagctaggcaaccacatctctccaagccatccttaatgcctaatgactgccactgcacctgacctagctccagggctgaccctttcatgtttaccccaaggccatgcccatctgggaaaccacctgggcaggtaccttccaaccaaattaaagtcaaggattccatccactatcactaaactagcacaaaccaagagagagaaatcaaggcaccacataggggttaggacaagtaatcaaagtcaggtagaaatcccagaagggtggtatacaatttatatttccctagtgaggcccattctagaataatgggaaaggttcactgttgtcagaatgccaagaatgaattctctgaatctggccttccctgaaatcaacacttaggttctgacaacctctaaattcatcctcactaactacatcaaacatttagcatgctttttattgtggggatgggggttgcttttgtttgatttggtttatctggcatctgaaacaaaagatgggaaaggatgacattcattcttaacctcgtgtatagttaaccacatcaaaaaaggctattgttagatacaaataaacgttaacatacattagttccaaaaggctaaagcctttcaggtgaacattattggacactttctcccctgtgccagacaaaactatgcatggcttattcccagagtcaccccgtcctttccaaggcattctatgctgcctcagggatgcaaacaattatggtacttccaggagagaaggagcacataaattctgtcaccccttgaccccaggatccaatttcacagcaatgggtgaaaggattttttagtcaagagatgatgtgagacgcacagataccccttggagtcatttgggtgacagcattaaagagaatgaaatgagctatcttgaaatggaggccaagtgcagtcactgcatctggaaagttaggctccttgatattcaaagctctggggctcggcaaaaaattcaaagagcttttagtattcaaaacaaaacaaaaaaaaacaaacaaaaaaacaaaaaacactctttaaaaaattaaaatattcaaaactgtggaaaacttgcaagaatcatatcatgaacatcccatactgtcttcccaagattcatccatttgctattattttgccatatttgctttatctcttcctcctcctctgctccccttccctcaaacaaacaaatgaaaagtggtttttgctaaaccatttcggtgtaggtgtgaacattaaaagcttctaggaattacagtagtctctcacacatacaatgatcaaaatcagggactttaacgttgatagaatactatcttacacgtagtccatatttacttttcttcaatcccgagtgtcctgtatggccactttcctccagtctaggatcgcactggcttttagctgtcatgtctctttagcctccttgaagctggaatactttctcagccttcctttgcccatcatgtcattaacattcttgaagaggacaggcctgtggcttttcagagaatctatgctggtctgactgttatatgaggattagattcatagtacatgtttttgaaaggcatactacctaagtgatagcatatccttctcattgcattacatcagttggcacctgatgaaacttggtcccattcttgatgtgttaaccttgattccttaaataaggtgttttctgccagattacctcactgtatgtgtgtgtatgtgcaggtattcctctttttcccttttataattaataatgtatgggaagacttttttctgactgtgtaaacaccctgctaatcaacaagctttcactcaatggtttaacacctattgacaattctactctgaatcaattattactataatagttgtaaaaaagtgatttttctaactctattatttctttcacagcaattagttggttttctagtgcaagaaacagctgccctttctcccttctttccttcctttccctccttccttccttcctttctttctttctttctttctttctttctttctttctttctttctttctttctttctttctttctttcttctttcttttggttatatcttactcatttgattcttaagtgtcccatttcaagctggttcctgtgtcattcagacaggtcctcattttttttttaatcagtttttattttctggcacaacaaaatgttccaggcttttcttgtcctttccctgctctgaaactgcaattagtcattgctctaagcaggggtccccatccccaacctccaggctgcagactggtaccagtctgtggcctgttaggaactggctgcacactaggaggtgagcagcgggcaggggaacctaactgcctgatctccgcctcctgtcaggtcagctgcattagattctcatggcaacattaaccctattgtgaactgcgcatactcattatgagaatctaactaatgcctgatgattttagatggaacagtttcatcctgaaactatccccgctcccctgccaccgatggaaaaattgtcttctatgaaaccggtccctggtgccaaaaaggttggggaccactgttctaagggcccttatttttagtggggaatgctatttagaaagcaagagctgggcactcagtgtgttcactgctgctaggagtgttattgcttgcaggccctttaagaggacaagtaagaattataaatatatattgagtcatgtcttcctattgatacttctaatctccatccaatagctcaggctcttccttgcctttccccaatccacagttgtactgccctccttccacagtgataagcctgactccccacaaaataatacatttacttaatcctacaatggatacaaagtaatttcagaattgtcccacaaataacacaaccaagaacaaatgtataaagttcaagatttctttccagtacttctgttgtttgattgaaggccatgcccatctgggaaaccacctgggcaggtaccttccaaccaaattgaagtcaaggtactgcattcaaaataacttgaatcagtatttttttcctatgtgtaatcatgtcatccatttgatatatagttaggttcatttactctgtactcaatttcccccatcttgttatttaatgttatttcggaatatacaaaccatgaacatggtttcaaactcaaaactatataaaaaggtattcagagaagtactacatcactgtcttccttccctaactcttctaatgctattcccaccctgtagatgaccaatttcatatcttctagtttatccttcctgtgtatccttttgcaaaaataatcagacacatagataaagacatttttatttccccttctttctacctgaaatgcagcatgctatatatagtcttccacattttgctttttgcactaccaatatcttctggtgatcactccaatcccgattcacagggatcttcctcatcctattttacagcacactactgcattaatgtattatggctcattcaaacaatctcctcattacaacataaccacgatgatgctgcacatattattatgagagaagttgaacatattttcatatacttaaggacccttttttatcaatttttgtgaactttctaggtctttgctgcttttctatcggatttatggtctctttagtctcctcaacgtgtagtaactttctatatattagcaatattagcattttatcagaaatacatcttgcaactatttcctcctggtttattacgtgtggtttatggttttttgccatgccaaagaggattttgtttaatttctaactttacacaatcagattttactacatctgaagtttgaattgtgaaaaacctttccttgtgcttttcctttttgttataaagcaatttcttatactggctaatttttaagtatccctcattacactatacatgggaatgtatgtaagaagaaaatcctatttgcctactgaccgctgggcaacttcaaaactgcatgacctttatttctgcaggcccttcatttcctagctgcatccctttcattttccctaaccccaggtttcctcagcaggccagcttcactagagagctgtaaactaaacctaaattactaaagaacacattactcactcatcataaccataggaatctttctctagagcaaataagaattagtagtacaaatctgttttataatcacatactttcacaaagcaagaatcaccaatagtatactttattgtctctcattgatgggtacattttctcttattatttttattatcaaataatccatgtttattttaggataaaattaaaactacagctaggcaaaaacaaatcaagatgttggaactgttaatattttagggcatatatgtaaacacacacctatttaaaaactctcttctttttatacctattaaaaaaaccctctgttctctactatacttgctattttgtaatctgtttccattttcatttaatataaacatctttccatgttactaagttgtctgcaaaggcattttaaaaggctacatggtattatactgtataaagacataaaatattgaaccaaatattgtgctcttaggatttaaaaaaaatatcgtaaacaactctgagaaaatttactcagacacacaccttcatgaatttgttcaaatgcttctttaagataaatacctaaatgtggaattgcaggattaaatagtacacaagattttcagggttttgatatacgtggtcaagttgccaccagcagtgtatggtgggttccctttacccacactgaacccacattagtgttatctttctctgtaatcctttttatctcctgatttagcaagactaaacaacagtgtaaagttctgcaaaagcaccagataagcaaatttagaacaaaacattactgatgtctgcccaaaactctgtaaacctgttcctaggctctaagctgtctattgaaatgtcctaagaaaccatttcactcagagaagaacatttttttcactcttcctgcacagctcagtctttacgatgttaaaatcctgtacaacttcctaacagcccttcacattcttcaggagcccgagtttggttctggttataaatgcataggatagatcccatacgggaagcatagacctaagaaatttatggaaaggaatttatgggaaagcttctctcatcagggctgtaccaattaaaaatccataaataattctcccttgtcagtttctgtataaacacattggccttagaaatttttacttcaggttctagtctaatggcctacacttctaaattatgcttttaattgaaaaacaataacatgcattttttttccagaaccatctgtgctttcccaagaacatgtaactactacagataaatccgctactttgaacaccctaattatccagtttagggttccaaaagcttaggaaaataatgccattcctgaaaaacagtacgtgatcagaaacacttgctttaaaattcgatatttggtgtgtgaagcttcttaacaagtgtttattaaactgcataatttcaaagcctggagtggtatattgcaatgttttcctcggagttgatcacatttgcatatctttttacacttcctgtgaaattaatattgccttttgtatctcgaacttagctaatataacttgccatttttacttttcactgctatgagtaatataaagtgaacccccaaagggacccctgcaacgcctacataagctttattctctcactgttgtattttttcatatgaatatattaaatcaagattaataaacctttgcagaatccactggtcctgcaaaaaggcaagattcataacggtaaaggctgctcagcaaataaaggaaacctgctcctaaaactggagccaaaggccggggttcatggagctcttgtcacatccaacagtgtgccagagactcttcacctcacaagaagtctttcaacagtcactcaataatatgtgcaaaagtggcttaaccaccaggataccaaaacccagccggtgattatcaggctgccttggctcagggatacatctttgtgagatgccaaaaactgaccataatcccaggattttaaaaatttcagctgggcttatggggatggaatgtgataataaagaaacaggatggtaggggctgaggaaaagtggaacatgatgagaggctcctaaaagcaaatcaaacacagaaaagggaaatctctctgaacactgcataccgcactgggcacaggagtcctcagttgagcatcccccactcattgggccccagcagctactttgcctagctaagaatctgctcaaagctcagggaaacctaaatggcaatacaaagaaagagttgggggcagcttcaagatagcaggctactggtacaaatactttgtgaggtcagaaaggctcactatcatgacttgtactgctgtcattgattctcctacttcaagatcatctccaacttggtcaagaggcagagtaatggggattcagggccacagttagggtgcagcaaatgaggtacaaaatttaagtagaactaaaaacaacctcagtagccaggtgtggtggccatgcctgaagtcctagctacatgggaggctgagataggaggatcacttgagcctaggagtttgaggctatagtgcactatgattatacctgtgaatagtcactgtactccagtctgagctacatagtgagatgcccatttcaaaagaaaagaaaaaaaaaagaaaaatcctcagtaatcaagataataatacttcagtgcaatctttttagaaaccaaaaaaatcatggtgaagaaaacacaattttaaataaatattaatgccctgccaaccatatttgagcctgcatggacacttctacctacatttttaatatattttaaaaattaatttttttggagaaccttaaagtcattgaagaaatactgaaaaattggaaagtaggtatattaaaacttacaatattaaatgtaaatattttatttatactaaaatcagaattcattataatttcactttcctgactctaatgggacaaagtaattttatttttatgttttgagatagagtctctctctgtcgcccaggctggagtgcagtcgtgcgatctcagctcaccacaacctccacctcctgggttcaagtgattcccttgcctcagccttccaagtagctgggactacaggtgcatgccaccacgctcggctaatatttgtatttttagtagagacgaagtttcactgtgttggccaggctaggggacaaagtaatttaaacatgttttcaaaacttacttctttgtttgtcttcttttcaatggaagaattaccatgtttgacattctcttatcacctagtgacaatcataaatgatttttaattaaacaatttactttctttaaattaattttattttgtttttccttagctttaggctccaaaatggcttggcactgtactaatccttatttaaaacttcaatgttttgttcatcatggatttttctggcatttatttgatttttgaaaaaaatggaattaaactatttgtcttgatcactaagtatgttgacattctcttaaactgtgcattaccttgttccatccaaatcaaagtcaaggatgtagccatctcagacaaataacataacaatgactttaagtgtggaaagaagcctaagatcttttattaagtgaaagaagtatgtggcagaataatatgtatagtatgggctcacttgcacttaagaaaggccagaaaaacattttaaagaataactctaagtcattacacatcaaataaacattgacggcaaaaggtaaaaagtgtagttactgaagcaagagtttctaaatcatggtgctgcaaaataatacactgggtgtccaagtagcagtaacaactaagtattaccctctgctaacatctgatatctttgaaagattgtctctacaataatgtcattctcattcacttgtagctaggtactttttttttctagagaaagagatgggatttcagcatgtgtactaggatgacaagcaaacactgtaggttcaaggaagttcatgggcatctcaacaatatgtgtggtggtgaaaaatacactgagaaccactcatctagctgctactgatcctattccataagctaggaatacgtcataagtactgttttgtcctcgcgttggggatttttgttttgttttgtttttttgtacctcctcagtatcctcctctgttaagtaatagcatttttgtttgctttttagccaggtttatggaggtataatttaaaaatagtaaaatttacacttttagtatatatttatatgaattctgacaaatgcatatagttatataacaaacaccacaatcaagatacagaacatttctatcatcccaaaaagttcccatgtactttgccatagtcaatctttaccctaattctccagcctctggcaactgctgatttgttttccctataattttgcctgttcaaaaacatcatataaatgcaatcataaaccatttatgtctgacttcttagtgtaaagcatttgagattcatccatttgatgcatatctcagtaatttatgcctttttattgctgaatggcatcctattttatggatataccacagtttatttatccatggtaataggatttggattatgatttcacaaatcacccatacttcctttcaggtcatgtggtttataaagggctgacccgaaagttccagagatgcccatagccaggcctgatcaaataacatattcagtcatcctgataatatggatggtttagagctgggcacatggtttgatgtaacaattttcgattcaagacaactgacagaactattggtaagaagttactgatggtataatggaaactgtttctggtagctattgcaccaccacaagggagccccaacttgaggataataaagccaacaggaagcaaagtgcaactaagtggatgagataccttcctaacctagtttgagcacctggatccagacatgcctaaagatctacctgtagacctgtcagttacatgaacctataaaattccttctagcctaggccaattttgattatatccctcattcctgaaactaaaatctcttgactctacagcatagaaagaaatctttcatcaaggaggttacaagagagtcttggaaacaagacacaaaaaatggttttgacatcagacaccccaactttaccacttactacttcctaagtatacaatgtcaagaattctctttactcctataaacctgtatttcctcatttccaaaatgcagagaataattccttacccattctaaaatattatcttgagaatcaaaaaaactaagttggttcaaatacaaaagaaaaataaaatgtatgattattatacacacaaaataatttgtatatgaaaaggagatattaagtgatgacggtgagagagaatcaagaggcattataaggatcaatgcagaactccagtgcttatataaggatcaatgaacaataattgtaactagaggtatttcttgagtatattcttgtgttaggcattgtgtcaggtattttacctacattatatcatttaacattctaaatatcactaaagtaactttttaaacccatttttgattaggcttagagaacataaaatactttttaagttaaagtactaactggcagaggccaaataaagacctaaatctggaccactgaaactagtgcacacttctaagttagatggaaggcatgaagcaaacactttggaaattaaaattcagttataaaaaccatcacaacacaattaatttagcaactacattcctttatacataattgtgccgagtgcatctaactcattaagatgtagaatgtttatgctgtcatataatattatcacatggtaataaatgaagttgcactatatctctaaacatctggatttcagagccaattttacacatttaattcagctatttggtgtcttaaacacatagcaaaaatacacaaggaaaaaatgattgtacatctggcatcaagatggctccaagaattggactgccaatgaggaagtcaggtttttctagcctatatcctctggaggataaatacccaaaatagtactgtttccaaagtaaccaaaatcaagaaaggagactccacaaaggaaacaagaatgaaaaagacaggcctagcccttttcaaaagctgagccttccctcccaggatccaaggtacttagggtttctcatacctgacaacctataaacgagaaagagtatcacttgtttgtccttccatttctcattttccagctttggtgcttatcaggttctccagaggtagcaaatttgtaagacatttcatctatttagattttcatttattcatccatcctttcagttactcagtgatgacttctatctgctgagccctgcactaatgatccaaaattcccaatcttcctgcctaggagagatagggagaggtagggaatatggcttctccattttctccttttcctttagtaaccaacctctactggaattaatcctttgagttcagctgggccttgagatccaacatgatttgttttaaaaatcaaggcaactattaatgtaaaaacaaaacaatacaagtattaggagaaaacatgagagaatttctgtacaactagatgtggggaaagcctttctaactataactcaaatccaaatgcaaaaaaaaaaagaaaaaaaaaagattgagaatttcaattacctgaaattttttaaaatttgcatagcaaaaaataccataagcaaaaataaaaaattaagtgcatgataggagaaaatatttataaaatatatcacagattaagctccaatcaccctaatatatattttaaaattcttggccaggcgcagtggctcacgcctgtacttcctagcactttgggaggctgaggtgggtggatcacaaggtcaggagttcaagaccagcctggccaagatggtgaaaccccatctctactaaaaatacaaaaatcagccaggcacggtggcaggcgcctgtaatcccagctactcaggaggctgaggcagagaattgcttgaacccgggaggcggaggttgcagtgagctgagatcacaccactgcactccagcctgagcaacagaacgagacttggtctaaaaaaaaaaaaaaaaaaattcttaaaacccatttttagaataagaaaaatagaaaaacaagtagttcacagatgatataggaattgcccttaaacatatgaaaatatgcttaattttacttataataagagaaaagcaaattaaaactacactaagaattataaccatattactctaacataagaggttatcaataggagaacctgggtgtggtgtacacaggaaccctttactatcttcacagcttttctgcaaaccgaaaactcttcttaacaaaaaagttgatccaaaaaaagtacattgagatactatttcttgcctatgagattgtcaaaagttgaaaaacttgacaatatactctattagcaaacagagtgtagagcaacagttcctctcaggcattgctagttagagtgcaaaagggtataacctgtgtaaagggaaatttggcattagttaacaaactatgtgtctatttccttttctatctttctacatacctatctatatatttacttaccagcaatgtcagttacagcattcaccctgaacatacaccttcaactgtatgaaaaaacgtggacataaaattattcactgtagtgttatttccagtaaaaaatactggaaagaatctaaatgccatccatagatacaatcaatagtagtcctttgtgtgaacaaccaatatacacatagaactactattcaactgtaataaggaatgaggaggatctttataaaattatatgaaataattgccaggataaaaaagcaaggtgaaagagtatacatagcatgctaacttctgtataaaaaggaagcgtatgtatatttgcttctttttataatgaagacatgaaggataaaccagaaactaatgaaaatattttcaaagagcgtgagtaaaaatggagctggaagggtagggatggagtgggactttcttgaacaatttttttttctagttttgacttgaaccaggtaagttttgacttgaaccaggtaagttttgacttgaaccatgtaaagttttacatattcgaaataaaaaatttaaaaaggatttataaagcaaaacctaaacttgcatacaggcaggacataaatggatctaatgatatatcacatcaacgtaaataatcacagaggaaaaaaataaattcaaataatttctgaagacagtattctgaatgtatatccttagtggaatattaggaaaaaaagaagtccaaataaatcttgaactttacttaatagattgattgtcaggaggggtattgatatagtaattctgaaactattttccgtgtactataggatagagcaaatgaatcgatacattaggatctcactgtggaataaaggagatacaaatatgaaatgagggaaagtgcggaagaatcctgtgatgttgaatttgaatggttgagttgtacatggtaacatacatgcatctacctatctgtctacttatctacctatctaatctatctaatctacctatcgcctagcggcaatggcaccccagtagcaatgaacccacctagcggccaaaactttctttctaaattccattctccagtaaagggagacagggcttgactgattcttgattggggtagggaaaatgtaaggtaaggttgatacatctttttttactccaggacatactcaaagactgatggagatatgtcaaaacgacataggaactagcatcaggggatcccactggctaaatgacagacaatttgagcctcacaaaagaataaggagctaagtatagttatatcattttgtggaacttcattgagctgtgtgcttataatttgtgtatttttttgtaggtatgctgtatttcaatatgaaatgtagtgtctttttttaagaaagctgtgatacaagcagcaaataagacatataatttactttagcagaaaggaagaccgtgctctatgaataaattgttctgattacactgatggtcatccatcctactatggaaacagaggtggagacctcttttggtaagaaacaacgtcagcccagaaatgtataataatacaaagagaaaaacatcattaggcacaaatcatcgatggacaatagaacccatgagtgaaaggttcttgggacacaaaatagttacccagtctcaaagtatcaccccacagatactaatttcaaggcaaaacaaaacacaaaacaaaaaaaaaccttaaaaatggagtgacctgaagaatatccaagatgaaacagcatcaccaaaactggcacaaacaaattatatgactctgctgtgatccactgtgaagcaggcaacattacctagatagtactttggcctacaatgaggaacaattggacagatccacattgtgtggtattccacaatcactgggtcggaatcttcaaaaatacagactcatgaaagagaaataaaaggcaggagaatattctagattaagagggtccaaagagacaaaataactaagtgaaatgtgtaatccttgattgtattctaaaaagaaaatggaaataaggaaaaagagacattacaaggtatgagggacattaatggaaacatttgaatatattagattacatatcaatgttaaatttcatgtggagagtgataacagtattatgattacatattcatcttaggaggtataaggtgaaatgtcagggggtaatatgatatctatgactgaaatgcaaatgattttttaaagtataataaatgagagaaaaaaagccaatgaacaattacaacaaaatgttaataactggatcctcaagggggaagagtaattgggatagactgtacaaaaattaatcaaagataactagcatattttgaatgctcactgttgtcaggccctatttagagaggtttgcaatactaactcatttaatccttgcaataactctatgtgattgataccacatatatccattttacagacaaaatggaaacctatagaagtaaaataacttgcccaggctagtaagtggagtagctggaatttgaagttaataaatttagagtcaaagtttattatcatatccacaatactactctgcccttcaaataaataagtctgtttagaggagcaaacacattaatcacaccaatcttatgattacatgcaactgatatctcctgtgtgcctaatgcagaattctggagggttcaattggttccaattagttctttttcctgtaccagaaaagaagatcagcaataactggaattctggggtggcatggagtgggggtgttaaattttacaaacacagcatccaaaaatagtatgttcagtcatgagtattatctttaaaatagagaatataaagaaagtctgaagatcaacatttaaatcaaagaaaaaagaacaaaagtacaggtgctttgaggtttagactatgctgaaaatgccattatagagcagtccatttcctcagtaggtagccccaaaagacccctgacacagtagaaattatatcattatacaattaatcagttttctttcacaatggcacaatggggtgccctctttaactcaacagagtaaccagctcaccaacagtatctagaaaagaggaaagtcacagaatggaaaaatagacacaaaaagctatggagaagagagactgaaacagacaaaggcggttgtactataaaagaaagcgagaaatggaaagggaaatgtcagcaatctaaggttaaaagagaaaagatcaggatataaaaagatgtagaagtctcttatgaaaaaaaaaaaaaaaaagggaggggaccagtgaagagatagaaatcatgaccagagtcgaagcttgaaaacgcagggcaacacacaaagagaagctgtaatagcagagccattcactcaatcattcatttcactcattcatttaatgcctaacatatgaagggtactttgtggagctttgagagacacaaaaatgactaagacaggacccctgccctcaaagagcccagctgttccaaatattctcattttggtatgctccaatttttaatgtaattttaattattgttgtcacaccttagctaatattttcatactcaacatgtacttccagaaattgcagcaactataccatctataaaagagggtaatcttggcagggagcggcggctcacacctgtaatcccagcactttgggaggctgagatgggtggatcacgaggtcaggagatcgagaccatcctgcccaacatggtgaaactccgtctctactaaaaatgcaaaaattagccaggcatggtggtgtgcacctgtattcccagttactcaggaggctgaggcaggagaatcgcttgaacccggaaggtggaggttgcagtgagccgagatcatgccactgcactccagtctgggcagcagagcgagactctgtctcgaaaaaaaaaaaaaaaaatgagggtaatcttaaatggatggcagctgccatacagaatgagttcattcgttgtggaacggaaacatgtttacatttctgatatgctgatagtatataatgcagtattgtgatgtggttctctgtatatatagatgctgtctatactttttttggatacagcacactccacatcattctattttatttttatcatcccattccagagaggaggcaaaggacaaggaagtctaaaggatgtggaaagacaaataaggaagttaaaaaacaggttttcattttctttacaatttcccagagggcttctatgacaaaaagctgtactgaacaacggaatgcgtatttgtcatagagtagctgagagtgaattctaggtaaacatacaagggagaggctcctagacagataccattgcctagtacctttcatttaaaagatacctagtgatatatgacttgggaaaaccagaaattgacctcccagcctgcctcagtatatggtctttgctcttaccaaggttggcttgctccctgaaaagacctgaaaattcaagtttgaaaaggtgtttcatatacctaatttagaacacacccctcctagatctataagagtaggtgagaagcatagaaatgaacacctattattttgaatgctcatcttctgattcctttaatgcactgtcccgccctttaccctctccccaaatctttgtggttcttttgggatttcaattgaggtgccccatctctccgccagagataggaatgtgactcaatctaaccaatcaaaatcttctgggggaagtgtatgaatctgcagttagagagaaggctttccgagatcttgggcacttaaattcacataagtctgaagctgcttagagatatttcttcccccaccacaaagactgtgactgaagaaaagatgaagaccacatggagaagaggaggactgtgaggggggtgagagcagaggcgaatttatcctgaagctactacatcttaagcttacaggtctttctctctttttttttttttttttcccagacggagtctcgctttgtcgcctaggctggagtgcagtggcgcaatcttggctcactgcaagctccgcctcccaggttcatgccattcttctgcctcagcctcccgagtagctgggactacaggcgcccaccaccacgcccggctaattttttgtattttttagcagagacggggtttcaccgtgttagccaggatggactccatctcctgacctcatgatccgccggccttggcctcccaaagtgctgggattacaggcatgagccaccatgcccggcccaggtctttctctagcgatgtgttcatatggtcatttataatcttcttatagagaaggctctccaaactgtatgagctttgggccacaaaatcctagattcacccctgggagagacagttgtgaagatacaataaggcacacatagccacccataacagaagccagtgtcaccccactggacctgcaattatgtgagccaatattcaccctttctttttatcttgggataatccaaatttggttttacccacttacaaagggaagaaaccggagattttaaagatagaaataaagtcatggctcgtaacttgctggcaggaaaaaatgagaaccaatgctgtttttgactttcagagtatctatcataagctatcattttgtttttgtccgcatttcagtatgtggtttaaaaggaagttccaacatcatatttgtaactagttataaggaaccggcagggaacagcctccagacatttttcaaatatatttttcctttaactggctataaaggacaataaggattaagttggcaccacaaaaagtcgcatttaatgatacccttttgtgtgttacccatttac

SEQ ID NO: 345 - DNA, 568831 bp, Homo sapiens
cttcttggcactttgacttttccttatagaggttacagtttttgtgtcttgcattacgtggttatcgctgagggatgtagtagaaactacatggatggtttggagagttagaaggtttggatttaaattatagctctgctaattgttagccatataatcgtgtactggttacttagcctctctgaacttccaattcctcatctctaaaagagtgtaatagtatctttcacataacatgattgtggaaggtattctatggtcagtgtagtaaagcctcaaagcctgccatgttggccgggcacggtggctcaggcctgtaatcctagcactttgggaggccgaggcgggcaggtcacctgaggtcaggagctcgagaccaacctagccaacaaagcaaaatgctgtctctactaaaaatacaaaaattagctgggcatggtggcatgtgcctttagtcccagctacttgggaagctgaggcagtagaattgcttgaacccaggaggcagaggttgcagtgagctgagattgtgccaccactgtactctagcctgggcaacggagcaagactccaccaccacaaaacaaaacaaaacaaaacaaaacaaaacaaaacaaaggcctgccatgcagtgccactgaaaaatgttatctttgtgtgtgtgttgtttttttttttttttaggattctctgtcaacccattagctaataatgcactcactgtatttttccttttatttctccaaattatgacctatggtagacccagtgtttgctgactggctaaatatgttttaagttctttcagagaagaattatagcacaaaagtcccaactatttctatgacttttcagatcagttgccagtcagcctccagaaagactattgacttgcacagtcattagcagtatgtgaatctacttgtttctctgtgcacttaccaggatttaattttataacttgcatttgtctttgctaaattaatatgtaagaaatatcttattattgttttaatttgaatttctttgattactaaaaaaatttcccaagtagtggtttattgtttgtgtttctctttatatggattgtcatatgacaatatttagaaatagtctgggctgaagacgcttgatataaaagggctaaaaatgtttaatgttttgagctgcttaaatttatttatttgtgcattcattcattctctcagtctttattgagctacctactccgtgccaggcacgtgctgcacatactatgaagaaaaaaataaatgaatgaaaacagtgacttccaacctcttcatttaacatgtgtgatagttgaagtctagaaaagtgaggttaattacccagggccgtacagcttgttcagtagcagagccaaccatttatttgaacagtaatgattttaaatgttttgtgtccatagccttttaaaccatggcgacatcctggaaatttcagtattgtgatgttaaagaacatctctaaactgtgtctacgttgaaaaatcagagtcctgatttttggtttagaaaacatggtcacctggttcttcagttgtaaatataattccttcctagacctctctaatgcttaagtctaaattcattcttaaatgaataaacttaatattaaaataagatcaggaagtaaatcccaagccaagcatttcagaccagttgtgaacctcttttgacatgtttttggtaaatgagaagaactgatgacatatttccctatcaaataaaatagacaatttagatttaataaggcagttatcttcaggtaataaaaattcaactaacttgccataactatcttgtttaaagtcaattaagagcctcatatttctcacttgctgggtaaaatttaatagaacttcagttaagcatttattgcttatttaattcaaaattaagttaatcaccacagttggtaacaaccactgagtatttaattaacattcagcaaactatcttattaagtctaaattagatacagacaagtcttgtttatccccatcagtttgcaaacaccacctcccccacctcccatcccaaggggcctttggttttcctacagttttccttttttgattcatcatttttattttcttctacttaagacttcacttgggtgaaagaggagaagaggcagcagtccatcatgttatagaaactttgggctcgtagtataactgagaaactttttcaatcttttcttttttcttcaatcctattctattaacatttcgtttttcaaaaggtattgagcacattctctgtgagaggcttcttttaaaccctaaggaagctataaaagaggtcattctgacatatttggttttattttctcatcctagaaatgagaggattgggtttagtttatccgtgtaacacgtattattggcttgcagtgtgtaaggcacttagctgagtgtttggatacaccttgattcagacaaggcccctgctcttaaagaggacacagaccagtgtgaaagctgcaaagttcagctgtaggaacatgaaggtcctttagaatgctgtgattctgtaagacagtatttcccaaagtgttaaggctgttttattaagaaaagggtcctgtagccaagtaagtttggaaaagtccaagttaaacaaaattaaggaaatttcagtattgtgtatctttaccatgggattttgagactttaataaacgaatgcgcattctgacctcccggaaggtttgtttcccaaagttatttgatcatagaacccctgcaccccactactaccctttgtaccagagcatttcctgggttcagtgatgtaatatgctttggggaaagctgctgtgggccgtggaccctggccacgaacctcccacagcccagaaggggtactcagacattcaccctagtaactatgatacagggtcagaattctactttgtctgaaagttgtgcacatagagtgggtgattttagacatagagtcttttaactggagtggagggtatgtaaccaggacagcctttcctcatggaggagcgctgggtctagcgggagatagactgtgtaggcagagaggcctggagggttgccagagcatcatcgggaacagaataacagtgaaattctgacatggctgatttggtggagactccctaacacattgatataatgtagaccaatttttattatagcctgaatatggagaggtaagaggcaatgaattttttggcgcagaactttctgccttcggctttgttccaactgcgtgactgcccatctgcagaagtgattgttgattcacgtctgtaagacattttcattctcatgctttgtttggggcagagcctctgccttgtgaatcactcttatgagagggagtctcagtttcttttcttttcttttctttttttttttttttttttgagagggagtctcgctctattgcccaggctggagtgcagtggtatgatttcggctgactgcaacctccgcctcccaggctcaagcaattccactgcctcagcctcctgagtagctgggattacaggtgtgtcccaccatgcccagctaatttttttgtatttttagtagagatggggtttcaccacgttggccaggctggtctcaaacttccaaccttgtgatctgcccgcctcgatctcacaaagtgctgagattacaggtgtgagccaccatgcccagccgagggagtctcagcttcttcatcaacagcatcattctagtcagtctagtttccgtttaccttgtcatctaccacttcctccaacttaccttccccccagcttctcttattctggtgaatcacctgtgtcttcatttttcattcttattcatctgaatcatcttcttcatctaaggcaaggtacccttttatatcttcctggaaagacatctacttcatttaaaataatgctaccaatttcctcccctctggtagcaaccagcagatggaacatgctagatgaggtagaggataatctacaaatctggtctgccatatcatgggagatttcacgtaacagtgaattctttcagagcctctcagcaataccttccttgtttttcatatctgtatcaaaaggaacactggcaaacctgggttgtatttctcattccattttgggcttgaatttttctgagtctgagtctcagtttatctgtgtatgaaacgttagggttacgctatgtgtactctcagggccttttaactagaaaatgttgaatttgaatgtttactaagtcaacacaagctgcagtcaccctggattgcttgatcctccatgtacttttgagcctggcagtatgaggaaactcctgcagtgagcatagttcatgcctacacaaagtaggcattccatgaatattggttctcttccatcctgactgcttctggattcattttctttttattgccattgctttttagtcacccaagcttatctctttcttgtctacaccctcaatgctgtaaatcttcctttctcattctccatctggatagcttcctctctcctcacctttttcccttcaggctatgcctatggatgctgtccactctgaaacctcccaaagacaaatgattgcaatggaggcacagattgccgggtggtggtcctggccagctacaaatctttccaagagattagcaccatttctttatggaatcatattgttgttccatgagtgagaccaagtcttatcctcaaggatcccataatggaggtgagatgctttctttttgacacttagtggaaacaacagtccatgaggtatattatcaattggaaaggtggggtttttgctttctaggattgggcaatgcactactaggttctcagcgtggattcttgagtatctaggaaaactggtcatgtggaaagcttaagcttattttgcaggccttgaaaagacagcctgcatgtttcatttcactctctacccgaactgacacttcagggatgaaaatgtcagcagacagccagcaagtagccgactagagggcatgatgtgggctggtggtgcaactcttcaaggatgatatgccagagagggcagaacacagttaggacaaggccaaggatgtcattcccatgtggagaggccattggtaacctcggcgaggtttggttcttctccagtagagattttcagaagctaagaattcaccttgagagtcctttttgcttcctcttcttttgtattaaacaaactactcacctctcagtctttgcctttagtcctttggctattcctggttagataggcccaattccagaagcatctggaaaactctgctctaagtatgtagtgcttaagggccagagctctggagctacactgcctggatttgcattctggcctgccaaaaatacctcaacttgttgctcagtatttttaggcctctgttgcctcatccataaaataataataagaaaattacttatcttgttgtgaggattaaatgagttaatacatataaagcccttagaacagagcctgacatgtgataagtgcccattaaatattagccactgttattatgtgttacccttattaagtcacaaaatggcgatttggaaaagataatagagattatctaaatgattgtgttttttttgttattgttgtctttttaaataaacttttaattttggagtaattttaggttgatagaaaagtaaaaattgtacagggaattttcatatactactcacccacttgtcctcatttttgatgtcttacattactatggaacgtttgtcaaaactaagaaactgatgttggtacattactgtgaactaaactccaaactatttagatttcaccagcttttccactaagttcctctttctgttccaagatctagtccaggatacccagtttaggatcattttaaaactttcatcttctttaatatttatttacttatttttttgagacaaggtcttgctctgtcccctaggctggggtcccccacttgtgtgatcatagctcactgcagctttgaccttctgggttcaagcaatcctcccacctcagcctctggggtagctgggacaacaggtgcatgccaccacacccagataaatttttgtattttttgtagcgacagggtctcactgtgttgcccaggctggtttcaaacccttgggctctagccatcctcctgcctcagccttttaaactgctgggattacaggtgtaagccaccacgcctggcccatattccttaatatttagagaaggattccttatagaaaagcctattacaggtcaggcgcggtggctcatgcctgtaatcccagcactttgggaggctgaggcaggcagatcacctgaggtcaggagttcgaggccagcgtggctaacatggagaaagcccatctctatttaaaaaaatacaaaaattagccgggtgtggtggctcacgcctgtagtaccagctactcaggaggctgaggaaggaaaatcacttgaacctgagaggcagaggttgcagtgagctgagattgtgccattgtactccagcctgggcaacagagtgactccgtctcaaaaaaaacaaaaacaaaaaaaacaaacaaaaaaaaccaacctgggcagcagagtgactccatctcaaaaaaaaagtaagaaagaaaagcctactatgacgtataatgttgtaatcatgtaatctggagcagctgcggatgaagtcgagcaggatgggacccacctttttttcttcccctgatttatctccctgaagggctccagcaaagcagggcttaaaagtcactgcattgagtctccttgttcttaggggaagagactgaggcccccaaaagtgaagtgacaatgctgggagaagctggaagcccagagaagatcagaaaaggatcttcaagataccttgatcctgtccttgttgaataaatgagtgagcaactatcggggactcccaaaaattagggtttggatccaggctcctccacctttcccctcatttttccttatctgtaaagtgggttcactgatcagtaatgtctcataggacttaaccctcacaaaatgccacagttttaccctgtgaaagttaagcaaaccgttgtgcccacttttagcacagcctggaacgtagtaggttctcaatcaatgtttgaaaaagaagccttgaaaatcaggaaattctccccttagaacttatttcaagaagattgggacaagctggtgcaaaacaaagaagagttattcatgaggaaatctgtgacactcaggaatggaaccagtgtttgagtatctgataagcaggatatactgtctgtttttattcttggaggcttttatcatacaatactacattatgttacagtctgactttcacacaaattggatcccaaaacttcttacaggaattaaaaatacaaactcgtgggcagtatgtgttttataaattacagaaaacagtagtgtaaagacatggcatagcaagtgcagcgaagcgtgcgcaggcattgatacccgaggaacgcacgcatgaggcagcagggaaggcacagcatgctgggtgaggcagcaggtgcacagttctgtccctggagcctggagagatgggggaggagggacatctctagctgggaggctgggtgaaggagctgaaccctggagacataaataccctgtatatcttccttatcctgccatttatggtcttattgaagggggccagctgacttctgaaacctcatctccattgctttccctcactcttgtctttgttgcagcactttctgcatttggattaccctgccctgccatcattacctgtttgaatccaattgatcttcaaggtccagcatattaataccacctcttccatgaagcatgccttgatttctgcccatcccccctaagcaggaaatcatcacttcctcttatggttccatggccctttgtctgtactgcttgcatggcactgatcacttcttaccttctcttgtagttatcaatatgctcgtcttattttgggcttttacttctttaggaccttctcgtctgcctggaacttggcaaacagtgaacatttgttggatggatggacaggtttgacactgctgacactagactcaaatttagtttctttagagtagaattttattttattttatattttttgagtcagagtctcgctctgtcgctcagcctggagtgcagtcgtgggttcttggctcactgcaactccacctcctgggttcaggcgattctcctacctcagcctcccaagtagctgggattacaggtgcctcccaccatgcctggctagttttctttgtatttttagtagagatgacattttgccatgttgcccaggctggtgtgaaacccctgacctcaagtgagccgcctgcttggcctcccaaagtgctgggattacaggcgtgagccaccacgccccacctagagtagaattttaacttgcttatctttacatctcccatgctggcactgagaaggtgcacattcattcatttcacaataaagtttcaggcactatttcagcagtaaacagtccatttgttgatagttaacacagagaaaatagtactcattgggatgtgtttttatacttgtaaggtcgatctggatttgtttgtttgttttgatatgtaaggaccaagaaagaaaaggtttgctaatctacgagtatttctggtgtagaatgcaaatgctctcttattccttcaactggctttatactaaaaagagatcactgggctcagaaaggtcctatttttcagataatacagcagttccttactgacttgcctcaggagtaaactccttttccaatttttaaaaggatagtaccaggatgccactgtgctcatagttgggcttttttgtacatgttaatttttttttttttaaatatagtgacagaatgcataccactgaggtggtaaatggaaaaaataagtgcagtggagtatactgtctgtttcttggggccttttctattaatcacaggaggaagcatcagacatgaccagatgagagagccagatgacccaagttcatgccagatcaaaatcagaatggcaaaattgggaggagttgatgctgttgaattgagaaagcataaggttctcagagtgatagagctggaaggatcataaaggtcatctagtctaatggttctcaaactcgaaggaacattagggtcatcctggagagtttactgggccccgtctcagaggttctgatgctgtaaatcaggcgggacccctgaattttcatttctaagaagctcacaggtgctactaatgttgaagagaacctatgatctagttcaacttctgggatttcttgctttctttcttttgtaaaaaaaataaataaataaatttaaaaaagagtttttgaagatggggaaatgaggcctggaaatagaaaagatttgcctagagtcacacacactgtcaggtcaggtagagtcaaaatcaggcaccccgactcacagactgcttcacattgccatcagagattgtcctgcaacaatattatgtttagttctactgcagaatgataactggatcttaccccctttgcctgatctggccacaaacttgtttttcaggtctttccattaggctctcttcagctaattaaaaaaaaaaaaatcagttaacccacatttattgaccagtgctgtgtgttcacaactgtatttagactagtggtatagcagtgcagtagtctgaaaacattttctcatctgtaaacaaagacagtcatacctcctaggactgcaagaagtcactgaacatatacctggcccttagtgtacacattactaaagagaataagatgtggtctgcaccctctcatgcaccagtggcttcttgagcagtatgatagagagagacagctgagatttagtggaaaaacacaaggcttagaattgggagagctgggttcaagccccagctttgccactaaatggctgtgtagtcttgaacaagtcacctgccctctctgagctataatttgaaatagacttagcttaagcaacaggaaagcagtaatgagctagaggaaggatagaaattgggaagaagtataaatctgcttaggagatggcaagtttggggctgaggtggaattgatctgagggagagacctggtagaaagagctaggcagtatgaggctgagtgtctgaaggggtagcaggcctgggggtggtccagtgatggttgaatgggtgggccagcccagcgaggggatcgcctgcaatccagtagagatgccctcattttcatggcagggtccccctgtgccagtagacagacccaggcctgggaaggagggctggttgaagtgagatggataccagtcttggagcatggttggagaatctgtccagggtgatggcatctgttttggattggggccttgaggcacattttcagttctgctccctggaccagcataggagggtggcagacagtacagtgatttgaatacaggattgatcctgccaccttgatttctgcctttatttagcggcaaagacactagatcagaaaagtactggatgtgattgctgtagtctttcatgattgatttaggagctgggagaggcctggctaggagttggaggatccctgggaagatgaagattaggtcttacgtgagcctcagccctctcctctgtaaaatgggagtaatgatggtaattatgctgatgttacctattctgactggagtaaggattaaagtacttgtctggaggaaggcacttcatggttaaaacatgaaaagagaagtgcacagtgtttttattacagggaaacaccaaagagctggaaaggaatgagggctggagagatggagctgccctgaggactctgggaggtcatcctgggggcagaactttgacagttgctgcccgaggtgggacagggatgctgggaagatgtgacgatgtgcataagtgtgtcatgttcaagatggttctaagccctggccaattccatacatgctcttttcctttctcatccatagaggttttggcaaaggcatacttgggagtgttgatatagctgacactgcagcaccctcagtttacaggtgtgagaagagtgaggctcccacagtctcacttggacaggtagtcagggctctgatggagctcctggagtttctaggttctctgtcacttgatagtcagtgctgggagggacctcagggaatcagccaatttcacagatggggagagtgaggcaggttgggaattctggccccagtggagggcaccacatgcccacagggaaatgtctttcccagccccctcctcatgcttctcctcttttctgtctggaagtcctagttctcctcctcacgctgagacccaggtagggtgattgtccatgtttcttcatttatctgttttttttctgttgcccagggactactctaagcaccatgctggttgctgactgttcgcttttgcaagatcttggaatctctgtttgttcacatcacaactcaagaggatacgttctcattctcccaatgtttgtcttctgcccattgcatcaaattgctcttccttgtttggaattaaacttctagcaatcatttacctttatggttctcttaacttcaggtcacactgttgtttagtcaatgtgagaatctttcagatgttctgcactttgcaaaaggatattcacagccaatgtgtgcggcagtgaaggacacttgttgattccttatttattgtctgctgttccagggaccggggactagaggtgaataaagccttgtttgggctgtctaggatgttgtgatcgacacaggaaacagacatgaaagccaaattggcgcagtgggtgaagtattgtaatactggtctctgtttatgatatatggaagaagtttcctagtagcagggtgggtgagagagtccatcatcattgcagattggtgcctctgtggacatgcaggtatattaggccagaggtggggagtgggagagagagggagagagagagcacgacaaagagagagagagagagtgagcaagagagagggagggagagagacagagagagagagagagagagagagagagtgagcaagagagagggagggagagagacagagagagagagagagagagaggttttgagagcattgatatggggtctacatattccccccggcccccattccctattatcatagaagcatgctgccctccaaggcttttgaatttgccaccgtgaagagcatgcatggaatcttcggctgtggccttgcattgccccctgtcttcgcagcggagcttctttatctgacccgtgcatgtgcctctgatgagcagcccttcatcacagctctgcggcctcctcctaggcccccgccttcagctctccagttcatttcccgccttgttcccattgccacctgcgggcttggagggccacctgacattctgtcctttgggtcccctgtgactccagagctccttcccttctggggcgcccacatctgcgacacgcttgtttgcccagtgcattttctacacttagagttcctctcgtgctctcatatttccatttaaagccctctcgagaggtctgtctcctgccagcagcattccttctagtttactagaactccatttctcatcctgccaggaatccagccgtggagtgagcttcagcaagcctctctgcagtctcttgtctgctccaaaactgtggcctctggttgtgagaaatgggcatcctgagtcagtgagagcagtagttagcttgcagcagcttcccctctccccctgagtgagcctttcttcctcttcctcctctttcattcagcctcatcctgccttgggtccatttgacagataatggcaccttgaggccttgtcttttgcatggcatctgtgcctgactggtcagaaattacttgtgaagcaacatagggggttgttggttgggtccacttttaggatgaagtcagaagggatcgtgagtgatgcttggccaataagaatgtattgatttgatttactaattaatttcatttccagacaccaatatatgcatagccttgtttgaagaaaattaaggagaaccattttgtaaatggcaatgagtgtaagacacttaactatcttcctgctctccctggcgtgggcttccgcgctccctgactctgcttttatttaaggtgtctgggaaggcatttgtccttcggcttcccagctggcttcttgccttctcactcactgcctcccgtagcctgtgggcagaatccctcaccgtgcccaccttgccctgctctcgtctgacctcacctctgtttccaggatttgctatggctgtcccctgccagtcatgctctgtgcttgctactctgagtgtgtccctggtcccactctcttgcagcctctgtgtcttagcacatgctgccctgatggcccaagggcccttcccctttgtttctgtctggggaatgttctgtctcctctttcttgaacctccttatattccctcaagaagacttaaggcaaaaacaaacctgaacttactatgtgtggtatttttgtgttataagtgtaggacctagtcatagtaacacatttcaaaaatatggaaccgtataaagaaaatgagcatcactcataaatcactatttagacacaagcattgtttacgtttctaatattctttctttagtggtgcttttcatgattttatgtgcatttgcattttactgactaaatattactatataaacattttcatatcttgccacttcacctaacaatacagcacaagcagcttctcatggcattaagaattgtttgtacatgtaattttgaatggctgtatgctgtttcatcttaagaatataccataattctaatttttcatcattataaatagcactgtgacgaacatccttcttaacaaaattctttgtctgcacctatgattattttctaaggtagattattagaatttgaaatgccttgcacaaaggacagtaactttttcacccttagtttcagagagaacatgttgtctctggagaaacacagaaacatgaaaaagcacaaagaagaaaataggcctggcacggtggctcatgcctgtaatctcagcacttttggaggccgaggtgggcggatcacgaggtcagggattcgagaccagcctggccaatatggtgaaaccccgtctctactaaaaatacaaaaactagctggacttggtagcgcatgcctgtaatcccagctactcaggaggctgagacaggagaattgcttgaatccgggaggcagaggttgcagtgagctgagattgtatcactgcactccagcctgggtgacaaagtgaaattccgtctcaaaaaaaaaaaaaaaaaagaagaagaaaataaaaaccacctgcagtcatttgcaacagccagtgtgaaatttgctacataattgtatctgtgtatctatctttctaccctacaggttgccaaacattttctgtaaaggactgggtagtaaatattttaggccttgcaggccatacatggtctctgtctcctcctcctcttgtttccgctgctgcttcaagattcttttaactatagaaaaattatttctcgctagtaagctgtataaatatcagttttcccacctggttctagcctcaaaagtggagcaattctgtacatactttgaaagcaatgtttaaaaatttatttaatttaattaattaaaaaattaattggttactttttagagacagggtcactctctgttgctcaggctggagcacagtggcatgagcatagctcactgcagccttggaaatcctgggctcaatcaattcttctgcctcagcctcccaagtagttgggactacaggtgcacgccactgcacctggccatgtacatactgttttgtaattgttctcttccacaatttaactacttcatcagcgtcctcatagttttctgttttaggcaacccagatataattactggctttctgctgggatgcccacagcactttggccagatctctgatatagaatttaaggcacattttattgcgagtatttgctgagatgtctctttcttaagtctaactcctcgtgagtctttccagcctcagcacatttcctgagtggtgcttaatagatgctcagcaaatctgtgtggaacgattgccttaggctgcaagtttatcccttcacaatgcctacatttagattgcaactccaggcttgctccttgggccagcagcatcagtatcacttagcacttgttaccagtggagactctcggtctcaccccagaatctatgtctttaggtgttgctgaaagtttgagaagcattactgtagagctcacctctgctatattcatcatgtacttatttatagtcatccctacctcgttcttttcattggtcggaacttcctgtgactagaccatgggtattccttaattgactgacacaatttgtttcacatacagcaccagctgccatctggcctagtgagacctatgtggctgccattgtttttggctgggagtggttgtgatagatagaggagggagcaaatatttaattagcacctgctatgtgccaagtcctgtgcccagctctttacacacattcttccaagggtgagacatgatggtgtttgctgaagggaacatagggatctttaagtccagtgatttttaaccagctaaagaattgaatatatatatataacatatgcacataatatatatacatatatgtacatatattatatatgtgcatatataatatatgtacatatacaatatatgcacatatataatatatgtacatataatatacatacacacacatgcccagcccttactccagtctagaatcaaaatctctgagaagtagacctggtcaagagtacttagagaaaattccctcagtgtttccattgtacattgctggtgaaaaaccaatggtctaggccagcatcctattgtacagatgagaaaggtgaggcccaaagaggtcaatgagcatcccaaggtcacataaatttaatagcaaggccagacctagattttgtactatctgcctgaggacacacttcacattacctgagctgcttctgacctgcagtgttggggtggaagtagaagtgggtgaagaggttgaactcttgtcctcggatctctgagcttgattgggcagctgggagtgtagaaaacaggcaccacgtcctggagtatcctttccattccccctccacctttgcccaccttccttatgtcctctttggggctatgattgaagaggcttgagacattgaagagcatcaatatctactgctctaagtgacccaggcagctgctgtgacatctggtgtcttcctttatctttgtagagtcatgggcagcacctgtaaaggcaggtgtgaaagaagctttgttctgattcttttttcactgtcccctctgtatcagacactgtcatgggagcccccggtcaacttcttgcttccagttgtgcccagccagcagcaaacagaatgagacatcagctgaagcttttcaaagacatcctgtggaagggcatacagacttcatgtagtggccaagggtgtgattagcactgattacgtggcaaagcggaatagaactaatgaccatgatagctgccatttacccagtgctcactgtgccaggcactctgcttgaatcatttcccgtaatcctgtaacagccatgggagggggtgggagtgggagggggtgtgctggggaggttttatggcctcccataagtggcaagctgggatgtgaacccagttctgcttgattttaaagtccatgaccttaattgtcgtactacactgctttcctagctggatatgtgcttataccttctaacctgccactgctaggaatttaagcaaaaagcccatagagatagactgaactagtgtgtaaggacctatggtagcagatgtcaaaaatggagtggactgtatcaattggtataagatttccagttgctggaggtgttcaggcagggaccacggtacctccttgtgggagactatcaaatggaagatttgactggccatcgcagtgcctctgggattctaattcatcggggcttccaagatatgaatttgtttggaagattctgtcatagagcaataaaatgtactttgggtaaaaatctgtggatagggcattggtgaggctctgaaggatttgattttgcacggactacttccagcaccgagagtcctgctgctggggtttcttagtgcctgccatgtgccctgcactgtttggctctggctgggccccagatgtgagaactttcccacaaggagctccccatccaggagggaagggagagcatgctgtcactgaaagataaactatccagtgccagggagtgtggggagagagacaagtgtgctgcctggggagcttacacgaaggatgcattcaatgaaccaggaaatttgttttttaaatattggatttgaactgggctttgaaggctatatggcattcctttaggttgtaggaaggtggtatcgggtcaccatactgagctgtgtggtgggaaaagcaggtcggaccctaatgtgagccttgagtaataaggaattgaagagtgagcctcctgggcttctttttaaagtgaatagggctccggtaaacttttttttttttttttttttaggatagtagagaaagagcaggggtacattttgtaattcaataagcatttgcattgaggccactgtgactggagcaagctgagcccacctctgttaatgactaagagttagcctgaaggagatgtaggttgggcagggcctaccaggaagggggactggctggtgtaggtaaaggggcagtgcagtgtcagcacctaggtttcgaaaggctccagatgctgagatggtgacagggtcttggacgtaagaagagagagctatgaaacacaggcacaggtacagtgtgaaattttggaaatccctaaaaatgaagccaatgggagtgctgctgtgaactgtgatacgtgtttgcacctggccactggcatatcttctatctctgtttgcagagacgccttctttttatacttcttttgatggtagaggaggaaaggacttgagtcttagagccaaggaggcctggttttgaaattgtcctctgttaatttacagctctgtgacctcgagaatgttgtttctcctccctgagttgcagactcttcatctgtgaaatcggggagcgggcggggtggggggaatattcttaccctgtagggcacaggttgcagggaaggagagaatatccactgagtccagtaaatgcaagtcaggaacattaatcttcttcactcgctcttgttttatccagagtagataactctgttttccccctatataccccacagtttatagagtggataactctcttttccccctatataccccacagtttatagagtggataactctcttttccccctatataccccacagttcatagagtggataattctcttttccctctatataccccacagtttattgcgtggataactctcttttcccctacataccctggctgactttgtgcctttgcccgtgtaatttctaccttccagaaagctactttttcttcacatgtttcaatcatttccatttgtttgggtcaagcctctgcatggttccttggacactctccctaggaatcccaacgggcagcggcttcccttctgtcgttctctcatggtgtgggtaattgttgacctaatgttatgttttgtgtttacacccctctcacctgtcagctgcctgagatcaaagttctgattcatgtctcccctctctgcagcactcagcatgaagcctggcacatagcgggtgcccataaatgggtcttaaatgactgagaaaaagaagcgatcaggctgacaactggcatttccctggctttagaaacctgagagaagaaaagctggtgtaggaaaggagtgtcaggcctgcggcttcctatttcctcattcagggcacaggttgggcttgcccggagccatagttcttgagacttaaccacctcaggcctaaatctgccttctttaattacctcctttccagggaacaggagtccttgttgtctgcccagagctgctaaatatagctccaacccccaggccttggtgtgcttctgggccacagtgctgcacagcctgagatgtctgttgattttggggtttcctcagggattctttacattttcaagttttcataagggactgcttcttattttgaagccagcaaagagacttgaagggcacagagtgttgaaaattttataggaggatgctaggagagagttaaagagcttgggtagagaaggggaaagagaagttcttaaaagagggctaggtggcttaaaaagacgaccttgtcatgcatttaatgatcttcaaaagagtgacatcttgtaatggttttcccaggaaagccccttcacatttgacttttgtgacctcttggtcctgctgttggcagttaatcctttctagcttgaaataatttttttctaagtttttttttttttaatttaaaaggtgctataatacaggcttacagtaaaaataaaataatgcggaagtgtttacaataaaacagtaatttcctgtcccatctcttcccaaaccggttccattacccatagtcaaccacttgtaaccattttttgtttttgagtttttttggtggttactatcatatttctaaataatatgcttctgtctcatgcttgagttactagttttagatatgcctattaaactttattttatgataggtaaggactatttatttatatccaattggtccttcccagttctcttcccaagtcttgacagttacatttctacttttattctttgtggtttcctttatgtttacagaatatgcataaatctcagtcttttgctatatgaacttttgacagtttcgcttcactcactattttgtaagatgaagatattagagtttccctccacttttcctctccacatttacccttcaacttgtcaataatgttttaggttaccttttgcatctcgagggtttataatggatacatgcatataggcacatgtatatattaatggttttatacgtatagctaagtcatctgtgctctgtggtttgattgcaaaagctgaaaaaataaataatatttacattatgatttctaggtaaatattgcttaatacagggctaagtcatgtgctgtggtttcatttccttttctggggttctgaggtcaccacctttaagccacttataggagactgaactttcccttagcatcaaaatctaatagatgattgtaattttttctgtagttgttcagagtcattctacattttgtttattttatttctatagtaaatagataataaataagcttcttattataatttcttcttatttcttaaaattttaggctgtattttgtttttgttgagagaaaaaattagcattttctaccatatctcttatgtattctgtcgttctcttgtctgcttggagtctgttctgtgtgtcttcttcaagttccagcaactttttctcttattttggactggtttctccatatctgggctataatttcttacgcagtttccccctcttccctcccacaaagtttctaattgcttccttttatttaaacccctgtgtttttattatggtttcagatatttccaggctttcatggaggcattcttctggagctcctgagtaatgtcattatctgttagtcatcattattaatattcagaagcagatatgttattaaaatattattcaccaattttttaataccaggcagttttgtttgctctttcttttttttctctactgaatattcatagacattctagtttattttttaattcctatatatttaatagccactctcctagtccactgagtggatgtactatttttaaaatttagccatttacatattgttgaatgggagttattgccagttatttgctcttataaataatactcttttgaacatttttatgcataaagccttttcattaaattattttatatgaattcttcataggggaagaaaactggaaagcctgtgtcatcatctttgaggacatatgccagttgactacaatggtgctaggttttagtggggatcacttggcatttcttacttaagatcctcttttttccttttggaaaggagcagtaagaattgggaggggagtaccacctctgaatcagcacatttagttttcttggcagcttttggaagatataatgtattgggacttattgcaaagttggtactgcctagtaattcactgagttatcaccctccttaaaggagtccccaggggtcagccaacactccatgacttaggcccatgatgctcttgtcacctaaaatctttgtataacaattatttggcgaagtgttattcagcatgatcatctccaactggatcatcacccttattcactggaattgtttctcggtgactttgggaaaaaccagattcattcttaaaactcaaagaggaattcccattgagaatatgctacaagatctacaactgcttctacacgtggtatataaggaagggtttgaggaatggcaggttgttagaatgaatggactgctgggaagaaatacatagtgatgggaagcatggtaattgatgtattgaagatgctgcatcattgttggtcaccctgcaccatggtattactataaaacttcatcaggctagcaacatttactctatggttatggatgaaatctgcatcacataattacacaaaaataggatccttgtctttgaaaagcttaacaattcatagatgaacactgatcatactaaaagaatatgtacctgttgccctatggaaaagacctaagcttaatgactcacagtctaattattttggttagtgggtgataatgtattggaggtgatgatgagacacatacatccaaaatctcacagcttggagaggatgtggtccaacagtgctattttatttatttatttatttgagacagggtcccactctgtcacccaggctggaatgcactggcatgactgaggctcactgaagcctcaaccacctcaggctcagtttgtcttcccacctcagcttcctgagtagctgagactacaagcatgtgccatcatgcccagctaagttttgtattttttaatagtgacagggtttcaccatgtttcccaggctggtctcaaactcctgagctcaagtgagcctcctaccttggcctcccaaagcactggcattacaggcatgagccaccgcactaggcccataaggaagagtttctgagatgtgcgagagtgataggcaggccagggccctctctcaggatataattggggccacgctgtggtttctgatatttgaggaatttggaattctgatttatttttgcctaagacacctcattctctggaatacaaattccacatctataaaatgatagggttgtatctgatggcctgggctttgtaaacccttctgttctgagttccataactctgtgattctgggttctgtcccaagtccaagatgatttgaaaagaataaaaaaaaaagaccttgctgaatcagtaccagcgtcacctgcttcagtctggctgggaagtaggtcagaacttggcagacacgagaatgtggttggctccaactgtgagctctgccagggtcctttgtagacacctgccttagaaagggtctgtgaaagaggggggtgctgacactcggaggtggggaagggtttatttttggctgtagatgctgcaagcgaagaggggtgattgatgagaggaggtattgggggacagggaatgaaagactgaaagaaggagaggagcaggcacgtattgggtgcataacttgtgtggagaaatggccaatattttttttactcctcccacacacactgtaacgtaggtggtaggtgtcattctgtggattttttttttttttttttgagatgaagtttcgctctgtcacccaggctggagtgcagtggcatgatcttgactcactgtaacctctgcctcctgggttcaagcaattctccctgcctcagcatcccgagtagctgggattataggcatgggccaccatgcctggctaagttttgtatttttttagtagagacggggtttcaccgtgttggtcaggctggtcttgaactcctgacctcatgtgatccgcccgcctcggcctcccaaagtgctgggattacaggcctgagccaccgtgcctggcccattctttggattttaattatgaggagattgaggcttggagatgtttaggtacctgtccagctaggctgctggtaagtgagggagaaggagtcaatgtggggtctgactccatgtcgcctcttcctttcacgctctaactgtgccatgctctgttctaggcactggggatatagtgatgaaggaggcaggcaaagtccatggtctcataagtgcttgcattctaggaggcaagacagacaacaaagtaaacaggtgcatatttcagagggtgacaagcgctaagcagcagagtatgacagcagtagaaggcaggagtgacagagttgcatgttgtgtttttacatcctagtccataagattgtgcactgagatgagctgatctgaggaaaccaacagctctagagtaagattcttgaggttagaatttagccccggccataatgtgaaccaactgtgaaagttgagcaagtcacctccccatcattgttaaaatgaaggaaaataatccctgttcttcttatttcactagatgatgaaagaagatgaagtgaataagtttgatgtgccaccatttttaaaactctggttggggccaggcgtggtggctcacgcctgtaatcccagcactttggggggccgaggcaggtggatcacgaggtcagagattcgagaccagcctggccaacatggtgaatccccatctctactaaaaatacaaaaattagctgggagtggtattgcatgcctgtaatcccagccacttgagaggctgagatgtgagaatcacttgaacccaggaggccaaggttgcagtgagctgagatcgtgccactgcactctagcctgggcgacagagcaagactttgtctcaaaacagaaacaaaaacaaacaaaaaacccagttggttttaaaaatacaaggagctgtttttaacagtttggttaacttttaaaggataccttcttatatttatttgctacgctttgtgtgcttggaggaaacaactgtttctttggttatttccttattcttagaatgaagacctcctttgccatcttcagaagagtttggatttgatttgtgggcatcagaggaccattaaaggtgtggagccaagagctggcctttaggttttgccactggaagtgggtgaggatggaatggaggggcagcagccagtggtcagagagatggcttgggtaactgtggaaactggaatcaaattcagtctgaccccacagtttgattcaacacagcagtcaggtcagccagtgagcaaacactcactgaaggtccactgtgagccaggtggtggctgaggaggggaggcataggagacattgaatcaactcagccgttgctacgagctcactgtagctgagtgttctggatgctggggagtcatgtgcttccggacctcaaggagcatcttttccagcagttaatatctgttctgttcccaaaagcatataaatcaatgttgattttagtaggcaagttatccatgcagacagagagacgatatttaaatatgtataacactgtattgaaataactctaggtctgccagaggggaactttagttgctggatcttgaggaggtttgagggttcctagggggggattgggaaaattgggatggtgttaggacaactaggagcctcaaaacataaactatttggcaatgagtaagggaatatttaaatattttagcaacctgtgttgctatatctctgtgtactgatgaatgtcagtttctcatgtggttataccactatcttatagcatcctcaatgtagtacttgatgtgcacacaaggcacagaggaggtagcgattagaaaggcttcatggggttggtgatgcttgagttgggttttgtaagatgaataggagtttggtaaagaactttctaggaagaagagagatcatgggcaagaacaccagtgtgtgaaacagcacaggacttgactggacagttgaggggttcaggtctaagggattttgtgctcaggtaattgtgagcacagtcgtcctgttaacagcagggaagaaaggagaaagagcagcacatccatttaatctctcccacagggtaggggaaatatcaagatgagaccatttttatttttattttaaataatagctatcacatgccaggtgttaggcagttagcaaacattgtttctaatctgacagtaactccatgaagtaggaattttcattcttcactcattctacaggttaagaaatcaactcagcatatttaagtgacttgcacaaagtcacacaatggcaagaacagggtttgatctcagtctcatctgactacaaagtctgaacgttccgcttttccactgtatggcctctctctcctgggaatttgcagtgagtgacatccatgagaaacagggcccttttcttgcctagaaatgtaagttgtgacaaaaactggaggtgtccgtatcctgttctgcaaaacgaggacaagagttcttgctccaggcgtcggcagtgctccggaaagacgaggcctcagatgtactgctttccaataccttcagcaagaccattctcagggagatgtttctctccatctttccttgctgcccctgagactttgacttgactttttactcctgtgaaacaacctcctgatggtgatagaaagaataggctgaccacatggacattttgtgtttatgctgttgtgacagggctttcttagagtaaatcaataacatgttcctggttgagatttggcctgtcctataacttgactttagggagagaatgtgctgattatgctgaagatagcgtgttggtttgtgtgtctttcatgtttattactgtacaagaagaagttggcgttctggtacctcccctccctcaaccattacaacaaggaaaacaaaatccactgagaggcagcatagcatggcgatgaagaacatggactgtgagctagattgcctagattcagttcccagctctgtcgctgtctagatctgtgtctgtgtctcggtttccttacctgtaaaacgggaatgatgataattgtagctactgtacaaggttattggaaaggttaaatgagttcatatttctaaagtatgtaaaaaattgcctggcatacaacaagtgccatgtaagtgtttgttaagtgaggacaacaacaaaattttataaacttgccctgctttccactgttccttacaggacatgatatttgcacaagtctgacctctgttgtgtgtggtcaggcactgaagggtgacatgttcacatgtgtggtctggtggacactagttttgatgactgctttgccataagaacttcgctggctatgggaaaatgtgtggttgagaaatagcaagtagaaggttctttttttttttctgctagtaggatagagtttgggttaaatggcatttgcagctgagtttatccatttttaaatttttcctggagttacactgtgcagcctatgcatcaatggttttatctggctcgattagtcagtggatagtttttaatttgacttaaaaaattgggggtcacataaagggaaccagcaaaagatttggattctgatgaacaaggtttaaggctcagctctgccactgacatgctgtgttacatgggcaagtccccactcaccatctttggtcctttatgtactcttctggttctcattgtttcttccctgaaaaaatcagggtgctgaatggtcaggtgagctccctattctctgttggtgagtggccctcattcctggtcagttagccatgggctattgagggaagatgttttatgaagtgtattgatggtaaatttagacagcaaaagaatccaattgatcatcttaattttttcctctgtacttcgtaattgtgccgataagaagtcctcatttcagctttacaccttttctaatttcccagatatttctgtgtatcaccagaaggcagaatggatccaaatagttattaccactcagctcttagaagttgtttgggctggagaaatgttttcattattaggacactttctgggtcctctctctagagaggcaactgagcctcaaccataccatctcccaggctcactccgtcctgcccaatctgtttacatctctactttggaggcaagctctatccagttctactaacctcagtgcgatgactcagggaaaacctagtttctttttcctaggaaaatcaggttgaccacaacttctgtagttcttgagggaagaagggaagtataatgatgttggaagtcaaaatattgacattaagatagccaagtggagttttattatgtatgtatgcatgtagacatgattgaaatgtatattacaagctcatatgacatacctttataatagagaggtacctgtggattctaccttacttttgttagtgttttcactgtttcatgtgagttttacaatgaacctgtgagatttgcagagttaagagttatatacccgtctatggtagaaaacacaggttcattcagaggagtaaagtggcttgcttgagatctgtgtcagtggtagtcttctgactagtgtttcacagagttgttttgacctaagaaagttagagcctgggccagacgcggtggctcacgcctgtaatcccagcactttgggaggccgaggtgggcagatcacctgagatcaggagttcaagaccagcctggccaacatggtgaaacctcgtctctactaaaagtacaaaaattagctgggcgtcgtggcttgtggctataatcccagctactcaggaggcttaggcaggagaattgcttgaacctgggaggtggaggttgcaataagctgagattgcgccattgcactccagcctgggcgacaagagcgagactctgtcaaaaaaaaaaagaaagaaaaaagaaagaggctgacgaaatttgtgatttttgaagcaacagaggaaatttagaaagaatgaaacttacgccgttaatattaagttataccaaggatctactcataatataacccaagactagaaacttaaagtactgtatagttgataaagagaacgaagccgtagagagtttactgaatttctcaatgaagtggcaagcatctatccatccttccattcattttgtcatattattagaaaaaaatacacagcatgccagctgccatgttgagccttgattcatcaaagttaaattagaatgacatatggcagtttagcatttaaaatgtggctagttcgaactgagatgtgccgttaagtataacacaccagatttcaaaggcttagtataaaaagtaatgtaaaatatcttattaataaattatatgatgttcattacttcttggaatgataatattttggatatattgggttaaattaaaatgcatttctcctatgatttcctgctttttaaaaatgtggctgcaggaaattaacaatttcatatgtggcttgcatcttattccttttggacagcactattctagcttgtgtctagtagaggaagtaagatttatacggacatgcttttctgagagcgtggcatctcgcttctttactcctctgcctttatatttgtctctactgcctcaccttcttttggcttcttaacccattctggtcggatggaagttgttcttgtccgggtctagagggctcagatgcattcctttttagcagtgctcttatttggcattggtggtgctgtttctgttgaccactcccagtgtctctggatgttttgttattcctttacctccctagcctctccttggggtttctttgcaggctcttgctctctcttgtatcccataaatacaagcattgcagagctttgtctcatgactgctaggtgtttatctccagtttggaactcctgaacttcaggcccacactcctacatgccttttggacactccagttggaaatcccaaagttgcatggggctcaccgtgtcttttggcattgttagcttggtgagtgacatcgcccaatcctggaaactgggactcattccggatggctcctctctgtccttcactcttgcctctgactgtcctcagtcttacagagtcaaccacggtaacacgtcctgcccacttccctcctccctctacctttggagcctgtcctccattcaggccctcagcatctctctcctggagtgcttcagcagtctcagctggccttctttttctattcttaccctcatccatcctattctctcttttcttcctgagtgatattccaaaaatgcaaatctgttcatgctatgtccctgtttttaaaatccttcaatgctttcctcattcagggcaaattaagaatcctttgcatgaattaagggacaggaatggaaagaggcaggaagtggtttgacccctgcctctttctgtcctcatctcactaatctccaagatgatcttgtgctctaggaatatacctgggattctctgtagctcccgtgacctcacacatagtgttcccttgtctgaaacaccattgcccactctatcagtcctttcaagattttgctctgataccacctctgcctggaatactcctctgactgttattgtctctgcttcctccattttaggccatttgttgaactgggctgcatttccttgagagcaatggtaattctttatatttctgtatcttcaaatcaaaaataggtgtgcaagtgatatttgttgagcaaataaatgccaaataataaattgtatagataagacattgtgggagttgagataaaaattctagccaggtagggatgggagcatggagggttcaaggaatggtgacatttaagattggccttcaatttgggtagtattgggtgggacagtgcagaggagacccctatagtcatggttattgtgccatgttctgcaggactgaaggatattgaataggcccattccctgctcaataccatcaccaccagagtagaataaggatggtaatctcaggagtccctttgggctagtgtctatcattttctcctgagctgggttatataactcggcagagctttattgccccagtacacagctggcatggcaggcaggcactccgatccttgcttgtgagctgccttggaggaagcgagtgcagaatggttgcctgcgttttcatctttacttctccttcacagccgcctttctgtatagcatagaggtgacctcagcaccagagacaggaaagaacacaatgagtcatctcaggccctaatgaggtgcataagggaccctacttaagagtgagggtcaggtgaggtcatgctatgcctggggtgagttttgcctcggggctccaggcggcactggagcagagctgagctaattttacccacaggagctgactgtgctgaagggcagggcttatgacattggccttatcatcctgtgatacccagaaagctcccaaggtgcaaccccgttatgtctgggctgttttcccctcttctagttaaatacatttttccattaggcgtgcatatcgaaaagcaggatgctgaggtgcaaagagctttggatttgggtggaaggccacggagttggatttggatctcgcccctacctttgaccttgcacaagttacataattcgagtctcagtttcctcatttgtaaaacctcattcgtatacctgtgtcctaagattgcttctaggtttacacacttggtgaaacgtagcaagcgattgctatgtgccagtcactgttctagctgctttattcatattgtttcacttaatcctctaaagaaacctatgaggatggtgttattgttatccctgtttataaatagggaaacaaatgcacaaggagcttagataagttgccccaggccaccagccagtgacagagctgaattcaggccagtggctccaggcaccacactcctaaacaatataccttattgttttgaaatgatagaaactttccttgctatatagcacaggcttaatgttttctaactacctgctgtgtataagggcctgggcttgatgctgggtaagagagcagcatagctgttgtgctgttctgtagacttgaatcacatttgtagatggaagcccttggtcagctgaagggtatggtggatagactttggtatctgacattgtaggcactgggtggagtgctcctcacacgacctctcatctcatcctcataacttcttcaatagtcaggcattggcatgcccattttacagatgaggtaatagagaggtagcatcacctcctcacatttacttggtagacagagcgactggggctgttgggtcccatgtttatgttgattcatttgcattccccatgaactgtgcagtgtctcagagctattattgttgcagaactcacccctgcccttctgcccaccactgacaaccctagagaaactggtgtccatgaaaaacgtgggtcaccagatgagaaagtcacatctgcatggtcagagcaggcaccaggtgaaggtaaaagaaagggctgggctttgttccaattgtttattactgtgtagcaaattacccccaaactcagtggtatacaacaatcgtttagtatgctcatggattatgtggatcaggaacttggacagagcaaagggggaatgacgcttctgtgctccacaatgcctgggatctcagctggaagactcgaaggctgggtgctagagggatatggttgctcactcactcacatgacatctgagacgttaaccaggcctgttggtcagaatatctacatgtggtctttccatgtggcctggacttcctcacagcctggtggctgcttccaaagggcaagccttgagaggaagggagagagggagaaagagagcgagtgagcattagcaggtgcaggaagaagctgtagatgcatcatctcgctatactttattggtcggagtagtccccaactcgcttagattcaaggggagaggcaatagactttacatcttggtggggtggccaagttctggaagagcatgtgggacggaaaatttgctggagcctttgttggaaaatacaacggaggctccttttggccaaaaaggaggaacagacgtctctgtggagctgcacggaggtagagccacagggtatgcagcaggcgcacctgtatggtgctgagtattcactggcaaatcaggaaaacaaaggtcaagccaggaatcctaaggaaaggatcagtagttacgctataaccatgcttcattgtatatgaattagcgtttatattgtccataaactagtttgtgtaactctgatttgctgattacatcgactgcttatgtaaccctggagttctaggtctattttggatttttttttttttctgtgagatggggttttcctgttgcctacctaggctggagttcaatggcgtgatcttggctcactgcaacctccccctcccaggttcaagacattctcctgcctcagcctcccgagtagctgggactataggtgcacaccaccatgcccagctaacttttgtatttttagtagagacggggtttcaccatgttggccaggctggtctcgaactcctgacctcaggtgatcctcccaaagtgctgggattacagccttgagccaccgcgcctggccctatttggcttcttatactaaactgagatattttttgttccttcacagaggcaagggagaagcttttagatatagacagacataggtctcagccaaataaataaagaatgagtgatcggttaatttatctatttttttttccctcctgcatctaacaaagttcaggaaagacattctgtataatttaacaggaaagagatgctaacaaagttattgaaaagactggagctactgggtttaagaatttttttttttttttttttctgagacggagtttcactcttgttgcccaggctggagtgcagtggtgcgatcgcggctcaccgcaacctctgcctcccaggttcaagagattctcctgtctcagcctcccgagtaactgtgattacaggcacatgccaccatgccccactaatttttgtatttttagtggagacggggtttcatcatattggtcaggctggttagccacaatccagggataaggaagatgtgattaggaagccactgctgaggcctcagaaacttttctcaacatcttaatagttagtgatggggcactggattggcctatggagtgtccttttgcccttcatgattccctggtattgcttgccagtagaaatagtagcaggaagattcagcttcacttccaccttccagatcacacacaaggaaatcttactggcggaacctaatttactagctttgaggaagtatggggaatgtaatttttaagtcggcttctgtgatgcagaaaggcactctagctggtggaaatagtctgattgagccagccaagagaatatatctacccccaacttatccatttaaaatccccaggagttattattctgaaatacttaatgtttataagtaattataacactgtaatataattacactatgaaattatgtttaatatttgtttatttatgtaaaatatataaacttaatataattaataccctgaaaaaacaggccagttgcccacgttcagtttctgaactgagttcttatttttgacgacagcagttgatttgcaattttccagttcagtttaatctcctcctgggagtcataccctaggacagttgtcttgtttacaaaatttcttcacaaacatttattaaacacttactatggacctgtccctgagctggatttggcaatgtggggagagagaagtcaaggattcttccactgggagccaatactgggaaggagaataaatcaggcacacagttagaacagggcaaggaagatgttgatcaatgccctacacagcaggctcagcaaatccagggaagagagattattctgactgggctgagaagtagagagttttatatagtctgtgatccggtgattctcttttgggggtagtaccatctcattatggggcatttaaaaatgtgacggatgccaggcgtggtggctcatgcctgtaatcccagcactctgggcggctaaggcgggcggatcacttgaggtcaggagttcgagaccagcctggccaacgtggcaaaaccccatctctactaaaaatacaaaaattagccaggagtggtggcgcatgcctgtaatcccagctatttgggaggctgaggcaggagagtggcctgaacccaagaagtggaagttgcagtgaggtgagatcataccactgcactccagcctgggtgacagagtgagattccatctcaataagacaaaatagcagcataatggggtgtcttctgttgtcccaacgactggagatcaggctgccattggcatttagtggttggggccagggaagttagacgtcctttaatacatgaagacaccacagataaaaaactgtctttctccaaagggtcatctcattcctgttgaagactacgagtgtgcttgatgatgtgtaggacgtggatatttggtgttgggagtggaaggatagcaggtcaagcagaggggacaaggtgagccaagagtttagtttaaataaagcaaagaatatgtgttgagtggcaatgggagaaagtttatggtggcaatagaagcttcggtcccggttgtggagaaactagagctactagataaagcacttggacttcccctgttgccattgggaagccatttcagatattggagcaggtccttgagagcagaaacgtagcctcgtcttggcaccatgcatcatgtaaacatcagtaatgctttttgaatgaatgaatgcctcaaactgtagtttacaggtgttagactagtgggtacctgagttttgccagatttaggatcctgtggttctgggagggccctggcagccagcatttggacttttagagaatacatggaaagggcacagtggcgtgccacacagatactgtctccacattgtggtcaggcagcagcagtacttgctgacaccgaagagagatgtgaaaaagagagattcttgcatggactcctgtgtgaggcccataagccatgaggcatgtagggagcagactgtgtcgtctgcatcaatgctcttgcatcttgagcttttaaaaaattgccattcaaaccagcaatttgctgacaaggttcacgcgctatgaccatgactgcagttgatcctggggagtggcttgcttgtctgcctggggatggcagccgcgtgcgttccctgtgctgtcctgtagggttgtggtggctttctgatattcaggttggtcccttttccttctttttggatgggctttcgaggttgggagaggaagctcagggatggaactgactaaacatatgtgagatgtttccttgtttgctgctcatggaggtttcatttctgaagtcttttcttgggagggaaaaggatgtgtggatatatgaggtgactctagaaccctcattttatggatgaagaaactgtgattcacagagggagagtgatttgtccagtgtcacgtggggagctggccggggagccagacctcctgtaccttttattgcagggtttattttatatatatttgctggcaaaaagaaggaaagagaaacaatttatatgttttttatttataataaaaatatttattataattatataataattaaattatagtaaaaatatttatttataatataaatataaaatgtatattatattataattatatataattatattgtaattaaattatatataattttatatattatatattatatatattaaattataatacagcatattgtaatacaatatattttatattaatatagtatagtaaaatatataatatataatataatttcattataataaaatataataaaaatatttaaaaatgtattttatatttacatatatatttaaatatatacatatatttatataaatatatattaatatttatatattaatatatatttttataaatatatatataatataaatataaatatatatttatataaatatatataaatatatatatttttaaatatatatatatttttaaatatatataaatatatatatttaaatatatataaatatatatttaaatatatatatatttttaaatatatataaatatatatttaaatatatatatatttaaatatatataaatatatatttaaatatatatacatatcaaatatgtatatatattttttctcttttttgtagagagaagatctcgctatgttgcccaggctggtctcaaactcctaggctcaagcaatccttctgccttggcctcccaaagtgctgggattacaggcatgagcccctggccttatagcagggtttaaattacacccactttgggggaagagagagtggtgtgtgcaggctttggtgccaaaggcttgcacatggttactggctcagccacttactataaaatttgtaaaataggcaccatggacacatctgatattaagcatttaaaaagaggagctgtgtgaaaagttttgttgactacaaagagctacagacatcttcctttttatcttgatgtggatgtttatgcactgggaattggtggggccatctttagagaaggggtgggccagtgaagacactactgaccataccccaatcagaaaacactcccaaggggctcacttccccactgtgcagtaaagaggttttgcactgagatttggaggtacagcacaaggcggggaaagcatgagccaagttttgagtcctgtggaattgagggtgcactcctgcctggggccaggggttcttgtagcaatataaagggagacgtggctaaaaacatagattgggctcatcctggaggccttgagtctggcctgagggtgagtggatgctatcgtttgtgttgtttagagcactggtgaggagtcaactgggaaaatctcaatgaaatgcatctttaggatgtgccgggaatcttggcagtaactcaggagggcaacagggaatcttgcaattggagtagcggggggtgattctcaagttttggacacattctaagtaactttttgcagtgcttcaactttttacttgagtttataataacaatggcaatattttttatagttgtagagctatatgaaatatttttacacctgttggcttcattgttcatacaatatcttagtgagggggaaggtaggattgttttcgttcctgttttacagacaaggaaattgaggctcagagagcagatgggatttctctggccgcttggctggttgatgtggaagtcaggagtgaggatgccaagtttcacacttcttcctgtgccaatgacctggaggagtgtttttctcaaactcacatttctttatcctccacagtcttgggtgtcactcttggaagtgtaagatggtcatgagtttcaaagatttctgagataagctgttaagattttcaaagatgagctatagagaatttgggacataaaatgtgtttcttccagtaactcttgcttgctatcatgttgttggttcaaattgaacatgttgataagtgccagggaggaaagaaaccagtacctgctacttattgggcaccttttttgccctgaactcagtactgcctgcttttccatttgagtatctagaaacatttatggatggagtgattgtaatattgtacaattctgtcaactagtttattagctaattctcataaaagccttaggaggtagataaacaatattattttccattttacagatgagaaaactgaggtttagagagatgaaataacttgcttataacttgcttgagagaacacaggtcctaaatagattataatctttttttttttttttttttttttggcagagtcttgctctgtcatccaggctggagtgcaatggtgcaatcttggctcactgcaacctccgccccaccaggttcaagcgattctcctgcttcagcctcccaagtagctgggattacaggtgcacaccaccacacccagctaatttttgtatttttagtagagacggggtttcaccgtgttggccaggctggtcttgaactcctgacctcaagtgatctgcctgcctcggcctcccaaagtgctgggattacaggcctgagccactgcacccagctgtaagtagagtataatgtaagttttctaatttgagacttctttcttccttgctgcaccccatctacgccatgtgttgcccatcccactggtgaaaatgcagagctgcttgttaaggaggtacatgtcagaccttggaatttactggaatcagacctggaaggtactatgaagagctcagaaggctggtggttttcaagctgttctcttctgagcctgagagactccaggagtcatcttgagggatatagcacggagggaggtgaaaagtggtgggaagtggaggaaggaaggggaccgctagagccaacctgagtcgctctgctttttcctattttgtaagctaaacattgtcaaagcatccatttaaaggaaaagttctgctgctacatataaaagttaaaaaaccactgtgtctacccttccttttgctaacactgagaggcagagtggttcagcacaaggggacacaaagtggcttagcacgagtcacgagatgtgacgggtctgagacctctcagcctagagctcccttacccctgggccactttgttagacacacctcctttaattcaaatccccgtctcagtgggacatggctttttcattttttcaaggaaaggtttaatctgtccagatccctgtgaagatcttggctcttggcgcacctgctggaggttcgaggtcctgcaaccacagagtagctgcaggaccttcaggatgtcccgagccacaaggtctttgacctgcattttgcaacctggttgtgtctcccctttggactctgggaaccttgctgagattggtacaatatctgtgctaaaaaggtttgaaattatagctagtattgtgttaccttcctggtccaaccttcacagacattgtctgactaagtatatataactcttgagtgttcactgtgtacaccggctcacaagaaaggcaaggttcctgatcccaaggatctaatggagagacagaaacaaatataaacttttgtcaactatttcagagacagttatttttgttatacaagattgttatgcatgctagttatgtggagaggatttcatctcttagaaatgagacggggagaatctgggcgatgagaaagaagaccagaactggggagtacagtctagaattgcaaggggttgagtttgctatgtgaagcagttagttttggactgttgcacttactatttctgagatttgagcatctgacttttcctttaagcttttgttttctcatttgtaatatgggagtgagagtgcctagttcacagggtcattgctggggttaaatgagataatgtatgtaacctgcttagtataatacctagcacagagtaaacactcattaaattttcattgttatcgttgttatgatttggcagcgaggagtcaaaagagcctattttcttaaactcatcaatggtataatcagagctttgcatctcgaagtaaaggaacactctgcttttattatttatttatttttcactctgcttttagacatagaattcaattgcctcaggctacaacaaactggcttcaatctacctttctgagttaacttctgtttatttctatccatctgcccacttctctcactagtgacctacacattttcttttttttttttttcttttcttttttttttttttcttgaggtggactcttgccctgttgtccaggcttgagtgcagtggcataatcttagctgactgcaacctcttcctgccgggttcgagccattctcctgcctcagccccctgaatagctgggattacaggcacacaccaccacgcctgtttagtttttgtatttttagtagagatggggtttcaccaggttggccatgctggtcttgaactcctgacctcaggtgatccgcctgcctcggcctcccaaagtgctgggattacaggtgtgagccaccgtgctccacccacattttctaagcttgattttaacttgctggtctttgtcatatcttctcagtcattgctggggttcaaatctttcttttctttttcttcttttttttttttttttttaaagatgggaatctcactatgtttcccaggctggtcttgaactcctgggctcaagtaatactgccttggcctcctgagtagctgggaccatagacatatgccactgtgtctggcttaaatatttccttctgtcggaatgccctttgttccttcatctgtgcccccctgctccatcctcttttaattcctagcccaaaagtctaacccacccattgggagggattctgcagaactcatagagtttacaacatcttgtccttcaattgcagtcagtctctgtcttgaactggatttgtgagctccttgaagttgtttgtatctcacagctctttgctgtaacatccctggggattcaagcacgcacacatagtagatgctcacacatctatgcaataaattactttagtgtctttctcaaatgatcagcacaggaagcaaatgataaaatgcaaaccagaaaacagacctcactgggctctgtgcttgtcagccttgggaatggatttctggcgaagatccggcccctctacaaatgacagagatgacttggctcttttcaggaattgaagagaatcctgacaagtggcatgttgggaaaggcctgaaggaagccagaccagcttgctctcagagctccttgggtcccctgcggcccccaggtgatcttcagcaagacctggtatgtaaatgagcctcatctgctggctcagcctgctgcccactgctagggatgctagaattccagggtaagcttctgtgagccgggctgggaggtttagtgggttggagattactagctttttggtatctgcagcttgaaataccttgtgcccttgattaattcatgcttgggagcatcctcagtgctctctggaaaatagctccttactgtatgtttatttccccacgggcttatttcagagagactggagcctgtgtttctaacagcttctccaaggaaaacatcgcaggccacgtttccggaactgagaatctcagggggtctttgaaacgtccatctctattacctccttttggcccagcatttgcttttagctgaaaagggagattttgtcttgagccttcctgtagacatatgtgacttggagtttgaaaatctgacagctgctgctgagctttgaactgcaagagtgagcagcatatagacataaccccgtagaacatcaaatcattttcctttaattcccagagacttaatgtttctttgtcttgcgaatgacctcactgctttttgtatttgtaatggaatgcacagtcatttgtaagtaatcacacaataatcccttacacttttataatgccttacccttttccatagggctttcactctcattatctcatatgatccttataactgctctgagatataagcagagcgcctattttaatctccaattttcaggtgtagaaactgaggttcagaataaagttagccagagttaaaacagttagtatgtagcagaattggaaagggagtctacagaattggaactggagtctcctaaaccagtgtttcttttgctccttattgctggtgtgaccttgggaatatacttaacctctctgaacctcagtcttcctatcactaaattgggtataatactacctcctgggatagttgttggaagggattcaatgagactgggaaatcatttaataaaaggtagaacacactaataatgggaggcatcattgtacttactacatgggccttgacggcgaacagtgccatcagaactgtgaaagaaaataacattttttctctctttttagaaagacacaggttcagaatggtgttgtcagggatcacaagctcccagccccgtgattagcaaattgaccctgctgccctgtctgctggctgctttcttattctgagaattgtgttgacaagaccctcttttcctacagagctctctcttaatgttgcttggaatagccttgtgtcctggagacagttttaggtctggcaggatctgagaacaggagtggggatcttggaatgggatctgcatccctgagcttcatccacaaagggtgggaatgtggcttgggctgtggggtggaggtagatgaacagctggacttgcaggtctatcttctgttgtttctcaataaagtagacaagtccatctgatgggtgtttagtagggtatgacttgtgagtccacaaggccagcagtatatatgctgaatggactgcttagcagtaacacactggaaaaatccaaaaagaatggatttcaagttggcaaaaaatgcattagaagtcagcagtgtgatgtggtcaggagaacaaccagagtgactgtgggatgaggtcttggatagctttgtttctatatacagtcagccctctgtatccatggtttctgcatccatggattcaaccaaccaaggctcgaaaatattaaaaaaaaaaaaaatccaaccataaaaaaatacaaataaaaaaaccaatataatataacaactgttcacatagcatttgcattctcaggtattataagtaatctagagatgctttaaagtatacaggagatactacctcattttatataaaagacttgagcatctctggatttcggtatctcaggggtcctggaaccaattccccatggatactgagggaacgagtgtacatactcacctacaaaaattccaaaccagtgagacagacataggttgaaatatggtcctgagaggcagaacgtgaagcaagggatggaaggccggggaggaaccagatttcagttccgtgtaaggaagaactttctgatggaaagatggaatttgcagtggcaggagataatgatctttgcttcactggagacctcaggaataccaatggggcaggcactgggcttaatggcctttatggccacttctaattttgagatcacagagctaggaggatgagaggcacacatatattgaaggaactgaagggtctctctctatgtggatgtggaaactgatctccaaatgtttgcaagatggagggtacgtttaaaatatttcattctggttttcatattgatctctgtggctctccccttggtctttggtttttaaagcttaagaccattcccagaagctcttttccatggaataatctcctttctttgctggaatgctcctgttgggatgcaggaagggactctgagctcctgacagaatgaagaccacccctttttgctctccagacctaattttgacgtcccacgcccacccgctgaggagggttgcaatggcgagatctctgtcctgaattctggttctggcatgcagtggaaggccctctgattctgtttccttacctattttaatagtaacttatatttgtgttccttcattaaatgtacaataaataataaatgtttgcttacggcatgcttgttaagtataaaacaaataatcaaaatgaatgtgtaatgaccctttggatagaccaagtagaagctgcttttaggacacatgattggaccatttctagatatctgcctaatttgtaaatgaaaaatatgtaagctacacaaggagcactgactcgtctaaaatcttaacgactgactgatttgggcttggggtttggggcttgggtccttcatgccctgatcagagctgtttatagcttgaagacttcctgggggtgagaacaagcaacctcttggtgcagtccaaagccaggaaatgggtgacgattttgaaaaaggactcatctgacctccagaaagcctttacaaccaacagtagaacgagatcactaagaaacagaaccaccgggaagccaagatgtggtacttggattcccatctcggagcacctcctatatcccgacacaccatttcccctagtgtctgatctctctttctcctcctttaattcagtctggagtcattttagatcagattcattcctgattggcttcactgctccaacttagtcatcacagaaccttagggttggaatccatgttacaagttaaactgagcaattcacccccacttttcctgacaacagtgttctcttgagagtctggttttattctgagtcttccagcccggtgtctgtgcccatgaaggactcatgccaaattacattctcaggaggactcccagaccaagagactctgggcttgggcgtgagagacttggggctgttctttttctttttttttttttgagaagaagtttcactcttattgcccaggctgacatggagtttcactcttattgcccaggctggagtgcaatggcacagtcatggctcactgcaacctccgcctcccgggttcaagtgatactcctgcctcagcctcccaagtagctgggattacaggcacacaccaccatgcctggctaatttttgtatttttagtagagaccagttttcaccatgttggccaggctggtcttgaactcctgacctcaggtgatcctcccgccttggtctcccaaagtgctgggattacaggtgtgagccactgtgcccggccgagaggagttgttttgagactcacctgccatcataggaaccatagcttaaattcttgtgaccttttcaggtgcatctcccaaaatatctcccctccaccaaattaatgatttatttcataaatttagttgcattctggatggtctcattcttaagatgagcttaaagcctttcagaccagtcacttccttgtttggggtggaggaggttttttcctggaataggacagtgtatggaagggttgagaatccacttctttagcggttaataatttactccgagtaaggaattctttgttaaagtggggcatgttcttcaagtgccagagaagagagaagggtgatttttctgacatcctccagcctgcttctccatatttggaaatgtttacccaccaggctgatctattggaagagagggaggtgactcagggtttaggagaagcaggatttgaattcttgtttccagaaacaaagtcgtccccccaccctgcccccacccttcccccttcattcctctgtcccttgttctggaagctgaggcgagaatgtctcagttctgttcccttcaggcttcgagaccaccgccttgctgtgtcccgtagtggactgagggcctgcaagagggagtgagggctagtggagggccagctgcctgtgggggctggacatcgtgtgagtacatcattactgccatttctgctcacagacctggggcttacagcctgtgggctggctcacttgcatggtgatgggacacgttgctgggagtgctggtcacttttatttgggggtgtggacagctgctttcccaggggagtacttcttacagtgggatttcaagacaagatcggcctgaagaaaaattatatttgtatattttttaaaaagtaggtatttcctctcatctgaggcctaacttgagttgggtagaaagacaatttgggagtgctgttgtctgatgattaaggctaaagcaacaagctggaagggatgtcgggatgtctgtggacatgtagggaggggtagttttagcttgaaaacagttatggtgggatttaagagtatgcaaaatgttgatgtgtagcatttgcacagcatccacggtctggaataccttgtgtgcaggtcactgtgtagatttgatgagttgtcagagttggaagagtcctgcagagttttcagcacatctgtctaatttcacagtgtgagataatgggcagcagagacccaggccctgaagacagatggctcattatgtgggattagaacccagatcttctctctcagttcgttctccttcccctagacttaagctgccccctctattgcgagatgaggaaattgggagatgttagaactgtccacacttactaatctagttggtgggaaattgaggactagaacctacttctagttcagacctcttcccgttaggatatatgggctcagatgcctagatttgttgtttttgtatgaggctcttttcttttctttttgttctttgatttttacttacctttcccttcttttgttcatgtgaatgtcgtatgaatgcaaccttctgctctcctttgctccctatatctttctctttcacgaaaggggatgatcacttgtccaaaaggcagaatgaatagtgtggaacttcctttctatccatggaagtgaaaattatgcaattttccctgagagaaattcagcaaggcttcccatctgagcctctaccactattcttgaagctgtaagaattctggaatattatgcccattcaaaggtgagtcctgattctgattagattttaaacacacacacacacacacacacacacacacacacacacactttttaagcctaccaaagcaggatagagacccagaagacaccgacctattacgtcacctcagatgtttcacagccatcaggagtaactctttgtagtcagctcagtttcagatcaacttttttttttttctttctttcttttttagacagagtcttgctctatcgcccaggctggctggagtgcaatggcgcgatctcggctcactgcaacctccgcctcctgggttcaagcgattctcctgcctcagcctcctgagtaactgggattacaggcatgcaccactaggcctggctaatttttgtatttttagtagagacagggtttcaccacgttggccaggctggtctcaaactcctgacctcaggtgatctgcctgccttggcctcccaaagtgctgggattacaggcatgagctgctgcacctggcctcggatcaacttgagggccttattttccagtgcagggaagatggtagaaatatgttttggggaagcattttattaccagtggcattaggtggcagatgtaatagagcagaggaagtgctctgagacctatgtttgttctggccagttttaaagagaggggaagcgactctctaatctgctttgaagcaagtgggaggagggaagttgcacaggactcccaggaacctgtacacaatctgtctccttctgtgaccagctgaggctgggtggtgactgtaagccctgttcatgagacaggaggagagagccttgaagaaggaaagcctggggtgtttttctgtggtgctgagggacagggacagtaagaggttggagtaaataataccagtatgaatactaatactctgaataaggacagctgacaagcattggttgcttaatgggtgccaagcacagggctaaacactttacctaaattattgtggcactatagctgcctttgagtaggaactattttttaaaatattatttttaattttggtgtaatacatataaaatttgccatcttgatggtttttaagagtacagttcaagcctgggcatggtggctcacgcctgtaatcccagcactttgagaggccgaggtgggcagatcacttgagcccaggaattcaagtccagcttggccaacgtgatgaatccccacctctactaaaaatacaaacattagctgggcctggttgcatgcacctgtggtcccagctactcagaaggtggggatgggaggattgcttgaatccagggagtggaggttgcagtgagccaagattgccccactgcactttaacctggatgacagatcgagaccctgtctcagaaaaagaaaaaaaaaaaagagtacagttcagcagtgttaaatacattcatattgctgtgtaatcagtctccaggcctctttcatcttgcaatctgaaactttgtacctataagcaacagctacccattttcctctcctccagcccctggcatcctccattctactttctttctctatgaatgtgactactctaggttctgtatctaagtggaatcataccgtatttgtctttttgtgactggcttatttcactaagcgtagtgtccttaaggttcatccatgttgtagcatgggtcagaatttctcctttttaagggtgaattatattctgtggtaatgaatataccacattttgtctatccatttaggtactattttttaacctccatgttatagaagaacagcaaccagagacttcaaagggttaattaagtaagtggcccaaagtcacatagtcagtagtggagactaattttacctaagaatggcatgtgatcaggagtaagcagatattggattctaattggcaagagtgtgacaaatcagggtgcttctcaactggatggtgacacctccttacaccttgctatggcatttcaataaagcaagtgttccaaagggctgtacgcagctatgcttcctttcttttgtattgggctctaggaagcccatagctaaatttaaagctcacctctagcaaatggtatgagacatccagctcttattttttgtatccctttctcctttctttgctttattttctcctctccttacccactttctcacttaaatcatgaactattagcatcttttgtcaggtacctcagatcatttctggaacaaggcagaatatatagatatgtggcatgatatctaatattttagtaattattaagtctgtggaatagtaggccaaaactggccatgatttttctgacttgactctgctcgtcttcttcttcttccttttttttttttttttttgatggagtctcactctcttgcctagactggagtgcagggcgtgatcttggctcactgcaacctctgcttcatgggttcaagccattctcctgcctcagcctcccgagtagctaggactacaggcacttgccactacaccccactaatttttgtatttttagtagagacggggtttcaccatgttgaccaggctggttttcaactcctgacctcaggtgatctgcctgcttcagcctcccaaagtgatgggattacaggcatgagccaccacaccccacctaactctgctcataatgcaatgtttcatctgggcaatgccctgcccctttctgagtctcacttttctcacctgaaagaggaggttactgttgatgacagtgaacatttaggctgtgctgagttttacactaagcatcctgtctctaactctcccaacactcccacaaggcaggtgctattatccccattttacttttgagaaaattaaggcctaaagaagtgagaaagcttgtccaaaccgctatagctcttgggcaaaggcattagtgaccaatgtgtatttgactccaaagcccaggatgttagccacagtgcagggctactatccttttatacaatctgtcaggcttcttccatccgtggcatgtattcatctaattttattaaatctttattgagtttccacttaggtgccttgcactgttctgggcattatcccagtactcgatttagagcaaagagtaagacacacacaacaacgatctcttggtgcttacacgctgctgcaggtgtgtgaaggaggcagataaaggaacacttaaacaagagggactgataagtaacccaagggaggagtcacaaagggcattctgactgtgagtgagtggggaaggactctgggaggttatgtttaagctgagatctgagtgacaaggaggccaccttgtagaagttgggggaagagcactgcaggcagtggagacggtcaatgcaaaggtcaaggctgtgaagtgggaaggagtttgtgtttgaggaacagaaggagactgatgtgctggcaggatgtgggctgcaggggaagaagcaggagaaaagaatagggtctagcaggtggtggtaagtgagagacctgagcttcttagacctgagtccagatgtgatgggttatgtgttacaggcatctttccagctgctgtggagggaacctgatagtaaaagggagtcaagggtagaagcaagaaggttaggctagacttttaccgtaattcaggtgtgatgtggtggtaactttgactagggcatagaagttgggcaggagaggtaagtttggggcatgtttgggagtgatcgtctataggatctcaagtgtgatttccttcagagaaatgctgagctaaatgggcaggaatctgggatactcagagggaaatgaaaataggtgccctagggggttgcccagataagcagctggcgttccaagaccaaagagtatctgtttctcacccctctcccatttagtttctaaccttgagctttgggccagtgcacagaggatggtggcttcctgcctttggcttcccagctgagagctgttggaacgccccaaaataagccctgcagaacgtgcagcttcctttgctctccctgggtatttttgtaaaacattctttcccaccaagaatgaggaacgttcagagtgatgctgactttatgggctgtatttaacatgttgttttttcatggtgttgtctgttcatgcagagatttctgtctcctgtaaactccctggtaaggaatcttcaatctccatgtgagatgggtctggaaggctcagtgggagcccagaagagctggggtttgaaagcctctccttgtcttgaggactggactgcggtccaagggcacctaccagccctcttttttcatttacatttgaattcacagttgctgccctttggcagttccctgtaattccttttaacaggctgggctttcctgcagatacttcatttttcaggtcttggagaagttaggtagtggctgaatcaggtagagaatccaaaattctgaccaagccccatcctctagccaccaggccaaagcaacttagcttgtgacctcatcctcctgtgtatcccctggcaatcttatactataatcagcctaagcccagagatgctcagaaatcatacactaagtcatctaaaactcatttctgaggctttctcatgcgcccctcttgcagtctgtagttaccaggttttcaaataattagcataatctcttaaaaacagtgttttgttattgctcattcaagtttcttctaaaatttcttttatattacctattcattgagttgacaaacatttattgagttcttactgtatgccaggcattgtgctaggtgctggggattgattcaaagataatttggaggcgtatggaaggggagtggataattacagcacagtgagataagtgctataatagggggatatataaagagccagaaatagcactatgaataacatctttgaacaaattgccttcttttttccttttggattattcccttatgtatattgcccaaagtgggattactgggtcatttaaaagatgaaaacaatttggcacaaaaagatgtaatgacttgcctggggaatacagctcaattttcaacagagaaagaaaaaattgttgacaaatccagatttagatcactttaccaggaagatggggcagtttttatactaccctttcaacatggtggcttttaggggcggggtgggggggatttattctaaacatgttagcctgcgtgtaggaatcacacgtcctcatatttaatctcacaacttgattgttctcacaagaacctagctgtatacatattatcgtttccattttacaaatgaagaaactgcacccttgataaaaggaagtaagttgctcaaaattccatagttaataagtgtagaatccaagggtcaagcacagttccttttattctttgactctatcctgttccccatgctgtgtttaccaattgagggtacctgtgctctagccggggcccggaatttaatatttaatgagtcacggaggctcttaagatgatggtcaggctctatgaaataggtgtagattttcttacctctgaagtcatagccagggaacaatgtctttctgtatattgacctgaaaggacccaagggcgcattattcctgaccctggctcaggtgctgaaaggctatttgcatagccctactgttagagcacagaatcccaagtaaagctgaaaccatgccacagttttgctgtgaaacatttattacttttctagtacttaacagtattaagtaaaaactcctgcccctggtatccaggacctgtcataaatggacaccaacatcggtccactgtgggtccatgtgggtccttgatgctcctgcttacatatctttaaatcaaacacatttcctaccaacccccagatatatcttgcactttctcaccttcatgccttagcacatgcctttcctttagcctgagataacctctccaatcttcattcatagaactcccaatcctcctgtaaacttctgcacagacgccatcttgggaagggaataatccttgatcaccacctgctctcccatccattagaagtgatctctgtgttctctgttctgctaactcaaccacagttagctgtgaggcaatagagtacaaatgtatgctgcatatgagcatgggatatggatttgaatcccggctgtgatacttcctcactgtcagttaacttgcttgagcctgagttttcccatctgccagatgggtgtgatacaataggtgctccccctgaaacccaccatgttgacaggagtagtataaaaatggtctgattctcccggtgaggtcacgtaaatctggaatcgtcaacaattttcctttcctttgttgtcatgacttttttttatgacatcacctcatgtcatgtcaccgtgtggtatgaaaatttgcattgttacctgtgcttcttctgtggcacttgtcctcccttacttgatgtcttatctctccttctagactgggagctcttcaagggcagggagggcattgcatctttgaaggccttgacatatggatactgctacaaagtttcctttaagggaaaggaggattccatacaacctaagtggtgacatcagcacaggctcattactaatctcatgtcacgaggtttcaggcctggctgagaactctgtgagctctgtgatgttgagcttcaggcacatagagtacaagctgggtaggcctctggctcctgcttaagagacagcagaaaggctggatggagcctgtctccagaccagcttcttctgattcaaggagttgggtgggactggcagttcactgaaggcagagtggtagtcctgcttggaacgtgaaactttgtttctttcctgggccttccagtgggtctgttatgttggtgagagtttcagacctagaggaaagggtcactgaaggtatgggttaagagcaactctgaaagccacctgccccccgacttctctgtgagtggggccacagggagaagatcccttcataggtagctcccctacccttgctatgcttggaaactgaccatggaaagggattcatttcttaaagggatagggctaccatttaactttctattgtgtcacttcccgaaacgcaacacctatggcttaagatccaagtgctttagaacatgagatacaaggtcttccaggctctggctgccacatccctttccaggcgtgtgtcccaccacattcctctgcatcctctgtcactggcctcaccagattagtcactttctctgagaacaccctgaactcatccttctcaaggcctttgcacattgtgttccctgagcctatttttctcctcctcatccgtggaaatcctcttgggtgttcaggcatcgtttagaagtcacatcatctgcagagaacttttagaccctcaaaaggacgttgcatgtactcgtgcttttctacacttttcattctgtcttttgtgttccagtgtgtcccccattgaggctcttcgacacccctaggcatgtccaactcagcacctacacctgctaggtccacacactgtgttatccaagacagaaggtgttagcaaacctctctttggtgcgcccctgaatgcagaacatgtgacattctgttaactaacagttgtgccagagtggtttccatagcccatactggggttcccatgatttgtttgatcatgagcccggccattcgaattgtttttgaattggtctgatatcagctagttaattgttaacccttttcaggtttgtttcccacataccagtagatgtctgcttagtgccagggttctgagctttttatttcacttaagaatataatagcaaggtagaattcaggaaagatttacttgctgttaatgtgaacttttaaaaaaatagtttgaaatgtaggctttgtttttatcccaaagctccatgaaatatgaaaatagcaggagttttaaaggtatatttccacctctagaggaagaactgtccatattatagttgtaattataaattaataaagcctgtgtcatgaaacttgattttgaacgcctgtgttcaaatcctggctttaccacttactagcctagagatattggatgagtgtctaacttctccgttcctcagtttcttcagtgttcaattgggaaatttttcttatggttgatggaaagtttaaataaggtcttggatatgaaactgggattttattagtgtgtgtgtttcaaaatgtggatttggaggccatttaaaaatagcatttccaaaaagtttgcttttaaagcaaagtacttagatatataaatttttatgaattttttttcaaatgataaaataaatgagtttacagtcaggagacatacagtatctaacaaacttagggaatatgcttggcttacaagacgtggttttagtccacataaattagaatcacagaactataggctttgagaaattataaaagccttggaaggggtgaacgtgaattagtgcatattgtgtgcaggctttgtgccatacgtgctagatatgggatcccaggaaatggttgcatacaccttgttgggtagatgatattaaccctgttttgcagacagagaaacctgagctttgagaaaatcctttacacaagtccaatatcaaagtctggaacttcaaactgcactcctgatggcttctagaaatcctttccatttacagatatgacaagacttgctttcacattgttgattttttttttatcctctctttctctgtctctgggggcagcactaattcagggccagatagaactgtgaaaatctgcagtgttgatgtcacataacttgtttaatgaatctagattagtgtcttgacttttcctgccaagaatctgctcataaagtgtcttgttttgagctcctttaactgtactcattcatcagcctttacttattttcttctcttttggagagatacttgccattgcccataatgtttgaggtcaggagtatatttgaagagggctttatattttcttaaaaaaaatacaggtggaaaatcaagtttatcagctatttcataccatcttcttctgccatttatgggcaacatgtggaagaggtggcagggagctgggagtttggaataatgtgtctcatcttgaatttgtcgctgaccagggaaaatactcaaggccaactccatcattcccttttgggaattcggtgcttcagctgtaaagagtgagggcactactaggtgattcctaagatttaaaattctgcatgttttgtggtgtcaaaaccatcaatttctggtgagctgcgtgatcctgcagctgtttctctgatacttttcaatctttagatttaatctattcaacaatgtataattttttaaagggaagcttttatagatacttctgaactataaccgggtgggggggataaatggatgttaaaaaatagaaaacaaccaattaaatagtatatagcatgtaattctccttggaaacttaccacgaaattgagaagcactttaacaactggtaatttaaattgcgtttgaactctgctaatggtttgtttgcatgggaacttcaatcatttcacagtggttctttagcaaagctgcttgttctctttatggaaaataagaaaaaattattaaaagagaagttggctatggaaaatggagaccactttcatttgtgcctggagggaagctggagagtgtgagtgagactccctcagggccaagggtggagagctcttcctttcagtgaagtttaaaaatctgggaagtcagatgccctttgctgctgttgtagaaactgttgtgatttgtatctctctctgcaaggagaagctttggttttatgcagcttgcgggtgagggtagggacaacctttttcgtttgttttatgaaattgcattgttcacaggtctaatgttggcttcctaacaacccatttctcagtaagtttgaaattatgcctctctctcctttcagtggaaatggctttcagaattccaatgtccttgaagaccactaggtctcaggaaactccttgcttttctgggctgatagtgattatactccattttgcctacttaatttctgtctgctgttgaggttactgggagagcgttgaaataggtgttcgaggcctggatttgtaagtcctggtttggctctaggtgtgactcatgtgaccaagcacaagtccctctgcccagtgtgttttgttgtcctttgtcaaagcaagcagtcacttgatccagtggatcaagtggctcctgaagaggtcacctccttacccaggccaccgggttctcttgtcagttggaaaagttgaggtgggtcatttaaaaaatccctcccaactttgaacttggaattgttttgtacacaaaacaattgtatgattggctaggtaatgtttacagtgacaacaatgaaatgggcatggtagtttctcgtatgtggatttctcctgcatacatgaaagacaagttttataacagcccttgccttgggatacttgtctgttggcatacatactgtgtaatcattagcaaaacaataatagttgctaatgaaataaaacctgtaataagggctgtattaggctattctagcattgccataaagaaatagctgaggctcggtaatctataagaaagaaggtgtaattgggtcatggttctgcagtctgtataagcatggcactggcatctgcttggcttctgggaagacctcagggagcttttactcatggctgaaggcaaaggaggagcaggtgtctcagatggcaaaagcaggagcaagagagggagtaggcagaggagttgccacacacttttaaatgaccagatatcatgagaacacactcgtgatcgtgaggacagcaccaagaggatggtgctaaaccattcatgagaaatccgcccccatcatccaatcacctctgcaggccccacctccaacagcaggtattacaactcaacatgaaattcagaggggacacatatccaaatgatatcaaggacggcttactgggaaatgtcaagattgtttatccctctgctgctcactgattctcacttttcaggcaaggaaactaaagttcaaagaacattaggtcctatagttagaaatttgtctccaaactcatattccttttctttttttatttggtatagtttaggtttatctgttaatttttttcttccctacaatttgagtatctaactgacttgcctctttcacctccattattaagatgaagctgttttcccaggagaactaggagagctgagatatgaacactgaggcatcagcattctctttccccatcattctgagtcaaattagtgaaataagagtgccaggatctgactaggagtttaggaggtatagaagtaaaccacggcccagtcagagactttataagcctgggaatttctgaagctggttaagaccctagagatacataagcaacacccttctgtttttcataggtgggaactttgaggctcagagacagagcagaagacagaacctggtcttctgattccctgtgttctgcttttttcattgttccactggacgctcatcagagggaagatctttttcctcaattggtgagtcccgcacacaaaaagaacacatttgccttttaaaatcaatgtatatgttttaatgagttttaaacatcagtgttttccacttaaagtatgggcatcagtaactaggatgcattaagaataagagaagaactgaaatgcccttccttctttcttgagttgcttttatggcaatagacaatatataaccatgctaataaaatgtgtggcaaagcaaaggcagagctcagctcttggaaggtggtagcattgaacttggaggaaaatttggagtaacgatgatttcaggttgccagcaattgtattgcctccttctttctcatttggcatggaagaaagtgttcatgaaatggaaagaccaaaatgaaaatgtcactgaacagtgtttgggcatttacaaggaaagaaagcagtattattgagtgtctcttgtttgcccttgtgcaaagtgctgcttcttttgtgatctcatttcattttatgtatttatttttttgagatggagtcttgctctgttgcccattctggggtgcagtggtgccatcttggctcactgcaacctccacctcccaggttcaagcgattctcctgcctcagcctcccgagcagctgggactacaggcacataccaccatgcctggctaatttttgtattttcagtagagatggggtttcaccatgatggccaggctggtcttgaactcctgacctcaggtaatccacccgcctcagcctcccaaattgctgggattataggtgtgagccactgcgcccagcctcattttatttctataacaaccctttggggcagagcaggctaaatttgcttaggcaaagggtgtgagcctttgttttaaagggcctgccagagctccaccaggatgtgaggtgcaaatcctgttatgtgctcagaaaggagaattgtgaccaggtaaggtaaactttcccttgtgttttggtgtacctctgtacttaatgggtagagtagaacattatgttctaaaaaatcggggtggtaaaaagaatcaacagtgtggaataccctgggctctaaggaaagctgaggaaattagtaagggaattctgggtgcgacttccacttaggatcctgattcgatggtccccattggctgaggccaattcatatatgcccccagcattggctttgtactgagtaattaatacaccttgacatatttgtggtgtagttttccaaaacagagatgatgccattgtgattgaaaaaaaactaacttcatttaaaagtgtgactgagtttatagatgtgttttgtctctctgtcttttcttaatcagtgtatcttaaaagtacaactgactgtgtgcctattgatctatattacataaaaggctggaaaccactggtttgatgcttaaaccttagtgtctgttaaaatttcaaacatgatctggaatatattccccctagcatacgtttaagtatcaaatgaaaaatctttgtcacctcctctatgtcttgagttttttcagtgtttataattaaactgtgataagtatgaagctttgcacttggacttaaaaaaatcaagtgtgtaatgatagaaagggagagatttccttaacaagagcagactggaagagacttttatttatttattttatttttattttttatttatttattattatttatactttaagttttagggtacctgtgcacaatgtgcaggttagttacatatgtatacatgtgccatgctggtgtgctgcacccactaactcgtcatctagcattaggtatatctcctaatgctatccctcccccctccccccaccccacaacagtccccaaagtgtgatgttccccttcctgtgtccatgtgttctcattgttcagttcccacctatgagcagactggaagagtcttagaagtttttgttgttcataagctaaatatgagccaacagtggcttttgttgggagtggcttccgaaatgctgatgcagccttcacctgcgtttaatagagtatggcatctagaacaaagtgagtgggtgattctgcaaacctagaacacctggaaactggcaagtgcagaggtcatgtgagcctcaggcacagtttgaacaggactctagctctgtttttctgcagcacttcttgctctgcccttttttgtgcctgggcttcatccttggaatgttttacctcatgggccatgagacggctgcctgctgaaacccaaactatagatatccctgttcccatttaggggaaagagcctggtttgctatattctcataggcttggctgactgtatatttctgaaccagtcattgaagccaagagaatgggattatggtaatatgaaccactattctcctgaaactgaatttggacatagtcccatccaaacctcatggtactcacacagtggagaagaggtggccccgcaaaggaatatctgggtgctgttaggagagggagagaggactggaagctccgtgggcaaccacaggccttctgcagacctctttagcccccctgtcagagaccctctagagagccgggctttagttcctgcctcaccttctgaaaaggcatcagccagctgcactgtctacacgaggatgctgagaggaccaggaatgatggccaaccaagaagtgttacgggaatgagaccatggattctgctgcaagattctgggacacacgtgctcatggccatcaagaacatagaacctgggcaggacagggacagcattgcttgttcatgtgtgtgtctccagagtctgctggggtctctggcatgggataggtgctgcatgaattttcatggatagaataaatctgaaggaagtgagggtccctttcccaaagggtgttctatcgggcattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgagaccagcctgggcaatgtggcaagaccctgtctctacaactaaacaaacaaaatcccaaatgactggacagaaagaggcttttgacttaagaagtttgtgagggcataaaaaggcagtgagtatggtgggatgccctaacagaagtcctgacaagtatgagatgtgcaaccctagaaaaacaacatcccttcacccttatttttttgatctgagaattaggaacaataatcattgccctgcctacctctcatgtttgcttagagcaagtgcattgttaaatgccaacctgttttgtaaactataaagtgtggttcctgtatgatacattattacagttgtcttcttccttaaagactcatcttgaatataaagaaaaagacaatgtaagttcagtgcacagcatcgggaacattagacatgctcagcgtatgcccttcctgccaacattgtacctcttcctcctccgggttggatgggcactaactcgtcctcagtcctgcagctagatctgcaactttgcttaatgatgcaggttaaaattgaaatagaattatgtattattatttttcacattcatttttgcctgagacaggaggtggagggtggtaaattaagaaacccgggaagctcagtgcttgagagaacccatagaagctacagtctagcccatttggcttcttactttgttagattagataatcatacctgctgctccaggcgtgactagcccagtgggagtcaggaaggaaattatttccctctgttgataccggtttacaattgccgactgtcgccaagggctttcagttttaatatttcctctttggtcctcagaagtatcaggtattagtctctgccggaagcaaagcattggtcacttccgtcagaggtgaatgtcttggctgtctataattcctcagtcaggtgctttctgggcatgtgtgagcatttgctcagctagcttttattgcttgtatgttatttgcttcaaaaattacaagaggatttgtcgggtctgagcagtgacctatccagtcccctgaaactctatggttcttcgtgtaacccagggatgtcttgtaggaggtatgtttgctgtccacgaaagtaaaaagtagtgatatctctttctctcttttgcttccttcctcctaattccacattctcctatttcttggcttctggcacagtggagatacctctactctacattaggcatggccttaggggatccgaattctcaggtcttcctcaatgagttgctgtgtggtagacagcatctgaagtttgaatgggtagagagacctttgtagattgtggccaaatatttacacctggttcatagagtatgtgtttgctgccctgatctcagtgttggtctgggtgttagtgaacctcatgatctttaggaaactatgtgaattaggcttagtccctgaccctgagaagcttatagttagggaaaaagacaaacatataaaggagaaatacacattagaaacatattcttttttttttttgagatggagtctcattccgttgccaggccagagtgcggtggtgcgatcttggctcactgcaacctccgcctccaggattcaagagattctcttgcctcagctgcccgagtagctgggactacaggtgcgtgccgccacgcccagctaatttttgtatttttagtagagacggggtttcaccacattggccagaatggtcttgatctcctgacctcatgatccatccaccttggccctccaaagtgctgggattacaagaaacatattatttatggtacacatttattaatcaccagatatgtttcaggccttacgctgagtgcttgggaaattgagataaattatagtctcagatctcatggggcgtggatgaagagttgggagaaagaaaaaaataggccaggcgtagtggcttatgcctgtaatcccagcactttgggaggctgaggcaggcagatcacctgaggtcgggagttcaagaccagactgaccaaaatggagaagcctcatctctactagaaatacaaaattagccgggcatgcctctaatcccagctactcgggaggctgaggcaggagaattgcttgaacccaggaggcggaggttgcggtgagccgagatcgcaccattgcactccagcctgggcaacaacagcaaaactctgtctcaaaaaaaaaaaaaaagaaaaaaagcattgattaatattatctcacagtttctgaaatttgggagcagcttggatgggtgccacaagatctctcaccacatcgcagtccaggtgttgctggacctgcagtctcaccggaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactgttccctctgcctcattctctttacgagaagcgagtcactaggtccaggccacactgaaggggaggggtgaatatgagcacaaggttattaataccaggaggtggagttacacggaaccatcttaggggctgcttaccacagattccccaggtttacatggatgtgctaaggtggaagtggacgttgcctgaagcagttgaataaacccagcacacctctgtggatcaattttacttgaagacatttttgggggaaaactccatttaaaactcttaagagaagcactggtacataatagcacaggatgtaaagttggcatggcttttaagaagaaaaacacaagttttcaattcatgccgtgttcccttacctctgtatttttgccctcctcagcggtagagcttttttggtagaaatgtcgaaaggttcttgcttgagccccttgctgtatgcgtgagacaccgagacttggaaagggcacatactcttccagggccacagagccagcggtagtcaagggaggaaccatctgcagctcctctctgtgccccgccttccaccgctccacacagtctctgctgcataatgagtctgtgcaacttttaggatgttttctcttcttttctcaaactctctcctgtcccagaaacagattaggaaaaataggtcaaaaattggaatcttgagctttgattttgtccctttagttaaatttcaggggtctgcgtctcctggtgggccatgttgtgtcctgaaaagttgcataaatcaatattacacggctcagacagtgtatctctgcagttatgaataacatttgttttaggaacagagagctgatatacaacgttactttgagactgacaagaccagacataaaacctcagccaataccctctgtctggcagggagtttcttttccagagcatccttctcttcccccgaccaaagcagtccttttcaaaatcaagctccgcagtttattttatagaagatgacaggttcccttagagtccacattcacataactagaaaaattaatggaaattggagccttaaaattatggtcaagcttattagtgactttacagccaaaatgaggaacgcacagctttggtcactgagaatgtggctggccagaacgtgaattctactacctgctccatagtccctttcaactctcagcaattttttttaatactcatcttattcttttttttttgagatggagtctcactgttgcccaggatggagtgcaatggtacagctcactgcagcctctgcctccaaggttcaagcgattctcctgccttagcctcccaagtggctgggattacagatgcatgccatcacacccggctatttttttttttttttttttttttgtatttttagtagaggaggtttcaccatgttggttaggctggtcttgaactcttgacctcaagtgatccaccctccttggcctccaaaagtgctgggattacaggtgtgagctgccatgcctggctaactctgcttgttattaaagtgtttcttaccaattatttcatttttattaaaagtacatagtaggaaatagagttttagttggacaaggacaacatggtaaagaggaatttggagtaggaagactgtcacgttagtcactgaatcctacctagttcacttagttttttttagcctgttttcacttctgcaagccatggagtgaagagtgcctacttcagagtctttggtgctctcaaagcagcgtaatgtctataaagtacctattgagtgtggtacttcttatgtagttggcacacattaaatgttaagtttctgatcaccttaagagtccataactctttgctggagatcacccttagttcttttctttgttaggccattatctcatgtcctgtttacactgtccccttggattggcctagacctgcagcgtttgtgtattggtcaccccagatttcatgtttcctgaataattaatagcctcaacatttctaattttgcataatgactcccaaggcctaactacaaacatcataatgtgctcatgttttctgatacctggaaatatagtggctctaggaacaaaacctttatccactgtgtttcatggggaaggcttattgggcatcactactggaaagtaagtgttgattttaatggcaagactagtccaggggtgaattctactcaggtgccattagcaacctcttcatctgtaaatggaagtgtctctgggacctgctcagctctgacctgctttgggtcctttttggacttcttcaggatgagatcacctcaccgtggttcaatgccaactggtttgagttatatcagttattaaaaatgatctaatgttttccttttaaatctgaggccctggctcattctatgattaagccagtgatttatttataatatagtgtgagatggctgcagccactctatgatgtaatctaagaatgacatgaaaacaaaataggtttttacataatgaaagtattcctgtaatacagtttatagcaaggctttttccccccattgagaatggagatatattctttacttttccttctactcctgtttaaatcttcttttaccatttattacacttaaggcctttaagtcaatttttaaaaatcagcatttacaactccacaaagtctctggttactcttttaatcttgtcattttcttcgctcccaatccccactgccaccctccatggcctctgtgtgtagccgctgctcaccccctgctcagcactccagagtcctcaccattcctctgcttatgctgtttcttctgctggaatgctcaccccaatcctaacttttcttctgctaaaggcatacttcactggttcccacaaatagcatccttctgtagcctgctcaaatgcacatcttcctttaagcctcctgtgttgctccttccccttgttagaaacccgttatctgtactcttatggaacttagtgtaatagcaaacccccacccctgctccaagggctattcacagactgtcagagttagggaggagaaatgacttagaggaatggggtaaggggttttgatagttcccggtctgctcctaatagtgagacccgggcagtcagtcatggctcatctttgtggttcagtttttctcagctgaggaatgagtggtttggattttatttcacatggccaaatgatgtgttggtagtggttccttgaggtgctgtgctgagaaggactctgaggctgcatcctgactcagctaatgatcacttaggaatatcgccatgggagtggagagtgaaagcatatgagaggtatctgagctgcttttggactaggtgatttaaatgtctctttttgttctaccttctggatgctttgatttactgacttgtgaagtgtcttgcccaagatcacgtagcccattaagttttagaagctgattctctgacacagagatggttaaaagctacacatttgactctcacattcatacacgtaggctggctgtgggagatgaaaagctagaataagaagttctagaagatccatgacttattgaaaacacaagactactcaaactctgtatgtctttgaggttgagtgaggtcacttttcacctctttgtcttctttgcttcctaggagttatgatgtccccactattcaaatttatgtcaaagatggcagttcaaggtcaaggtcagaaaggcaggtgatcctgccagggtcttaattggatcagccttaccccatgaatccattagatctcctgttccccttcttccaactccagacaaaatgcttagctctctgcaaaaagcccaattgcatgagcagtaggtcagctcagcaaccaggtgattgaacactgggacaagaataaaggaaggaaaggaagagggcattttaggatggctgaaggtgctggaaacttgaaccctagaggaatgaagaaggaactggaagtgcttagtgtaaagaagaaataaaggggcaggaggaggagagagcagagcaggtggtgctgtcctgggtctctgctgtggaacgggtgcaaactcactttttgggacctctggaagagttctggcagcagtgggttggaagcaagagatagatagtgtgagaatgttgatgttttctcaatgtttatggaaaatgcttaatgttttaatattaagagcaaaccacagatggaatgtgtgtttcaggaggtcgaagttcacaatcactgcagatgtctaggtggggttgatgcagttaggtattttctattttaggtattttgtggtggggataaaatgttatacatgatgacttttaaggtcctccctgtcttaagagtctagagtttttttagacatgtttttgtgtacatttaaataatttccattttaaaatgaaggctctttggagtaaagtgattgttcctttctccataatcttggcacatgtaagtgctgacttaccttgggcaatctcttctccacttagcattattgaaggaaaggagactaactgaggatgtcttagaattttttgtactgaatgtatttttgaagatgatttgtacgtttcttttcagggtagttccagggaagtctcttctttaggcctcctccaaccaccatcccctattgtcaatgattggctgtttttgtactaccagaatgctttgtgtatacatccaataaagcattcatgccacttcagtctgctgtataagcctgttttcacaatctttcttctcctctagattgtagaagctccttgagggcatgaattatgtctttttccataggaagtcccatgtcatctagtataatagtttgcaaatagtaataatgatgactcattaactcgagcgtttactgaacacctactatttgctagacactattccaggtgatgggactagaacaaatgttaaaaaaaagacagaaaaattaatgagtaaatatgtaatatttacattgtgatctattaggttggtgcaaaagtaattgtgatttctgccattacttttaatggcaaaagccgcaattacatttacaccaacctaaatatattaagaagaaaaataattgaggttaaaggcatgaagagtagggaggacacaaatgtaaattcactggcctgagaaggtcttgatggtaagagtatatgtgaatggagacctgaatgaaacgaggtagcaagccagagatgtgtgggtgggatggactggaggaagagtgtgtagaactgactgaaagcaaatgcaaataacctgacctgaagcatgctggggacatgccggaaaagtgaagaggacagtgtggctagagtgaagtgtgtaaaagtggtcatgcatgccaaataaaaatagttgcaacaaccagtaagacatacatgagagatattgtgggttcagttgcagaccaccaccgcaataaaacaaatattgcagtgaagcgagtcacacaaaattattggttcccagtgcatatgaaatttatgtttacactatactgtagtctcttaagtgtgaaatagcattatgtctaaaaatacagtatacataccttaattaaaacttttattgctaaaatatgctagcaattatctgaactttcagtgagtcctgcttttgctgatggagggtcttgccatgatgctaatgactactgactgatcagagtggtggttggtgaaagttggggtggctgtggcaatttctgaaagtgagacaacaataaagtttgccacattgattgactctgcagagaaagagtgatatcaagctgtatcacttctctgtagcatgtgataatgcataatatcattttaccttcaagaaaacttctttcaaaattggagtcaggcctctcaaactttggatctgctttatccattaagtttatgaaatatttgatatacttttttttttgttgtcattcaacgatgctcacagcatcttcaccaggggtaatttccatctcaggaaaccattttctctgttcatccataagaagcccctccttatccattcaagtttaaacaaaggattacagcaacacagttgcatcttcattccacttctaattctagttctcttgctattttcaccacatcctcagttatttcctccactggtcttgaaccactcaaagtcacccatgaggattggaataaatttcttccaatctcctgttaatgctgatattttgaccttctcttatgaatcacaaatgttcttaatggcatctagaatggtgaatcctttttagaaagttttcaatttactttgtccgcattcatctgaggaatcattatctatggcagctagagccatatgaaatgtatttttttaaataatcagacttgaaagttgaaattactccttgatccatgggctgcagaatggatgttgtgttagcagacaagaaaacaacattaatctctttgtatatctccatcagagatcttgtgtgaccaggtatgagaagaaatattttgaaaggaatcttttttttttccctcttttctgagcagtaggtaacagtgggcttaaaatattctgtaaaccatgctggaaacagtgctttcatccaggctttgtcattccatttatagagcacaggcagagtagattcagcataattcttaaggaccctaagattttcagaatggtaaatgagcatttgcttcaacttaaagtcaccagccacattagcctctaacaagagagttaccctgtcctttgaagctttgaagccaggtattgatttcttttctctacttctgaaagtcctggatggcatcttctttcaatataagcctgtttcatctacaatgaaaatctgttgtttagtatttaccttcgtcagtgatcttagcttgatcttctggataacttgctgcagcttctccatcagcacttactgcttttccttgcacttttatgttatggagacctagtttttccttaaacctcaggaaccaatctctgctagcttcagatttttcttctgtagtttcctcacttctttttgccttcatagaattgaacagagttagggccttgctctggattaggctttgacttaaagggaattttgtggctggtttgatcttctatccagatcactccaactttcttcatctcagcaataaggttgtttcactttcttatcattcatgtgttcactggaatagcacttttaatttcctttatgaacttttttttttttggtatgcacatcttggctgtttggcacaagaggcctagcttttggcctctcttggcttttgacatgccttcctcactaaacttaaccatttctagcttttgattaaagtgagagatgtgctactcttcctttcacttgaacacttcgaaaccattgtagggttattaattggcctaatttcagtattagtgtgggagatgggagggtccaaggagagacgtgggaatggctggtcagtggagcagtcagaacacacctatttattgatcaagtttgccatctcatatggccatgatttgtgataccccaaaataattatgatagtcacatcgaatatcactgatcacagatcaccataatacatataataataatgaaaaagtttgaaacattgtgatagttaccaaaaggtgacacagagccatgaaatgagcacatgctgttggaaaaattgtacctaaagacttgcttgatacacagctgcctccacaaatcttctatttgtaaaaaacacagtatttgccaactacaataaagtgaagtgcaataaaacaagatatgcctttattagttaagtacacattgaagatgctcaggaaaaaataaattgcttttgtgattcaaagaatccacataaatctaacaaaagaatgacaaaacatatttctgtttttcagctctaagagatgggggcactggatcaggagcaggatggtagtggtgtgcagctttgaacaagtccagttgccgtggggtttccctccatggcagagggctctccactccgtttctctgcccctgcggcaggcacacctgcagggatgcctgggccctgggtgcagatgggcaatcgtaagcctaatcacccattcaggcacacacttacttgttttccacatgcaaatatggcctttttgcggatgaatttaatacagttgttgcttcctcattttatttaaaacaaaacaaatggccaaccatgtcagttgagggtagcaaatagaaacatgagtattatggtctttgctgtttgtgtcgattacacggctgaaaggaatcccaggcaaatcagtcttttctgtgctcaattttatttttactttatatcaccttttcttactatcgctattggttttaacaaaatttttaaagagggctatcacattcctttctcttaatcattttatcaatatttcaggctccttagttctattttgtggtttctacctttgacatttttagtttctgaacttggggcccattgttcaaagaaaggcattatggagtctccaaaagccattggcaggtggtgtctgtgacttccttagcctggaaataaacaaataaacaagcacaaattagaagtctttgccctattactgcactattagtattgattgcgcaacatcatgcaaaaagtcactttaatttatctggcaggtcctatgtaaacaccaatacagtcaagagggcttggatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaaggtggggtttatgtgtaaatgatatctgtgtgtttcattttcctttcataaactaatttaaaaatccttttggtatcaaattttaagccaaaaagtagtgagggggaacatgggtaggaatagcttacagcttgcctaacaaggttgttgactgcataagagtcaggagttttgggtaagagtgtgtgtgtgtgtgtgtgtgtgtgtgtgtgtgtgagagagagacagagagagaaagaggtaaagaggaacaaatgaagagggagaggtcagattgtttgacagtagcaacttcataggcacagaatttctgagttggaaggaagtcttatacgtactgaatttgactgctttattttgtagggaaggaaactgatgtgcctagagtagttgagagctttattcaaactcattccactgttattgagtagttaggatattagaccagcaacatatttgggtagaaactttcatataaaaaagcgtaatcataactatccaatcatgtcaactagtaaggctgctcaggtgggataacacatcaaccttctttgggattcttccctcagacatggttttggtgggaggagcatggcaagggaggggcgagctccaaatgcagggctgctctgtcctcggcgacctgagcagacacacgagcagagatcagagacactcttagtgaatgaacctccctattggctatattaaagtaatgctctgaaaaagttccgtgtggagagcaaggccagttagggaacattttgtggatcttttatatgtccttaactatatgattcttttatttttaaatgaaaaatgttaagatgttacggggtatgtatgcatagtctaaagtgatgattttagaggtagcaagacagtgagaatgtccctacatgtgaaatgggcacagttttatcagggaagtgtcaatagagggttaatgttccacgtagtggctgcaagaatgataagtggtcatggggatagcctgacactctaggagcagaaggtggtgggtatggatagaactactgatatagcatgaatccaacctgctgttatctgcgcaggcctctctgcagctgtttgccctgaagtacatgctgtacgtttctccagctgatcctgcatgactgggtataaacgcctgtccgctgtgtgctggacagccccagacaccctcggcagcctgctgtgtttgtgtgagacatgctgtgttagggatttaagcatctccctactcgttcctcatctttttctcttctcttccttctaatctcctttcatctttccctttgggggagaaaaagtcatcagagttgtttgaaggttcatttatgttgatttgtttttattttgaagctaatttgtttcctgcttgtatctgtaactgatgtacttcatgtgagaccgtgttataatatacttgagttctccttggccctctgatttcttttctttttttcttttactgaaaaataaaagatttccttctctcttcagacctacagctttctcatctacatggacaacctatttttaaagaatcttcagagagtcgttgactttgttataactactactatatacgtaatttcagatgatagaattgaaaatttaacttgtttttctagaaagagtttattttccctataacttcaaagagtaatggtggggagtaggacattctgaaaataagaagaaacatgtcaaatgaatttctgacttccagctaggcatatggaataaaggtctttattccagtgacctctgctcattggaaaactttgggctggtagatttcatgattctgacgctgtatgtcctcttgagttacagtgagtgatgaggccaaatcgcagggtggatgatgtgctttttttgggctaataggtgttaaggaggcatgctgtcctttggcgttaagacagatcatttcctcagttgggtaatgtttaaggaatccactaaatccttaaatatatggcacacataaggaatgcagagcttttagacactcagccttaacatgggttattttttagcatggctaatggctaaacttgatttctactgggtttgttcaacctatttctaacttataggtaaaagcctgctttttatcctctccatcctcatcacctttttagttgtgtctctgcttgattcttcttgcattcaggtctatattgtattataaaaagaaagagagagacagagagagagagagagaaggaaaagaagaaggaaaaaaaaaccacacacattgaatgggaaggcaggagagtagagctctgaccccagctctgtcatagccacctgtgtgactatttgcaagcattttcatccattcaacaaatacacaccaggtactggagatacaaaactgtgaaagacacggttcttaccctcaccacttacagtcaggagtagagagttaggtacacaaatagaatgtgaaatcacttctcctttctgggtcttcattttacaaatgcaagagccagaactgggccaggtgatcatcaaggtcccttctgaggctaacatgccatcattcatgcaaaattcattaaacatctgataatcacttacctaagtgaaaattagcaaacatttcccctttctccttagtttgtaggggatgatattgaagacgaatgaggcgatgtctacaaaatgctttaataagcaagttggagaaagagattatgtaagtttgaggcattatgattaatgaaaaatgaaaacaagggctgatgttttcagagagagaacagatggttcctttgttcagaatttgagtataaaaaagagaggaagaaaagatacttgctatattgtttaggccctgaatgtgagtaactttaaaatgccaaaacaatctggttaggaaagtcccatagattcaaaatagctcttacagtgatcaaactataattaatataacaaaaaaaagacagaaaaatactaataagaaatgccacagtgacagctgacacaacctgacaaaaactcctatttttacaacaactctagaaacttgattttttctgttctcaggagttataccacactgtaaaacaaactagtgagaaccgatttaaaactgtttctaccgttccccctacccctcaggttattttagtttcccatgactcataaaggaaatcttcaggattcacaagaaattggcaattcttttccatctttgctgttgagtattgataggaaaacagcatagtttggggcaatttaagtagagaacaaacctccgggggcttggggtggtgtctcagaaggccggatctgggaagggcctttgaaaagcttgcacggaaagctgcgaaataaatcgtttctttttctctttctttacgttctaaaatctcgtgatctgtttctacaatacacaggctaattgatgttatccttttggcatgattcttgctgtcctggggtctatcacttgcaggctatgagaatgaggccatagaccaccacactggcagcactgagcaaaaggtgctagacccttctgagttcaggtgctgtgtaactggtgctgtgattggacagggtgactaacctcagtctctctgggtgtaatttcttcactgtggaaagaggaggctaactagaaagttcactctgacactaatctgagttcaggtccacatctttttttttaattaattattttatttttaaaatttttatttttttgagacagagtctcgctctgtcgcgcaggctggagagtagaggcacaatctctgctcaccacaacctccacttcccgggttcaagcgattctcctgcctcagcctcctgagtagcttacaggtgcccgtcaccacgcccggctaatttttgtatttttagtagaggtggggtttcaccgtgttgtgcaggctggtctcgaactcctggccttaagatatctgcctgcctcggcctgccaaagttctgggattatagaagtgagccactgcgcccagcgcacatacaattgtaggaaggctgagaatggcttttaatttgggagcgtttaaaagcaaacatgcttcctcaagacaacagtaacaaaaaattgacatcgttgaggtgggaacttctttaatgctacctgagcctcttgctgaaatggttctatgcagttttgcatagctaggagtggtaagctcattcacagacatggaagaggcagagtgggcttagggagaggcaccagtctagtggtccaacttgggttctgggttccagtcctgcttctgctactaaccccatgagaccttggaatgcccatctctaaggtttctttcagagctgaatcactgtttggtctgtgattcatcaaagcaattagaagactatgcctctccttcaagaccaagactttggtcagaatactccctagggactttctcactgtgtgtggcactcttctctattagacgctttattcattctccattgtattagagtcaaaagtatgattgtttgttgtagaggtgccttttccgtgtcatctctgataatctacccctctctctctgagtaacctaggcttttaaaacacatctcctttggcttaatcacactgcctggtgtctactcagcattatgtgtttgttgtctgccctgaactgtgaactcagccatgtcctgctcatttctgaagcctcagcatgtacatcggtatctggttcatggtagattttcaatgaatctgagtgaatgaatgatggatgaatgattttgtatctccttactaggcatatgttccttgagggcatggaccgtgtctaatgggtggctacctagtgtctcattcttggtccgttgttagtggtgatttttgtcctcttctttgcactcatcattctaggcttgtattagggtaaattgttagcataattctgccttgtttcccaccctgcccccgccttttttttcttttgaaacagagtcttgctctgtcacccaggctggagtgcagtgacacaatcttggctcactgcaacctctgcctcccgggttcaagcaattctcctgcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacctttgccttccttttgccttttcacctcctcttagaaggtaccttatatgataatgtcacctatgcaataaagaccacaaagtaaatttaataaaatagaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatttgtctgtgaatgctttttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgatatgtctaggtgtctatttctttggtctacccttcaagtaggaatgaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacattttctattcagcaacaacattttccctggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctaatttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcagatcactctaatttcctgggcctcacttgacccatctgtgaaatggggtaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatacttgtgtatgcaaagactttaacatttattaataattttttctatagattggtgaaattggtttgtaatttttgtcatttcacttttgtggaaattgagcaaaagtgagagataaaatgatgtgatcaggctgggtgcgttggctcatgcctgtaatcccagcattttgggaggccaaggtgggcgcctgaggtctggagttcaagaccagcctggtcaacatggtgaaaccctgtttctactaaaaatacaaaaattagctgggcatggtggcacatgcctgtaatcctagctacttgggaggctgaagcaggagaatcgcttgaacttgggaggtggaggttgcagtgagacgagattgcgccattgcactccaggctgggcgacagagtgagactccatctcagaaaaaaaaaaaaaaaaagatgtgatcaatatcaatctaaggacactgtaaagcagcagaggattgacgattttcctaagacttagtggatgtagaagagtttaaaatattctagcctagtggtttgcaaacttggccacatattaaaatcttcagaggaactttatgctacaatgctcatctcagtcacagtgtctgtgggtgagacccaagctcagttacattttaaagctcccgagagtttagaactattgatctagtcttgatttcgtatcaatttctctgatggtatcttgcttgacatcttacttactgggctgcatttttgtgctgtgtctccctgacacccaagtgaaaactgctggatgaaccgaaaattcacccaaacaacgtgaatgtaatggaaactcttgaaaaggcttacaagccttgaagtaaatgttgggcgaagggagcgaaagggttagcgtttttttgcattgggacctgccttctttttatgcttctaggaacgtttaaaaatgagagcaaggaatatatttcattgctttaattgttcaaggtcttttaaaagcgtgtgcaataaaatgccttttaagataactgacctttgtattttaatgctttttggaagggaacaatacctagtgttcagctgcagtataactttatatatatatatatatatatatatatatacagtcagcagagcttgttttggaatcagagggctgagggttttgctgccttcccagatattttacctgtttctgtttcaacatcaagttccattcagttgatgtttcttgacctcataatgtctaacctttatatctttgttttttccctttccaaacttatccaagaaggagacttcaaggcctgattcattaatttttccttctgctgggaactcaggtgtgtggtggaaggcagcacatgtgacctaatctatattttgacaaagaagaaagctccctgccctcccttgcaccagttcgtttggtaatttttaatcccaaaagccactgctaatacgtttttaaaaattgatgctagctattacgttgttagataaagctcatcttccaactctaaacttgctctttctaaaagtgaaataacactcaggttgcaaacatagtgaactggaatttcagaggcttgaactgacctacaaaacttgtaactgtagctctagttatacatccactgtggtcttggacatgtgaggtgtttgtctaccctcaggagttttagaagaagaaattttatggaattgctttccatattaagaaattaaaatagccaggtgctattttaattttacagattcacaactgtaatcccagcacttgggaggccgagcagggaggatagcttgagtccaggagtttgagtggagtggtcaacacagccgagaccccacatctacaaaaaatttaaacattagctggcatggtgactcatgcctatagtctcagctactcaggaggctgaggtgggaggatcgattgggcctgggacatcaaggctgccgtgagctgagattctgccactgggtgactgggcctgggacgtcaaggctgccgtgagctgagattgtgccactgggcgacagagcaagagtgtctcgaaggaaggaaggaaggaaaggaaggagggagagaaagaaagaaaaaaggaaagaaaatatacaaaaatctttgtgtagctctgaaataaatatatatatatgtatgcagtgtatatattatatgaaataaaattgcttgtgcttaatttattttaaaatcatgtttgaaaatagagctaattctcagttactacattttcccctctcctctttctgatggtttttttcttaactttttattgtaaatgattttaaacttatttaaaaagttgcaaaataagcatagtccaatatagccatatacttttactcagattcgtctattgttaacattttatcccattggatttatcatcctcccccttcctccctcccttcctctctttctctgtctacacacacacacacacacacacacacacacacacacacacagtctcccccaccccatatatatatatatatattttttttttttccagaagtatttcagagtaggtcacttatatcattgcctctacccctaagtacagtgtgtatttcttaataataaaaaaaataaagatagtctcatcatattcacagtatggtaatcagcttctgtacatttgacactgattcaatacttcagtctactgtctgtacttctcctttgtcaggtggctcagttctgtccttgaagaaaactgctttttcccattcagtgtacagtccagcctaaggtcaggtagtgcatttagttgtcaagtctctttagtctcctttgatttggaacatttccacagcctttctttatcttttatggcattgacacttttgttctccccctttacaattatagtattcctcattttgtattagtcactggtttcttcatgttttgattcaattatgcattccctgaaggaatattacaaagataatgtgtccctctcagggatcacatctggagtcttatgtgtccatctctccgtcattggggatgttaattttgagcaactgatcaaggcattgtccagtttctccacagtataggtattctttcctttgcaattattaagctatccatggggagacactttattcttgctccttatcaaaatattaccctacattttttcctaaaccagcatttactatgattggtgcaaaattaggattccatgttactactctcttcacattcatcattcagcatcctgcgttctactgtatgcgggagccccttccttctcctccctccctcccgctctctctctctcttttcctctttcttttctttctttctctctttctttctttctttctttctttctttctttctttctttctttctttctttctttctttctgtctttctctttctttctttctctttctttctttctttttctttctttcttttctttttctctttctctctttcttttctttttctttcactctctctctctttctttcttctgtttcccctcccttccttcctcccttcccttcccttcccttcccttcccttcccttcccttcccttcccttcccttccctcccctcccctgccctccccccctgccctcccccccgccctccccccttccctccccttttctttctctctctttctctctctctgtctttttctttctttctctctctctttctctctctctctttctctctattttcctctttctttctttcttttggttatggtcttcaagatttctgtttcaatctttcataattcattcttgctatataattattttggccctcaaattatcccagatttggtcagtgggagctgcatcaagttggctcctgtgtccttgagacatgtccccatcatctttgttgttagcaattgattaattgctggaataaaaagatgttctagtttggtcttgtatattctctgtcccagccatgaagtcaagcatgtcttcattatgtcctcactctttttatgtggagaaagatgttagagaccaatatctgagtgctaggtgtgctcattgctactctggtgccttaacttatagcctctttcaatgactggagctaggaaattttatatataaaaatatatatgtaaacaaaacctacgtgtatatgtttatctgtaaatatatgggtgcatatacaaatatgtatacacaaatactactactattaatttgctaataccacttactacacaaaacaaatctgtgaaaaagagttgaggatttgcttatggtgctcctccttcaacttaaccctgcccaagactgagggtatattgtcaaacgctcttcagggattacctggattagttctttcttcatgtgtctttcccctatatcccaatggtcattatgttcatttaaaatacagttgggttcaaatgcttcagtttgctttgagttttagtttccctccttcccatcctagtttgtttaattttattttttgaatatgtaaaacattaacatgcttccagaagccaaaactaaaccaaaagaagtgccagtctctcagatatttgctccaccttgttattccccacacctcttggaggttttcttggttatctttctggtatttctttttaatcctgatatatatatatatatatatatatatatatatatatatatatatacacacacacacacacatatatcagattatagcgtcagattatctgtgctttccctcctctcagtaaaacctgtaatgccccttcttccccaaacatatatatatatatatatatatatatatatatatatgtttttatatttcctcttctttcttacacaaaagatagcatgttgtatatcttcttttgcactctgatttcgtaaattttttttctttttttttgcactccctctcttcttttcttcttctctccctccctccctttcccccttcttccgtttttttttcctctctctctctcctgctcaaccaatttcctatgcttggacagttggatagttttctgcaatgaataacattatgcatatgtatttccatatcattggatatatttttgggatatattcttagaaatgggtatgctgggttaagagtaaatattttatgaggtactttagttaccaaatttttctctgatggaatgtcccactagcattcccaactacagatgtctgtgaagcttatgaattgttgccaatttgatggatgagaagtggtatctcagtatagttttgatttgcacatgtcctattaggagtaaagttaagcatcttaatgtatttaatgtccatatgtattcattttgtgagttttttgtgagttacctgttcatgtcttttgcccattttaaaattttattttattttttttgggacagagtctctctctgttgcccaggctggagtgcagtggcacgatctcaactcactgcgatctccgcctcccaggttcaagtgattcccctgcctcaacctcccaagtagctgggattgcaggtgcatgtcaccataccaagctaattttttgtatttttcacggagatggggttttgccatgttggccaggctggtctcaaactcctaacctcaagtgatctgcccaccttggcctcccaaagtgctgtgattacaggcgtgagccactgtgctcagtcctttttttttttttttttaaattgggtttttggtctttttttctcaattagaaaggtcttcggaaattagatatattggcctttcatctatgaagtatattacacatatctctcccaatttgtttatcttttgactttgattacagtgttttattttcttttcagtcatataaaatttttatacttatagagacaaatttaagaatcatttcttttattgcttctggactttgttcgtagttagagagcatttcttaacacccgtgttatctgcatgttatcttccagtacctgtatagtttcatttttcacatttagatctttaattcatctgcagtttgtgtgtaacataatgaatggatctaattttacttttttccaaatggttatctgctgtctcaacaccatttagtatgaaaatatcttctcatacttcccgtgtgatttgagattggtggttactttttaacctacaccatgactaggtgtgaaggagaatgatggtaaacagtggaacagggtagttagaggaaaatgaggtcccaggtagataatgactgaaacccaataagaacatacatatttttgacttcaacacagagctctttaccttttacaagtcatcctctctggtccatttttgtcaaaaattaacgtatttaatagagaaggtgtttaaaacaaaaggagggtttagagattatctgtgctttccctcccctcagtaaaacctgtaatgccccttcttccccaaataaattatgagaatggggctgcataaattttctgtgagcatgtgtgactatgtttcctctggttcctcgccgcatggtaattactctgtgctctctcctgcaaactgcccatgtttcactgcttgtaggtcaaagctgtattgagtaagaagtgaatttgggaagttttgcaagtaaagtgctacctgagtcagtgactgtgtcttaattcacctttttgcttccaggttcttgctcagggccatctgtgcacatggttttcactcaataagtgcctcatgaattttaatgactacacattaaactaaaacaaggtctgcccacctattcttaagaaattaaactctacaaatgatgtattccaaaactgcaaaagagagtgaaagccaaaacagatgaagctgtccttatatgggcaggaaaaactcagtaagattttatcagttcagtaggtgttgcatatggtgatttggaactgtctgccagttccaagatggccttactttattgtatggtcagtacagtttgtatctagtcctcatcaggttaggcctggaactccccaacccctgttaaaaacagcaaatcagggtttctgtggtggaatggggaggaaactggcttgcattaattgatgtataaggtagcccatgataaactcaatgccacttttatacacatctgggagcaagagcttttggttaattggcttgcctatgtttttgctctgccttggatgctacagaaatggaattgtttgttagagtcgttgcatggtgaaggaaaaatcagagccaaggttttgaaggacctaagggagaacattctgtgttctgcaggcatcttcctccttgggacacaaacagctccctgcctaccacacacagtggataggattccttcaatgcctctcctcgggtgaaagatgtggcatgtggaactgaacgatcaaaatcactggggcaactgtatgggcgccctcctgcagtgtaacatcctaacaggacttttgacaggaatggatacctaaatatttacactcctggaggcctcgtctgtctcaaccatacttaccagtcaccacagtgtctcctttctctgtgtagtactggataaatacagataaattctacaccctgacttactcctacctcatgcaaggaagttataaaatgtttgagtagcttacttaagtattactcctgccatggcttcttgacatgccttgatggagctgtggaaagcatcttggttgcttcaacacaaggctgtgagttgtttcatagggcagggtactaactatagtttgctgaccttatccactgtgtggattcatcttgggaaaggagcagagaaggtactgagaataccacatctgctgaagactctgctggatgctttctccagacatctcatacagtcttttcaacacccactcaagatataggagctgttccatttcacagacgaggaaacggaggctcagagactttgcattagtctaccaggtcataaagctagtgttcacagaactgagactcaaaaccaggtctgtatacccatgaaattggtgcttttcctctatgcctgacacatgacacatcatatcaaggcatcaccttttcttgaatcttattcatagattctgggcaagcagcctcagcttggtcctatgaaacctttcctgacctcctccacacaccccctacacacactctgtgaacattgtaatggttagttgtatacacagttgtttccagtgctggactgtgagttcttctggatgtcttcctatagtgtttaattcatagctggcttttgatacgtatgtaatgaaaattctggttttctgcaccatactgtgtttccatgctgacactaaaaatctagacatgctttcttagaattaggcaacccatttacctttaaggatgcactgactttggtttttgccttaatatttggccaaaacctgctctttgagttcgacctctgctttgcctttaggagggtaaagtagccaaatacctacctcattaacattgtaggcaactctgaaattttgcaggataatcattgcattgatgcgaacatcacactggttaccgtcataccgtatcagcataaaaatgttggcaatgaatacgtatatttttcaaatttgttgttaataaccagatatgtacttttaaatatagtgagcattttacttataacttggaatggaaaaccttcttaaactactttgtacgctgagactccaccaactaattgaaatataaaggaatatattatattaagagtaagatgctacaatatttaatgatgactgtgaaagctaataatgtatgggttaaataattaagaactttcaaatagttaaacaagtagggaaattagttggtaattaatataaaaattagattaattaaaccttagttaatgaatattagctaattgaggttattaaatcttagttattacagtttgttagctagataactttgggttgaccaacacatcttttttcagctaacaagcatttataaaaatataaattgtaatctaagtattgttatagaactagattatacaataattataattgttactgggttgtttgtggaatgcatttatgacaccaaacagaatgaccattaagaaccatttttaacttttagttatttaattacacttaaggtcatcagtctttcaagaaaaagcctatttaagattttttttcacattttctgaagataaattaaaagtagagtgtctacactgtctctcaacatttcctgatcaggaaaacctcccaaattacgtatagcaacatcaatgataaatgatttttaacacagagaaatttcatgtgtattcttatatcacaaaaattcagacgatgataatgagagatttcagtctcagctttggcttactattgattttaacattcagtcatttggcacttggcccaagtgggtaatgggtgcatatctatcagtggctcttcatacatttgtgcagggaggtacacatgcatacgtgtgggtgtttcaaagtctaactggaataggcctctcacatttatctcctattaatttgcagattgtttccatggtcaccatccagaaatttcccagtaatccttgaggaagttagggagtgtgataccattagggagagggaatatgtggcatagagacgtgatgggcattagttgtctgaggttatgaggtcgtggtgaagcctgatcatgtgaccccatctccatactctatgtccagtgctccagatcccatagacctgaatcttagttctggtgctagaactgtccctgatgcacatatagtaagactttaatttccattttccctgtcttatgaaaagaagtgttgataagctcattaattagctttctgctcatagcttttttctgactgctaatgacttcttgaggatgggcaggctttgatgagctgtgtggtcctgggaaagccttggtgtcctcttttacctgcacagtgagggtgacggtcgtgttacctcctgaggccacctttcagctttgccattctgtcatttgacaaagactgaatagagaaaagacaagatttaacgacagttaaagtccaagccagtttgtatttgctgaaagacacaactgagggaaaggaactgacatgtagtttaaacagactggttttttgttgacatgggaagtgtgaataatacttcttcctggtttatgagatatgaaattggttgtctaccttatctgtttctcacttttgttctcagttcatagtttggtcatggaatgcaattttgaagacaacttcaagttgtttttttgctcagtaatcatagtagtatttactgttgttcactgggcacccagtctgtgtacacacatcattcctaatcttagaagaaaaacaacgtgcaagacatgtgttttctttcccactttgcaaataaggaactggggctcaaagagattaaaagacttacttaagttcaattagaaagtggcagagccaggattcaaatgttggtttgcctaactgcaaagcctatatccaccttccacccagtgctgctacagcattaaagcctgtaaattgaattccacacactcctactttcacctgtactattacagtgataagtaaaaccagcgctgagccctactaacaaggtgtccttgatttgtgtgctgatgctcatgacacttctgtgtggcatctgctgacaggcccacggggcccagatgttcccactacaaagagctcatcctggactccccaaccagggaaagagacctgaaaaggaactggtttgtgattagggattattgtgatacttgaagtgaatggtcagtcagttcttcccatttatttgagttcttacttcccttccctttgaacatttcagtcaaacttctaacagtgactttcaacactggctgcgcattaaaatcacttggggaggttttgttttgttttgttttgagacagcgtctccctctgtcatccaggctggaatgcagtggcatgattatggttcactgtagctgcaaccttctaggctcaatcaaccctcctacttcagccttgtgagtagctgggaatacagggacacgccactacgcctggctaattcgtatattttgtagagacagggtttcactatgttgcctaggctggtctcgaactcctgggcacaagtgattctcccaccttggcctcccaaagtgctggaatcatggagctttttgtttgtaagcatgtcagccctcaccttccagagatcttgatttgaatgggctaggttggggttctcgctattagcgcaaaaaaaagtaagtactgaagggattctaagattcgtctagagaagacgatcaccgcattagggggcagaaagtccacttttcattattttgttggtacagtatactttttttctgactctatgaaccctcaatcttatgatgttaccattccattgaagggtgggatttattcactgagaacatttatatttttttgagatgtcttaggctgtggagagggtgttacagggatggacacagatgctgaatttagtggccccagagaagaggaattaaccactttggattggattattgggagcaaccaaaagtcagtgctgtggcttttgctgtcttcccttgtaatctcttcccctcaccagattttcaacacagaaggggtgtattttctagttatggggtattcacaatcacatctaataattttactccagaacatactatggcttgtttatactagcttgaatatttgtagtctctttgatttttgtttgctaatttaatttactattgcatataaaagaatggcttccatggagataatcaccgtggctcccagagtgcatccagagacatttgccttgcttctgtggaaatacacccaaattccccagcatgacattgagtgttcaccccacacctgacaccagtctctcttgctctaattaaggccactctttaccattcttgggcaccagccagatgaactataccctggtgtgggatctgcccgatcctgctgagacattaactctgtcctgaagctgtttgtccttccagcagctagaaataatctttcctttcctagaacttccacactgcattgagcaggaacacttgtagaacttctcacattgtacctcaaggtattcttatttatgcatgtatataatttctccccttctactactgtaagcttctgcagggtggggcagcctcttcttaattttgatatctactgctgtgccaagaatattgtaggcatttcctaaattatttttcccccagtgtatgtgttactttgttcaattcagcagttgtccaaagctaatctcttgagctattggtagctttggtgaacatttggagaggactactgtgatggcgtaaaatccggtgacctagttacagaatatcccctgcaggctcactggtaaggaaggctcatgtttaaactcagtgaaaggagagcctggcttatttatggtggtggttgtttacatgtctttaaatgaccttcttttttttttaatataaaggcaatatattctcatagaaaattcagaaactgtaaacagggttaaagaagaaaataaaaatcaacactatcactttcacctatttattattcttattttatttatttatttatttatttttaaggcagagtctctttctgtcacccaggcagtggcacgatctcggctgactgcaacccctgcctcccaggttcaagcgattctcctgccttagcctcccaagtagctaggattacaggcatgcaccaccaccaagtccggctaatttttgtatttttggtagagacagggtttcaccatgttggccagactggtcttgaactcttgacctcaagtgatccgcctgccttggcctcacaaagtgctgggattagaggcgtgagccactgtgcctggccacttccacctattattaatgaaacctgtcctatttaacaaaaacgataatgtggggtgtcttgtgcttggagcttggagaaaggaatttgcctctgtttttttaatgacttatggcaaggccagtatgaccagtaagtgggctgtttattattattattattattaatcaccattgtcactgatagaaattgtcactattgtcactgatagaaaccaagatagaaattgtcactattgctatagccccaagaaggacctcatggctgcataacgattgagcaccttatatttacacaatgcttggttgttgttttttaaggcaactgtgactcaacaacagctgtttgagaacagctccatcccagatgaaatcagaggaaccgaagtttaaaaagaaagtgtttctgggctgggcgcggtggttcacgcctgtaatcccagcactttgggaggctgaggcgggcagatggtttgaggtcaggagtttgagagcagcctgaccaacttggtgaaaccctgtctctactaaaaatacaaaaaaattagcagggcgtggtggtgcatgcctgtagtcccagctactcaggaggctgagtcaggagaatcccgtagtcccagctactcaggaggctgtcaggagaatcccttgaacccgggaggcggaggttgcagtgagctgagatagtgtcactgcactccagcctgggccacagagcgagactccatgttaaaaaaagaaatgtttctgagcactaaagacaatttgaacaaggcagaaaagtacaaataggaaaacaataatcttactagattgtttgtttttgagacagcatctccctttgtcatccaggctggaatgcagcagcacgattatggctcactgtagctgcgaacttctgggctcaatcaaccctcccacctcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaaaaattttaagtcaatcaacatacagatatttgtcatcttttaaatagctatagattttcgctcagactcaaagtctaatttttaaagaagtgactgttatatttaaatcatatatagcttcatgatgaaaaaaggaaaaacaattcttgggaccggacatggtggctcatgcctgtaattccagcagtttgggagaccaaggtaggagaattgcttgaggtcaaaggtttgagaccagcctgggcaacacagtgagaccctgtctctccaaaaaaaaaaaaaatatatattagctagatgtggtggcacatatctgtagtcctacccactcaggaggctgaggaggtgggaggatcgcttgaacccaggagtttaaggctgcagtgagctagaacggtgccattgcacttcagcttgggtcacagagtgcaactctgtctataaaacaaagacaaaagcaccacagttcgttagatataactgaatattatcttcatttcctactgtagtggttcttagaaaggttgtttcttaagttagaaactgttgcctaagtatttaggatgtggcaggcactgtgctacatgctggggttgacgaatgcatgggattcggctctctcccaggctggtgggaagaggacacatctagaagccagggtatataccccgaaggggtttgaggcagtgcagagttgatgatgatggtctccagcctgcctttcctttacaaaaatgaggagactgcatctcacattgccaacgagctgcttgactctaccgatattccctaccaagcacgattatgggtagtcttaaaattcttaataataaaatagatattgaaaatagtgtttttttttttaacagtgaaagtaatatgtactcatgtataggttttcaatatacaggaaactataaaatgaaaaggattgtacctgtaatcccaccccttacagctaactactgtgacattttatttgtagaagtccattttgctatcagacctcaagttttaaaatcttaactcaccctctgtaacctagttctcagctctattttatgtaacgtttttaaaggattcaagatttaaaataaacttatctcaccccaaatgcacttgtatatttttgacaccccctcatctctctctctctcttgtctctctctcttctctgtctctcactctatctcagttctctttctcctcttctttctctctctcctctctcctctctctgtctttctctctctgtctcacacacacacacggggaaaaaaaatcactcgagttaagaatcagtctctcattttacagataggaaaactgaaatctagaacttgtctgaaatcatgttaaaaaaaaaaaagtggtaatctgtgctcgaacccaggtctcctgaattttcgttcagtgctttttccattctacagtgatgcctccttactaggtcatagaaacagtggcagagggagaaaaggaaaaatacgtcagctccaaagagtgcagtttttttttttctgtgtcctttagctgagctatttttgtgactattcagtacatgtacaatgctgcctcttggagtgttccggctagactaagaggccattcactgctgactgcagccatgccatccctccatggaatcctcggcccggaaatcagatgggaacaaactattccaatatacaaatcaaatttcagagtctgagtgtacacagaaaaattactggatatcctgttggactatgtacataacaatgacacagtgatttatgagggtatgatggggcagagggtagcgggtgatgttggagttgattcatcacttaagcgctaatccattcaccagctccagtcagacttcaacacaaatgccaaattattcatcttccctaaatccaaccctattattttctctctcaaaaccttcagttgcttccttttgcatatggaagagagcgtggactcctccatctggcatttaaggctttctatgatctgtcctcccagacattgataggctgtggagatacagtaaggtagttgttatgagccacaccttgcagccaggctgctccagcaccaagcaacactttccccgggaggttgctgcacctccctgctcctcactttcctcatttgtggaataggaatagggtcattgtgagaattaaataagttaatatttgtaaagggtttaacagtgactagctcataatccgtcacgtagaaagttttttcttagctcatttaataagtacctttctaacccatcactgatagcatttttcttttgcaccagacttctttctagtcattgctgggagcgtcctctcattttcctgcctccctgtagctgtcactctcactcctaaactgttggcgttctcattttggcttgcccaaatcttacgcattcttttaagtccatgttcaagtgaatcctcactgattttgttcttcattcatccccttaacagacttttatggagggtctactgtgtgcaaggtgtattatgtaggaagccttccacagttcccagagctaggtgagctctgtcatgtaggcctgtcttgtacatatcaccttcgacattgctgagcagtttgtgttggacatgtttgatctcctcccctagaatataaacagctggagagtaggatgcttattagtaggtgcttattaagctttctttaaaatgagtaagtgcacatgctaccttttatagatctgttaccttctaatgaaggcaagaacaataggaacaaacattagttttgtgtgtgtgtgtgagagagagagagacagagagggagagagaaagagagagagagattttgaatgggaataattatgaggccacatctgagggcaaataaccacttccaagttgaagaaaggcaaggagaagacaggaatgagaggagagctgtagcagtcaaaggaaacgggatgagaatatgttattctctgaatcataaagcatttgctctgagaaatgtttttccttaagtggtataaaatgtaaaatgaattgggtcttagtttttcttttcctctttaggaggttggagctgatttttaaaatgaggtaggggagggaggtggggtttggagaaagaaagtgaaaattgttttctgaaactctgtttgtcaaataactctctggagagaaagttcagagggtgagggcctgccaaagctgaccagcagcacacaggccaaatcgttctttcgtcattgtcctggtcacttccccacccctgttcgccacccccaaacaccttttttcttctctctctctctctctgtgtgtgtctctctctctttcttttctttccttttttttctttttataacatatgaatattataagtaagtagctggagaaaataaaaaagcaaaacaaaacacaaagtaagcagatgatttcaacctgcaattatttgtcaggtcataaaaatgatgtgtcttagatttatttacctgatctcctcatctgttttccactggaagccttctgctcgcgtcacccttcttcatttagttccccaaacttccacccactttctgactcaaagcaggagagaagcattgaacaaaaccactggatttggagaagagagaaaagcagcttttaagaactgactttagaggtttagcacgaattaaattcctggtcttttctttctgcagatttttcagctattgttgttgtttgttttgttttgttttgttttatgtttcttgagtttatcgctaaagatgcttttccgtggatggcacaaaagttcagctatggccatgtgcttactgaaggcctgtatatggaggcatcacagtggctggccttgaagaaattaagatagtgaaagaggacccctgtctgcgaagaaagagctcatgtttgtgtgtgtgctcatgctttgggtgctacaaggagactggtgtctggggaagggaggaagggtgatggttacaggtataggtaaataagttttccaacagttaacaatacttggagacaagctacagagtgatcaatgctagagttaggaacgctgtgagaaggcaaggtgttctgtttgtgccattggggagggctttgctgtggggattgggggaaggatattgttttaggctttgctagatggctaggactttaacaaataagaaagaaagagctgagtctttaagacagagggaatagcagagacatgaaaatatctagagagattgggagtgggaggctgagtctggaggtgagatatctgtatccaatcagagaagtttcctatgccttcctgtaatgttggaggcttcttttttttttggtaatcagtaaggagctgtcatgggctttgtaaaagggctgtgataggattactctggtgtgtgtgtgtgtgtgtgtgtgtgtgtgtgtgtatgtgttttgcttttactttatacatttcagagtctttttaggaactcttaggcaaccttaactctggggagtgtgcattgcctgtctttatatgtctttacttctctgttgctgcctggttctgctccttctcatgcttctgtaacaaagtgcggcaatgcaggcttctagaaggtgatgtgagatctctgagcagaccatgtgtgtgttcttcccatccttttttcccctccctttctcttcctcctcctctttctatatcaccaccctcaccagcagcagcagcagcactcccctccctaaaataaataaaccagtcactccaaaggttccaagcacattagtcacatatcccagaagtttaatacagaattattttgacagcgagaacaagaagtgttttctagttgaacgcacagaacttgcttattccaactgggctttctgccgcacagacagatgatacgttttttagatggattggccgcacagcgcaggagactgtcgcttcccttggatacacagcaaactgctcactaccaaaagtggctggggagaagatgtgaaaggagagagagagagcgcgagagagacagaagagaagaggagaggggaggggaggggaggagaggagagacggggaagacagagagagagagagagagagaaaggaaatcaagttcttattatgtacataactttctcattaatggcttccataagtcactgagagatttctttgtgtttatttatttatttggctgctttggagccatgagtccttttttaaacccgggtttatgtctgttctaaaaaatgaggacagatcgagttattgccatgcgggtggctctccaagcattccagttgcatagctcttccagaaatatttcttgacgcacttatttagcactttctattgccgttactgagcagattacagaatcctcccggccctttcaccaaacccgtctagagctggtatggatctacttgtgcctatctggcagatagaaagatagaggaatgggaaggtgaagtccattgttactcatgaaggattttgaccagtaacctcagaagagtcagaagaagagaaaaagcatgtgctctcctctttcctgctttgcttttctgcttccaagtccctcctccaagcaggaagatctttcctgagcagcagcgtacctgggtgtgagaacccagagggagtgtggtggagagacgtgaaggggtcagttcctggaacattctgttccctctagctcccatgatcattgacttcttgcctctcaagtccttctagggatctccaggcttttgagaggctcagctgacctcgctcactgctgtgcatgctctctggagctttcttgtcctcttttggttgtttcttactagcccctcattcccaggactttttctgaggaatctctgttagttcaggtaataactggctgtgaaacctacaatagtaagttctttggatgtcggtgttttcagatgtttcttcttcatggaaactctttataaatccctcacaaaatgggatgtcaaatctcaatatgtaaaataatcaaagtgcagttaaatggtggtgctgttgttaaaaggtggaagatctcataggcttctagccagggccgagttatctccccagaagagctctgtgcctctgtggacccacttagtaagccattgtactggagttgctttaaggctccctacagccctgatgacctgtgctcagcattctttcagctttctgcctctttgtatatctttcaagcttgagaaagatcctctatagatcaggaagatgtgtccagtaagagatttgacctttgctggtttcttgacatgggctttgatgaaacccttttagcatgctcactttagatgattcttctcaagggggatgtcagccccaggaccccccagacctccatccctaaacccgggcttgcgtgtctggcaacccagggccagcacttcgttcttacactcagctgagtggtagtcctgccaccattgctgtggctctgggactatagcctctgccttaggaacacttatgagaggaatcgatggaattccaactatttttaaggatttttttttttttttttttttttgctgagtttgcattgcaaaaggaaggtagagcacgggccatctctccctcctccacttatatttattctgcacctacctgcacgtgacactctgctattcttcagagaaggttctgacctttgtgaccacgctttacattttcacattgcaaggcaatttctaaagagcttttcccagctaagatctcatttgagcctcacaacaactctggggcaaaggagactgtaaaacaaacaaaaacaaaaacaaaaaaaacaaaaacacaaaaccaaaacaaaaaacaacccccaaaaaccttagacaaatctaattccacagtttaattaagcaaagaacaattcgtgaattgggcaggccccaaaccagataatctggcactgccatttggttgaagaacatttgtggacagaacaaagaaggtgacggacagaaaacacaagtgaggtacagaaacagctggactggttacagcttggtgttttccttatttgaataggtttgaacagttggctgtctttgattggctgaaactctgtgaatggtacaagagtaggttgcatcctgtttacacatcctgttaggacggaggaggcagctttaggctaaacgtaatttaacaagattcaatgagattatacctgtacgcccaagttcacagttaggtagagaaggattgtggggatttgaagcttaggcttactgacttacgccattgtgccatatcattcattctcctcgtggcaggaataatgaatgaatattctattaacaggtactacctattaaccgcttacatatatttcaaatgttactaggtagatactttttacaggcctatttcatcttctcaacaaccctataaggtagaaattattatgtccagtttgttgatgaatggctagaaatatagagaagataaataacttgctcaaggttatacttcacagaattgatggacctcgaattctaattaagattgctgcctccaggggtctatcagtataggatgtgatctttacccatcctgagtcctaggagatataaaacatgctgttgaaataacaaagctggtttgtgggtgatcatatactatagtaaatacgacatactgttaagggttaataggtggctgttttctgtgtttgttcctggagatcgtaatatctttatgctgttccttctacttcctttttcaattttatgagctccatgttgaaattatgagtccttaaccctattgaactgtgtgccattgggcaagttgtttctatttctggggtattgatttccccgtctcaaaataaatatcttttcctgctccgatcattctttccttttaagtattacctggctggtgaatgtttatattgaattctctttgtacaattcctttcaacaatattgcttggaattataaaaacttaataattgttttaaattgaaatgacaattgcaggttatccttgctttcaaaaagattttgtttctgaaatgtagcttgttaaaagtttggaaataaagcatcacatgaagaaataaagttatatcaagaaagatgcctaacacatgttctgattggctagctggttgtgcctttttttttatgtgtgtgtgtgtgtgtgtgtgtgtgtgtgtgtgtcactctgtctcccaggctggagtgcagtggtgcgatctcggctcactgcaacctccgcctcctgggttcaagcgattttcctgcctcaggcttcccagtagctggtactacaggcgcgtgccaccacgccctaatttttgtatttttagtagagacgaggtttcaccatgttggccaggctggtcttgaattcctgacctcaagtgatccacccaccttggcctcccaaagtgctgggattacaggtgggagccactacacctggccgtgccttgttttttagtatcagttttttcttttcttttcttttcttatcgtttcttttcttttcttttctttagggtatgattctatttatttgaagttccagaaaaagcaaaactaatctgtggtaatagaaaatcagagtatagtggttgttcgcaggaaagaggtggtatgagattgcctgagaataggcaaaagagaacttttcagagtgacaaaagtattctgcatctttgataggagcacggattacttagatgctttcctttttctcaactggcctaagtttctttttctttctaatgcttgtataagaacaaccttcgttcccaaacacacagacgtgtgtgtgtggacacacacacacacacaaacaattcttcagaaagaaagcctcttacgtgtgttaaacttgccacttttttctcaaaatgtgctttgtatttctttgggtgagcaaaagaagaatcttcctcttctcaagttcagagtttgaatcaattcttcctgtcttttgcatttcagtaaatgtttcctagatggattcatcggttttccagtaaagacaaacagctcagaagccagattacattcatacccaaggcctgagttctgtgacccaggcatcagagctcagtgccatatatggcgaaaagaggaacaggagcaggagtggagggagaatgccagacatgcaatgcattcctcagaaatgtgcattcataactggcaaaacaggacccttgctggtttccatcttatgcagaacatgaactgtgaagttttgagaaagaagctaatgttccaagcatctgccacagggaacagtttattttcccttttctttttggtcacatgtcggtttaatttggagtcagtgtttaagtcaatgctggcatggggtgaagactaagaaattgttcttgcagtcagcagacatgggttctcagcccaactccactgccacccagctgcaaaactctccttggcttgtttttaatcaatggcaaagtagcagggttgaatttgatgatcttcgagatttctactatttctgttttctttggttctaattttgcccgagattttccagttcctgtggaattccccagtgaaagcattttctaattcttccaaatactttttgtggcttgaacttaaaaagacaaaaacaaaaatcccagtcttgaatttttctttgtgatttcctgaagtatgttttggatgcattatgaatcttcaattgacagattatttcttgctcggggtagagaagaatgcatttcctgcatcttcatggtcttctttcacttgcccctcttattgttggagaagaaatgtaggtatgttcaacacatagttgcagggacagctgtgcactaagcaaatgcagacttttaatgaccttgatagttgtctgcttctctcatgcattgaagccttttctgtggaagaagtgggagcagcagaaggcagattccacagcttcctcacacctcaagagacggaattagggatgtgagactgaggtgttggtttcccagtcagtaatcggatgagacactttgctgtcacagatgttaagaaggttaacaagaaatagaattgtaaaactctggccctaaggtggactacggtcactttcactttgagataaggcatgattttaaatgctcctattggtctttatgggttctgtagtctattttcaacagactaaaattgtcttgttgcaaaagtttgcaattttctgcttctttgggagagggttcaaaccaaagttgtcctcttccctttctcttctgaaaggatgacgttagtttctcagctgaaataaaggaaggaggaagtttccattgggtcttaggaaaatattccagcattgggctttaatggcagctgatgtcccaaacttgtgcacaatggctccgagaaggccatagtggtttaagaggcacccataatagtcccttttattcatgctgagaatgaagaaccaggggcaacactaaagaaacctgcacttggcttttccttgctgcttgtggtccctttcctggaagctgctataacacagccaccaagtcctgggaggaagagaaggaggggattaattcttatgatgcagggggatggctccagagagagtggaagcaaagacatctgtgttctgatgacagctgtgccacgagtttgctctgtgacttggtcaagatgctttgcaatttgaggccttcatttctccgtctggcaagtggacatgctagtggaccttgaaggcctcttctagctcttaaaagcatgaatttaatatatttccagattgtctgtttatgtttcctattgcatgtacttggtatgcccggtgacactgagctcatcaacttgtaaaaagaccgtgccattatcttctttaacggcaaacagaacaaaaacagaatcctctttgtgggtgcctgctcaccgtaatattaggaccaaattcttttgtgtaacattcacctcctttcccagtctagttccacctaacggttctagtttttgggaagcgtttgcttccatgtgtgacattcatctttactttgagctctctgtgagccttttgctactgcagaggtatgtgtctgttgaaagagaggaagctgtacacgatgacacggcagagtcattgggtcaggagtggtgttgagaagaatgaatcaggatgctggggttctgtgatagactctacaaatagtttacaagaagatttagggacagtaagcacaatacatcttttgcttcagtcaaaagcataaattttaatggttacaaatgcctggtgctattatgagaaaaccacaggaaagaccattatataaacagtaataatttgttgactatgactaatcctttggggagtatgatatgtgacataggcgtataagggctttatgtagactaacccctttaacacctattaacttgttagaccctgctaatgggtccacgagggtggcaggctaaggaatgctaccctctatttactaacgagcaaagcgatgctgaaatacagtgaagaagctgtccagtgtcacatggtgaagagatggcataacagagactcgttcagtgcttttatgcctgcgtcgtgttttctgcctttccaggcttcagcctacccagtaaagcaggataaaaacacacaataactgcccccaccacccacagccagaagatggtagaggatgggattgaattagtcatgaatcatgtgaaccatagtatttggtgaatcagtcttggtaattggtggggtgatatgtcagtcagtttactttcacaactgaattatcaactagggcaccacgatggaaaacagaattgaggatttctactttcttattattcatttgtacgtgtgtactttcacttatttaaggcaatgaagaactaataatacctaatatggtgccaggctttgtagtagatgctgacctgtagaagtgaaccataaaccctaagccaagggctataaaatactttaaaattcatgtagaatcctctctcaatcttacccccctttcatttttcagtgtgttctctgatacttttgtacttttgccaggtgataagtccaccttgacttggctattttatatctttttttttttttttttttttttgagacggagtttcactcttgttgcccaggctggagttcaatggcacgatctcggcttactgcaacctccacctcctgggttcaagcgattctcgtgcctcagcctccctagtagctggggttacaggtgcacgccaccacacccagttattttttgtatttttagtagagatggggtttcaccatgttggccagactggtctcaaactcttgacctcaggtgatccacctgcctcggcctcccaaagtgctggattacaagtgtgagccaccatgtctggccgtctattttatatcttatagtaaaggatggttgcctcaaaggctgtaaacgtcaatgtttagagatatatatgaaattatttgtaacttccttcaatagtaactttcaaatgccacccttacatggctttatgaaaagtaaacccttctcttaaatgtctgcttttttcttagagtaagtttcttgtgttggctttcttttctctcttctctttatcagtgaattcatttattctaaatttttttctgatgtagtttgggacttcctaacttaacaatggaaattgaaaattggagaagctcattctgtattctttcctttttattccatttttgatactggattatgtctgtataattgctcaaattgtgagtcatgtaggaacatgctctgtgtttctgcacatgatatttaaaacctatttatgctttcttaaccacaaaggggaccataaaagtcctgtcaaatagtcccagactgtaaattccttgaggtcaagagctgtgtcaaatttatttttgtacctctttctgctacagctcccagcccctagcccagtgccaggtagctctggcaaatgagagtgggattgaattggatttctcgttctgaccactctcttggtgcctttatcaacttgtccaccccattgggaggaggggcatggacctgtcaagtgtgatgaattggtagatcatggagttttccatcctccactagaactttagctgtgtttagacttcagaatgctgagtaactaataaaaaacgattccaaagcactctgcagatagaaagtgcttcatgtgtaataaataataatagcctcttaagattaggcacagccacacaaagaagtgccagtcttgcaggccgcaagaattcctgatagaccttatggttagagtggattggttgagactgacccttgtcactgttttgtaataagcagtttcacctccaagttaccacgtattttccattatgggaaaagggtagtttctgaactatctaggaattaatccttccaattatcgttaggagtctgactgaaggaacaccatgaaaattgacagtcaagctttctaggtaagcctaattcagtgcttaaatttagttctaaatcctgtccccttctccaactgttatttctttaaaggaatcagcagtcacctctattttagttctacagcatgtggtggtcttaagaggtggaaactggcaccttttcccaaaggagagactggaatggccagagcccatcctgactttgggtcatcactttcagattaaaacataactgtacagagtacatttcccttgattctctgtttccacagagaggcttttctgctttagggtttcattgatgggatgacttcttttcctttgtcctagagtgcgggtcaatctaattcaagtttggtgaataaatggagccataaactgtgttacccactttatttatttatttatttacaaatgaggtctcccctccctctgttgcccagcctggagtacagtggtgtgatcatagctcatctcagcctggaactcctgggctcaagcaattctgccgtatcagtcccctgagtagctgggacggtgggtgtgcaccactgtgcctggctctccaccttattaaagtgagttaagagaagcataaacagtgttttgctattcttcttggtaactttaaatgatgctttcttctcagcaatgatggtccagtctaactgggcatcattcatttagctattatttattgagcacctgctgtattccaggaactttttttttctttgaaacggagtctctgttgcccagactggagtgcaatggcaccatctcggctcactgcaacctccacttcccaggttcaagcgattctcctgcctcagcctcctgagtagctgggattacaggcacgtgccaccacacctggctaatttttttgtttttagtagacatggggtttcaccatattgtccaggctgatctcgaactcctgaccccgtgatcctcctgcctcagcctcccaaagtgctgggattacaggcatgaggtaccgcgcccagcctccaggaacttttctaggtgctgctggtcagtgaagaaaacaaagcctgctgtagttaccatttgaaagactgaacagaagtgtgactttaaaaaatgatttggcaaaagtatgctttaaataaataaacacagcaaacaaaaaacacaacagctctttcattctgtcctttcctctattctttctcttgtctcccatttttgtcctgtgtgtaacctgactccacaccttttattctctcactctgcttatcaacacagccatacttgcttctcaggctcttctgtgtctctttgttgtgtctgctgtgcttcatcatgtggcgatgaagtagatgaaggttgttggtggccggaccccaacttcgtattccttcttagctagttccttgattgatctccagacatggagtggcaggtaggtgctcttgttgtaagtcacagaacctggaggaaagagtggttcgtggccctggggcctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcaccccccaccctccaactctgtctctctctctctctctctctctctttctctctctctctctctctctctctctctgtctgtcctcctctcctgctgttgccatgtgaagtgcctgctcccttttgacttctgccacgttgggaagcttcctgagcctccacagaaggagatgctgctatgtttcctctatagcctgtagaactgtgagccaataattcaacaactcaaccacttcttttcttttctttttttttttttttttttttttttggagagacaggtcttactctgatgcccaggctggagtatagtggcatgatcttagctgactgcaacctctgcttcctgggttcaagtgattctcctgcctcaggctcctgagtggctggacttataggcacgtaccaccatgctcagctaatttttgcatttttagtagagatggggttttgcccctttggccaggctggtctcgaactcctgacctcaagtgatccacccgcctccacctcacaacgtgctgggattacaggcatgagccacctcacctggccaacctcttttcttttaaattacccaatctcgggtatttctttatagcagggcaagaatggtttaatacaggggcccatccagcagcactgcattaccaggattctgctgaagaaatggacgtggccccaaaagccatagcctggctgccaggtgccccagagtattgtcaactcagaggaacatctctcaggaaatattccttgattctctcttctctattagttttttaaatgcttctatcccagaggaggtgctcagtaaattttagtttctttccttttccggaaagtctcatgactctttatctgagtttgacttaagagaacttacttaataataattaataataaagaataaaacctgctaataataagatttaatagaactttctgtttaattccatggttattatacccatttcttaatctctctaagagacatggactgtgttaaagtgtgtttatgaactggtggtcgagggtgcatttccctcctaagaaaactcattccttgttatgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttattctccattcccatgatttagccctctaacttcatgcatttctttttgccctttttcttgtgctggattttagcccccagcctctctttcgatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttgattttatttttaccctactcacccctgatattcgtcccctggccttttctgcttacctggcttggagcaagtcctcatctgccaaagactatgtaggtggttggaaggagtgctctgtcctcacctcttcctcccatggcacctgcagccagagacctgctgtgtgtgctatatactcttctgacctctctgattctgaatcgactctcaaggctgaattggctgacatgcatcttctagtggattcattgtttttcatggtttacttggtttatgacaagctagggacagcttgacatttgctttcccgtcagtggtctggggacgtgcacagagctgcttgtttcagatctcctctcggtgtttctctacacttagtgaagactatataaccatggctctattataatacaatacgttataataagatctaggggcattctcgagaacttgggagcaatctaagaaaggagagtgaggttggagagaggcgtgtcctttgcatcttctggtagatgatggtggaggctgtgtaataacacgccaaagcctagcccacttgaaagcatcacgctctccagggaactgcctcagcctggggcacttatattatccatgcttagcatttttgtattactttacatttgtgaactgctttcccatgatttattagctgttcttgtttttaatagcccctggaggtacattgatattcaggcttctgagaatgtaaatgcacagggaacgttcatctcatcagatatttttggatctgggttcaggactctgacctcctgggatgaggccatttggggtcactgcctcccatggattagtaggagatcaagtggacttaacttcagctcctaaagtctccaaggcacagccatggaatgactgcagctatttaaggaaatggcgtagaagccattatccaaagagctggattccagtcctgactctgctgctgaccagcttcactggccttgagtagttgctttgcctacctatgcctcagactcaccctctataaaacaaaggtaacctctcaagtccctttagaccccccattgtattaaatataattctgtgactttggactccttctctggaaccccttgggtagccaatgaattatatgacagggaacatgggtatagatataacccattaggggacttgaattgagaaggtgctcaccttcctttctctaggattcaaggaccaactgacaatgatatgctttcagattcattttaagaagcacacaatcctcattcactataaaagtaagatagcgagtggagctgttagaggaaagtcagactggagccaagaccatcatttctgtatcttctgggtgttgtagaaagtaattagcaggcttgattatctcactggttcaacacacattttagggatgtgatgtaatgtgaggaaacatttagttgtcagattttagggctgtatcaaatttattcttgcaggaaaagtctagttgtcctggcaacctaaaattgatttctttttgctcttgtcagctgaaactggtcccctttgaatcattcctctaatttaatatagagagctgtgtgtctccacctggtgaccgaatcatttttaatgacaggtaactccagcaaatggctcctctttcctacctgagccagaagctatagtttattactaccttcaccctgtgttgttctctttgtgtttatttatttgtctgtggagtgaggtgtgtaagtaaagtggcattcaattaattaagagtttaatcaggcctgtagagcagtgatgtaattggcagccaatcactgcctttcgttttcagtgacctcctagacatgagtgggattcgaatgggctctggaagagggagtccttttgtgtggatgtctagcatttttgtaacccgaagagggtgatgtaatggcccagatgaaaggagaaagcggagctgcatggctgctttctgcctctgtcagtcatctctatcaagggggtgggtcatctatgaagggtggaatcgacatcattaggaagaaattgatgcctatgacaattgaagaggttgtgagagagcaatttgctttccttaaatggttgcaaatttcatggaccacgaatgccgcatctcaggatacagaagagaacttctgatggggaacggctaccagtaattttgaggaaacccagaaatcagcagaaatgccagaaagtgaggagacgaggaaataggtattatcaaaaaagtccagtgcccatcccccaccccgcccccaaacgaaacaggtatccagagtctagaatctgctgatttcattgtgattccagttgtcgacggtcctatgtagacaggtgatttgtgagtctttgaaaggaagtagtgttcaccaagagccagaacagggtcttaaccagttcccgttttgtctgggttaaccaactggtggattaacacgatgacacagacatagtggggagaatgtgggctttggagttggattgtctggatttaaatccagagtccaggtcattgtatacaaatgaccttaggccagttgtttaatttttgtgactcagcttcttcttcatgtcagttctatcctggggctaatgataggacgacaaaggaatttttttttttttttttttaagagggaatcttgctgtgttgcccaggctggagtgcaatggtgcaatatctgctcactgcaacctctgcctcctgggctcaagcgattctcctgcctcagcctcccaagtagctgagattacaggcgacaaaggaatttttgaagacaaaatgaaataatgcatgtgaagagcttaaaacaatttgcacatatgaattatttaataaatgtggttcttactactgtttgtaggaagacatttgaatttagtaaagcacataaaagccttttacatatgtatggataagtccgtaaacaaatacacacttattagtgatgcgggtttagaaagagtatatttcttggtggcagaagttccaaagtcaggccaggcatagtggctcacacctgtaatcccagcattttgggaggctgaggcagatggatcacttgaggtcaggagtttgagaacagcctggccaacatagcgaaaccccgtctctactaaaaatacagaaatattagccaagcatgatggttcgtgcctgtaatcccagctacttgggaggctgaggcaggagaatcgcttgaacccaggaggcggaggtttcagtgaactgagatcaccccactgcactccagtctgggcaacagaggaagactctaccaaaaaaaaaaaaaaaaaaaaagctccaaagtcatattgcaaggatgaggacataggtagggaaggggaaaatttgtgaccatttttgcaactttccaaactcctttctcctcccccatctttctttcttccaagaagttaccgtcattagcaatttgccatgtgtctagtttttgtctcacatttatatacctgtaaatatatgtttattttttgctttaaaaacctcaacagttatttgtataaaatttaaattctttgttctttcatgaaatatcatgactacaaacattgaaatagttactccgaattgcagtcacatgttttacttgtatataatcattcttataggcagagggataactgtaaccttttcccttctccttctcaccttgccctttgggagacgtttcttccctttttttgtgtctttctaccttgtccttctcctcccctcctctcttttcccttcccttatattctgttttcttaccgttcgtctccttttctctctccttccctccctccctcccttgcaatactttcctacctttcatactttctttattatatttttagtctcttgtctttagcttaatatggggctcagtggccaggcgtttacataatattgtgggtccttgaaacatcaggtcttggacacctagtctcagctctgaattgtcaggttcctgctgatatactttctgggtccactgttgctttgtatttaatactggaggttgtgataacattgtccagcttcaggaggccatggtagcgcaggagggatgcatgtgttgtgtagttccttgtctggaatgcagggtgacaggaggttggcttgtgtacacatgttcatctccttgggctactggagagggagtctttattttggtggggtgctcctaagagcagtgagctcagagcctctgtcttgagacttgctgtgtgttttcttggcctcccaatgctcctggcataagtgacatccctgcttaggaccctacactcatgatttcaggcaacctttctgccttccttttggcccctgcctctccaccccatgttcatattcttcatcccaggtgcagtgccaccctgctggctacctctgccaggcagcatccttcatgcttagctcaaattccaccttctcagaaacatctgacttcacatttggtgtcagtctctctcctcctccatttcccatcacacagtttgtactttcagagatactttcatacaccaccttgtattcaatgggtggtatctgtttctgagttctgatcagagggcagacatctctgatcctttggaggctagctcagtagctggcatttataggcactctgtaactgttaaattgaattactgaggaggcctgaggggttggaaggtcaaatgcagttaacccagggaactagaagggcccctgggaacttggttttggagcatggcttttatgagcagctatcagcttttccccaggctccttcttaatcctgtctctctagaggcacaaggagaggtggtgtttgcttaagatgctggtggcattcctagtgaagttaggtcagaatgtgccatctcttctttagctctcaacttcttagagtgtcaaccctcctcatattggaaaagcttagcttttaaaaaggagaaagtggtttacatgatgacctctgaatttttgactttgattattaatcttcttgaagaagactttgcagttgcccctgttacaaggaaagcagacatgccaagttgctgcatttgtgaaattgaatgaaattctggctgcgttttatggctctgacctttgggaacagtccagggtcagactgctcacatgatgtgcttgataaatccgcctcccaacagcactgttgagatcttaactagaattgctacttgcgaaacacctttttctgacttgcagttcagattctgcatgtactgctgactactgcttctagtggctcattcagataagtatgctatatattaggtagaaagaggatgcgtgatactaaggaaagagaaaaagagccagcccaggacacttgggttccagtgctaagtctgcaagagacatgtttgacatggggccttagttttcagatctataaaatggagacactaatcattattaggaagggttgtcaggagttcgagactagcctgaccaacacggtgaaagcccatctctactaaaatacaaaaattagccaggcgtggtggtacatgcctgtaatcccagctactcaggaggctgaggcaggagaatcgcttgaacccaggaggtggaggttgcagtgagccgagattgcgccacggcactccagcctgggtgacagagcgagactccatctcaaaaaaaataataaaaataaattaataaaacaaaaagagctcctcctatgaaagctctggaaacatcctccaccaaactggttgcacttctctaggcacaatatggtttatatccttctaaaatcagcatctcggccggacgcagtggctcacgcctgtaatcccagcactttgagaggccaaggtgggcaaatcacctgacctcaggtgatccgcctgcctcggcctcccaaagttgttgagattataggtgtgagccactgtgtctggccaggaggagctcttacagagctggaagtatttactcagagaaagatggagttagaagggaaggttgagaatgagagacaagttagtgtttattcaaggtggaggtgcacaggcctaatgtaggacaacggcaagtgggttggagaagaggggcttacgggaaggatgggcaggagaaatgggatgggacccaggaggcccaagggggaggtggaggattcaagtcagagcttcagatgctgggtctggagacactttctgaatgcctaggaggtagctgtggtgttttgcaggataagaaagacagaggctttctgtagctaccatcctgctaggtgaaatgaagggatggtctgggatgtgtgtgtatgtgtgtatgtgtacccacatacgtgcatgtgtgcatgagtgtgtattggtaacagaaccaaggagatcagggacttacccaaggccatacagctgggaaacagctttcatttgattacggtgctaagtttagtaatgactgcgagagacaaaaacgggcagggggagcatgtagggaaagggcctcggccccatttcctgccctctcaggcaggtagtgagtaggagttttaggtttcactgtttgatagcatcacctcctctgctttcccagaaattattcctcgaagtatgactcgaatcattcctctgttgggagatgtatcggttcagagctgactttctgctctggttgtttactgaaaaatggtagcactggcaattcagagggggcataagcaagtgaagaaaaaaaaaatgaacaaacagggcatgtgaggtcaggggccctggttgtgagtcccggccctgcttttagagacccatgtgaattgggcagatcaatcaacttcttagtgcctcagctttttcctctgtaaattagaagatagtgatttctgcttgataaatttattgtgatagtgctttgcaagttgtattgttggtcgtaggataataaagataaaggggtatacagacttggattctgtttctatatatgtgaagcgttagagagaggtggtaaattgtttctctcccgtgggttgtgcacatctctgatattatggtaatccccatatcttctccttttgcagggtggggtgtcttggatagtatggttactgaatgtagaatctactaactcctcttttttatttcctgagactgggtctcactgtgctgtccagggtggagtgcagtggtgtgatcatggctcactgcagtcttgaactcctgggctcaatcctgagtagctgggattacaggtatgtgccatcatgccagctaattagaaaagtttttctttgttgagatggggtctcactatgttgcctaggctggctttgaattcctaagctcaagtggtcagcctgactcgacctcccaaagtgctgggattacaggcatgagccactgtttctggcctcctttttaatattctgccctgtgcaaagcaccagcaccaacagcctccctcccacaacccccaacagctgtgcattaagtatcactttggtttgaggatttcctagcttgctgtttatcctgggagaatttctgagtttcttggtctttgtttctttacccaaaagttggggatagttcagctttgtctgcattgtggacactacctccagaaagcaatgggaagaccctttgtaagctgtaccgaactctttgtatttttggagcacattttgtcttttttctcccttcttctggtggctgaggtacctctttggtcttgaaaagacccacttatatggaggcggaaatgggcttatagagggaagtgactttccaagggccctggaatgaattggattctgagatctgtgcccgtccttgtcacaacgtgtcagattccattatttagtgtgggcctgatttgtccatgcctgggactttcccagaggaagtcatactttctggaaactctctgaggtcttgaaggggtgggagaagtctctgacacaagtgctgctgtggtcatggaggcttccattcctctctccttgtgttgagcagggaattgctccttggatattttaggtttgagtgactcaacatgcttatgacccagaggatgctgtggtgtgtttggcagcatgctggaattagtcagaaggcaaaactgcttgtcctgaccccagaacccacttactctaggtggatgagaaagtcctctcggatcctctatttcctaattcatggcaacttctggagaacagtattttctctgttactgctttatggggtttagtgtggaaattaaagaagagaacttcttattttttgtaaataataatacaatattcagatactgttagtttctgaaatttaaaatgggcatctcacttctgtgttccctccccaaataaatgtattgatactaaaaaggaaagccagctaactttatgaggatggctggtaaatgagccattctgtttttgcttgctgtccaaggcctctaatattaagcctggaccatttcaagcatatatggaggatatatatttcaaatatacattaggggtatatatttcaaaatcgaggacacattaatagtaagaggagaccatgtaagacaaagcacaggtttatttttatttttatttacctgtttattttttatatttttgagatgggatttctctcttgttgcccaggctggagtgcgatggtgctgtcttggctcactgcaacctcctcctcccagcttcaagcaattctcctgtctcagcctcccaagtagctgggattacaggcacccatcaccacacctggctaatttttgtatttttcttagagatggggtttcaccatgttggccagcctggtctcaaactcctgacctcaagtgatccccccacctcggcttcccgaagtgctgggattacaggcgtgagccactgcgcctggccaaagcacaagtttaaaaattacaagtttccaccagcctcatatctcccttggcttataatattcaagtgttcatggatactggggcttgccatcccccgccccgtgtgttaatgcagcccatggaggcttctcatagagacataaacagtgggctccagaaggtctctatttaagaaactgaggtctggcaaggtcacacatcgaggaaatggcaaaatcaagactaaaagccagctctttggattctcaattccctgctctttctgacacttcactcttccctcctgtcaggtgaagagagaagccagatggtttgacaaatggttctcgttgctgtcaaatctgccttctttctttgctcagacagacagttcttaccttccctttttcgggggactggcggaggtggggtgaggagagaggtaggaaggtggatgaaggaaaaaaagaagcattttattgcttcattctttatgtagtagtgatggccaataagttctttttttctctggcaagaagctaagtaaaggcaaggagtaatcgtcaccttgaatttagagcacatagaggcctagaaatggcaggctgtattaggagacaacattgatttcatatatattcatctctgaaaaaacatgtttaagatgccatattcataaatactaataaggctgtctgattccaattttcaggtgagattagcattttattgagtattttatctgtcagattcaatgctggatgtaccatcctcccaggcttattagcataattgctgtgcttaagcaacaataaaaaaatcagcagtaaaatagcatttagtgcaggcaatttgttatcaaaagcttttacttaaggacagctccagcctgcatttattagcaagttagggttataatttatttttattttgaaaaacaaaagtgggagaaagatttggcttttttgttttggaaataatagagaaattagaaagcattgcctctttggaaaattgtccacatcccttcttcctttgccgaaagcaggctgtgatgggaatagattccacttgtgagcgacattggctcagacaaaaagttgctctccttggcattggaacaaacgggtagtaacgtccctttatgcttgtacacacatttccaaaacactttcagatctcgtttgttgctcaaacctcacaccagtcccgtgaggtctccattcttagaaatagaaaaccaagttgaaatgacttgttccagatgaggcagttgagtggcaaagtggaggtgtaaaaactagtcttccagcctccagtcctgtctcagcattgctccccttcacgtcgttgtccagagctcctggtggagccttggccttttccatatgtacacgtgcacacacacacacatacacacagatctgtgtatctacacctgtctatacacatacgtgcacacctatgcacacacatctatgcatacatacatactttttcttttcctaaaagttaattatgtactcttgcatttgtttttcatttgatgtccgggttgaaatacttctgccacatgaacttctcttgatgccaaatagcctcttaaaatcaatctctctctctctctccaccccccaccccccacccccacccccccgcccctctagctagcaactgtatcaggaaagcacttgtgattaccatctgttaaggacctggaacaaaataaatgatgttataagtttttgtagggaagatagagataagattttaaaatatggagattgggaaatcatttttcttccttatttcttaggaaatgtatcagaaataaataacattaaattgatgccttttagtgggttttaggcttcaattatgggtaataattttcaaattgagaataaagttttgagtgaaaatggacaactgaagcttctaagctttgagaggagttattttagcattttagattttcttttctcagtaaattcaaacaaagatcatacaatcattgaatcatagcacgtctaaaatccaaggctctgtgctggccactgtgtgttttacagactagctcagacgtggctatgagccccaagacatgtttaaactattagagaggatactaacgatacattaataatgttcttggttttgacagaatattctagaacaggaactctagtaggatttttgcttatgttacatcattgaaatttaaattcactcaattatttattgactaaatattgagcacttatgtgatgttcactcttgtattttacatacatcatctcatgtaattttttaacaatcatatgaaatatgatctgagataatagtcagtactgttattattgttctcatcattagatgaggaaattgagactaagtaacttgtccaagtcattcagctggtaagtggtagaactgctgtggtctccctgtaaacacatgtttttttcatggtaccacttggcaaaaaacgaataagcaggtacatacgtagacagatagtgctaatgatgattagagaacctcagaactcatgcagaacctggatgtttagagagaaaatggaacttgaaatcagacaggtgttcaaaccctactatgcttcttagtgtttgtaaaatcctcaatttaaggacctcttaggatttcggtgtcttcctgtgaataaaggattataaaatctttctctcaatatcataatgagaataaattacaaaatgtatgtgagtgtctgcaaaggtacctagttcatggtgggagttcaccctatcttggaagtgctcataaacatgcagggttttttttttgagacggagtcttaccctatcgcccaggatggagtgcagtggcgcaaccttggcctcccgggttcaagtgattctccttcctcagcctcccgagtagctgggactataggcgcatgccaccatgcccgactaatttattttgtatttttaatagagacgaggtttcaccatgttggccaagctggtctcgatctcctgacttcaagtggtctgactgccttagcctcccaaagtgctgggattacagacgtgagccaccatgcccggttcaacatgcagttttgtgtactgtttagggacagatgccgaagccacattgcttgggtttggatccatcctaccacataatatcatgtgaccttggacaaacaacttcacttctagtgctgtactttcttcatctataaaatgggcttacatcatagggtccttgtgaggattaacaaagttagaatgcgtagagcatgtagaacaatgcttggcacacagcatgccgtgcttcagtggtagcacttactattccattatactacagccaccgagaaggacaggtacacagtgaatagtttaggactgttcatgttcccggcctcttcactccaagagcatcagcaagtttagtttagaacataggagttgtatttacacagctactaatgaccttggaaaagttcttggcttctctgtccttgacctttgtttatctgaacgagtaaacttcagatgacagagtgtgtggggaatggaatgcatccgcatccttgataagctgccctagtggaatgttgccatgtggctactgagggtcaattcactggtcaaaggtggcctgctggttggtattttttctgtgtcttccgggcaagttctgtctttcctcagtctgcacatgcctgggtctgtcctcagagctctctcccatttccctcttctctagaaagcattgatataatggggccacctcttccttggactgtttctgtagcatcagaaggaggtgggtgggaatttggcataccactttttgaaaggtaatacattctaacatatgtatttcacccaccttcaaagagtaagaatacactgaatgatacttaattttaaagatgtgttgctgaggtgaactctaagacgaacaattcttcagaatcttttactttcttgggcttcttgtcccaaacaacaattatctttataaagcctgtgtgtgtatgtgtgcgtgtgtgtttgtgaaacttcctggaattggtagtgttgattttgagatgtttctttggcttattcaaaatataaacagaaaggctaaagtgtttttcatgtcattaagaatgtctttataagaaaggacattggccgggcgtggtggctctcgcctgtaatcccagcactttggcaggcccaggcgggtggatcacgaggtcaggagatcgagaccatcctggctaacacggtgaaaccccatctctactaaaaatagaaagaaaaaaaaattagccgggcatggtggtgggcgcctgtagtcccagctactcgggaggctgaggcaggataatggtgtgaacccaggaggcggagcttgcagtgagctgagatcatgccactgcactccagcctgggcgacagagcgagactctgtctcaaaaaaaaaaaaaaaaaaagagaaaggacattaagatgataccttaccttgtgtggggggcttgtagctttcaaaacacttaagtacccattttcttatgtgtgctttatgacatctctatgatgtaggcaaggcagggtttatcattatttcccttttagaaatggtggatctgtggttcagagaagtgaaataagttttcttaaagcagttctggatgcaaacccagaacatttgactctagggtgctttctgctccaccaccctgatttgattgtaaggaggtaattcttaccaagtactgtcagattatatagagttgtaatatatcttaaaaatgcccattttaattttctttaaacagatcagttaaaaagttaactgtgatttgataccatcttgtttctccccaagtttaaacagcaatgagtctctaggaccttcggttaaaccagcatgtgtttttcaaaaatcaaatgtcaaagcatttcgtgaaccttgctttaatgaacaagagaagtgaaggtacaattccttttttgcatgaggtaattaggaaacaggatgtgcaaacttgctatatgaatttaaagaggagcacttctactgatgtacaaactggatgggcatattacagagggtttcatgctggtagaaattttaagtgaaataagttctcattaagcatatcaattatttttggactgtgtgaaaacttaatctgtttcatgagttggatctaaggtggtcaatacctctacactccaaaaaacagaagcatgactcaaacatctagttctgattgcagagtgcctttatctggaagactggacatgtcgtcagaatatagagcaagagggatggaatatgctcttaagtttcctgatgacttaagggtctgcactatacttgcttgggaggtgggaaggattgaattctctttggaaaatgcctttgaatctcttacacacatggtacccaataagcctagtgctgtattattagcatcatgtactagagtatggtttacctgacataggttttggaaatctatttcttttatttacactacatggtttcttaggtggcaattctcagtgaattaccagcttcctgatagtgtcttgaaaagcatgctttataaggaggcagaaagtgtttctcttttgacagatgacctccttgaccccttgactttccatttttgatggtttcttttgaggtctacgtcatctggtaattttattggtgtgatttatgcccccagtaaggatcaacttgtatagattctacattctcatggaagtctatgtactgtctctactgtgtaataattagctccaactctacaaacaaggttagaaatgaaatcaccagcattacaagtgagacataacaaatggaagattcccttctctgagtttctctcataccgttaattttatttgagctggcattgactcattctatatgtctcttctgctagattttgaactctggaggactggtctcatatcttattaattataatggtggcgcacagcacattataggtatttattactaagtggttgggtttaatatcttaagaagcagaaaatgtggtttttcttgagagagagatggttttggatgttgttcctctagtatattctaagcctgcccgcctggggctctgtaactatggctcctaacgtggggagcccacaatctagctatatcatgttagcgagagctctttgtatactgaaacaataaacttaccatcttgatgagttttacatgtagaatggcttaggttataaggtactgccacctcattccactgttgagaattgtctaatgcaaagctcactttttaaacatggataattggacagtcatgagtggatcatcgaagggataagcaaaatatatgtcaaactgagaattaatatctatcaaaacacttgctattatttggtagatgggaggttattttatttttaagaagtagattggctgaatggaaaagcaaaatgtggcataaaataaaatgggatattgttcagcagtgaaaggaataaagtactgatatggactacaacatggatgaaccttgaaaacattatggcaaagtgaaagaagccagttacaaggccgggcaccatggctcatgcttgtaatctcagcactttgggagaccgaggtgggtgaatcacttgaggtcaggagttcgagaccagtctggacaacatggtgaaacccccgtctctactaaaaatacaaaaatcagttgggcgtagtagtgtgtgcctgtaatcccagctactcaggatggtgaggcaggagaatggcttgaacccgggaggtggaggttgcagtgagccgagatctgccctccagcctgggtgacagagccaaactctgtcaaaaaaaaaaaaaaaaaaaaaaaaaaagccagttatgaaagaccacatattatatgattccatttatgtgaaaagcccacaataggcaaatctatagagtctgtagcgatagaaagtagtggttgccggcagggttggggtagaggataggtagtgattgctaataactgtgagtttctttttgggatgctgaaaatgctctttatatggtggtgatgattgcacaacactgtgaaatactaaaaacagaaccgtaaactttaaatgggtgaattgtatgtaaattatatctcaataaacctgttttaaaaagtggatttccctttaatctattctctgaggattgcttcagggattcaaaatagtgcatagtgccaagttttaaactcatattgatttgtttttggtaaataagtcatgcatgcttaacaatggtgaacacacttaaggaaaaagtggtaacacaactagagccaccaaaccgaagcaagtatatttccacctaacttcatgcacgtttttttctcagaagctttaaaaatttatactttctcaaatgttgattaatgagatatctgataagaaataacagggtactgacagtcctgattgtataaataggcattagggattgtgttcatggtttgcttgtcagcacaagagaaatgtgtgattatgttgaatgatagttaattttcttatccacccattttaaaaataaagatgtacagctagaaaacaggtgcccagggaatagaggagacctgcagctttgataatgagccccagaaagaaactagaaggaacaagctcccgcttaggaggtgccgttcgagtcctggccagtgtctgactgtagctgatgggtttagagaactgtggctggcttctcacaaaggattttttcatttactcttgttttgtgtttgagtatagacagcttttcccatcctccatcagggtcattgtcccaccttctctgactcacttattgtgtcaacagaattaaaagagcagccggtggacgtgtgtagaggctgaaggagagctgtgttgctagctttgtatttgaacggttcgtacacaaacagttctctttgattaagtatccggtgaaaccaattcacatgaactccaattaaactttaatgaacaagtgggtgtattaatatcagctgagtaatgcaggcagcacagattccagtaagtgactcacttctctgagcagctcattccccatgcacggttagagttactagaaagcttccagctatatttgagtggatctggtctgggccttgtaattctaacaatcctcagggctcgctattcatctagtgacaaaaccacagtcatccagacctctgttttcagagcaaagattggggatgaagagttttgttcacattgagcaattaggcccttcgttgagcagtgaccatttggacttttattttcctcatcttcccatttttgtttttttgttattttattttttagagacagggtctcactctgtagcccaggctggagtgcagtggtgtgatcacagctcactgcagcctcagcctcttgggctcaagcaatcctcccgcctcagcctcccgagtaacctggaacaacaggcatgcaccactgtgcccacctacaaaatttctgtagagatggggtcttgctatgtcgcccagcttggtgttgaactcctgagctgaagtgagcctcagcctcccaaagcgcttggattatagatatgagccccgtgcccagcctttattttgtttttaagtgagaattatttttttcttaaacccaggggcagtgtaggtgaaggttaaggcagtgaagatagaacagtcagttttgaaatgcacatagccttcctgagcctcactttcaccacatctgccagtctgcctcaagtctttaagtttccctacaccagaggcagcaaggtgtgcctggaatgatgaattcctttgagcacagaccctgttccatctagagactgatgactgtacctatttcctaggaaaggttaagcaagatcgtgaatataatgctcttcgtttcatgccggcacataataagttcccactaaatgtttaacttggtccactgggggaaggatgagaaggaggatttggagataaatgagacttggcccttgacaattcaggagcttggagtcttatagagatttgacttaaaaatgtctgtgtaactccagagtgataaagacaaaaatgcttgaaaaagataagtgaggattcgggggatggaggaatcccagaggttggccccgtctgagaaggctggaggttagggtaggaagaggtaagggtttgggaaggtagttctaggctgactgaagagtgtgagcaaaagcagaggcagggatgtatccaggtatcagatagtgcacatttagtgtggttacagtaggtgataatttaggaggctgattgaaactgaatttagcctctgccttagtcaccaagtcctttcccagctccacttgctgttctctctctcattctctcctacctatattgaaaccagttgaaaataatggagtcacacagaggcagatggcaataatgtccaggttgtggaacattagctcattgggcttgctaatgcagcacccatgaatgaaatttaccctcttcctctcagatagctcctgcactcaataactcccatttagggcacactgtgcataaagctcccaaccatgaagagcagggaggatctgcctctaacagtcaggtaactcacaaagactggaaggaagtgactgggttacacatggccagtttcttctccaaactcaataattgggtaactctctgcctcctcatctgagaacaagggagtgggagggaggcaaacaagaaaagagaagaagcagtggagaaaggagacgttctgcagtgccaggcttcttgccccacactcttcccaaatgtcaacatagttcctttaggggaaaaaagtgggaggctagaatggtaggacagggccacaatatggaagtgaaaaaccaggggcagtttcctgagcagggaatgatgtcattcgatctataattcagtctggttaatctacttatgcaacaccaattgaaggacacacttagataactcagccttgagtcaacaaatcttgtgtaacactgccaaggtccatagtgcaagaatcagcccccacttcggaaataacaaccacccctcagtgccaaattttggacattgcttgtaaatttcagactccttccctccaagatactgttttagagaatgtcgtagggtaaaaaattccaaggggtaaagacataaattccgtaatactacaatagatgggaggctctaatcaagtagataaattctatttttggaattgtgaataaagcagaaaagattcttggaaatcaggaattgaatagattgatggtacaaatgagagactatatgttgcttaaagaaaacaaaagattgcctatcaggttttaaaatgtgagtcagtagtttatatagtgattcaagctgaacagctatcttggttattaactaaaatcttttctttccccttccattttatatatgaagaaactattaatacaaaagtcattatcaaaggacactggggctaggtttcattacccagcttaatccttaatttcatattgagcatttcatattgaagtgaaacaataaggatatgtttctagagactgatgagacaactgaattggacttggttttgacattcaaagggatcaggtagaggtacttagttgagctcactacttcattttggcaaaagacatatgtcatagaaatgtagtagccatgatggattatgtatctttgaattgggagcctatgacaaattttctccaatgggaagtttcttcagagcctatcattgtttcaacaataattaaagtaatttacagagaatgtgctcatctacttttacctactgttatcttttttccaagttaataaactgaatatattgtatagattggttgatagccttcctgaaatgaacatcctttgcaaacctatctctccaaacccaaatcctgcccaaatttcccaattgtggtagcaagcccaatgagctcctgatacgatcctaataggatcctcttctctggaaatcctcgacagatcacacttctcttttcttgggaacagctttctgtttccttgtccagaatggatgccgttctgttatcctggtcactctctgggccccctccctttgtccaccatgagcacaggctactggccactgatcctcctgggggcactagcctggctaccccattgcttattttacctttgcttctcttaaataccattgttggtgattgctccacacagcaattgttctcacctaagtctgtggataagactcacttagggaggttttaccagaattcagctcatctccctaaatgtttgggtctggactagggcacacacttctcgtgaggcgcttctcatgagtaccccttctcaaactttacgggtatcaatttacttatggcctgcagtgcataaagtgaaagctttctgaaaagacatttaatccatcggtatgaggatgaaaaagacacactcagggcatgaaaagagtgagaaggtcacaaaaagggtgtggtctcagctggagaggaagctgaacaatcctataaaggaacaaaagctcagcgtcctgaccatctgtttctttctaccccaggcccattcccatcatgagtatttattctgcccagtgtgggatgggttctgttctagaagtttgcatgagcagagggaagcttagccccatgaggccagtcatgaggctccatcttattctataggcttcagcctttttatgaagacctagcttctactcttgccccaggccctaagcaggcccagacttttcccatatacacacactctctctctaacttatgtgtcttacatcttaataaggcagcagattgtatcagaatcagttaactctttatcaaaaaacccagagcagacagacgggtgaacttgctcatgggctgagctagaagggaggccacttttccttcacacagcctcggactctccctgggcttttttgtgtgtgctgcgtggagactgtgttctaacatttcagtcatatcttccttattttaaaactacagaattgatcttaccaacttactggggagcacgtcgtcagtaaattctaatggaaaaacctgtctgatcaatgggacaggaaagcgtcacagcaataccggtgagtcattccaagaccaggcacatttgagctgtgttgcttcttcgatgctgactataattctccctcagcattacgtcgtcttaagcagcttttgaatcttcgtctctgattccctttctaggtcagactgtgtctttttttaaaattgtgcctggatatccccttaataggttggacaagtcccgttaggataattggctgtatgaatatgcgaaaatagcaacagtgaattttaaagttcttgaatagtctccccgtcccactgtgaggtgaggcatctggggtgggctatctgttttttgattcttggttcttgtttttaaaaaaataggatgttggaccttgggatgagagggaagtaaaacagttttggaacccttttagaaagcaaactaagacaaaactcctttcttgagaaaaatggatggacattgtaaagaagacagtagggcaccaggaagccttgagccaggtctgcctgtgtcacatttcgagttatgagcttcaccgctctgctgtctgtctctggagatcatcatcaaacccctttctctgagttgttgaatggctcagatgagttaatgcctatgaaagtactctgtaaacagaaaaataccttcctatttgtaatctcaacaaagggacttttatcatccctaaaacagaacagacatttctttttcaattatgaaagttacatagactctttttaaaaagttaaatgcacaaaagtatgatgaaaattaaaataaccctaatgagtccatcatccagggacatcattgttctaatttaaacatttgggtaatctgttctctttttttaagaagggttgtgtgtgtttattttttttctttttttgtgtgtgtttgtgtatatctatgtgtatttttattctgttttctttacataacactgtattgtaaacattcccaaaatgtaaattttaatcattgcataatattgcattatctgatatatgcacatgcattttgagattttgtgacgaacgattgtgactattgtttccataattaagggttagctgcttaccaagaaaggaacttactttaaaacatggcaggcacacttggccatttttttttttttttttttttggcagtaaaggaatttgaagtatccagttttttaaataaattaatatgtattgaattggagtttagcagtacttttagttaagatctcagttaaggtaaaaaggtcagacctgtagagttattaatttgtagaaaattctgactacagcaaaacatattagcccaagttctctttattaataaaacattagttacagaaatactaaaaaatagattggttggtctcctgaatgtcctgcgttaggtaagttgccttatgccatctggaagactttttattttctcttcatagaaggatacaatagatttgttttgctcaaagagttcattttctgttgctgggcacatatataatactgtaaacacatttctggatatgacgacataatgatgaagagagacctttgaatattttcttaaatgaagattgaaggagtagtaagctgtgagaggagatttttctactatttcagtcctaagattgatcttttttgtcatggatttatccctttgtctctatgcatttctatgtgtctgctcagcatcttatcttctacatttgccctagttccatccttccttttttccatgcttgtttttccatacacctgcccatccaccctcctgcctctctatccagtcgtccgtctaaccatttctggcaattcttacctccctgtttcatgtatatctctccatttttacctgtcatttatatttatctatttgcctatccatatctacacctgcttgtctgctcactgtctatctataaagttaatggagatgattttgatgaaaacttatgaatttctttattgcattttacactgtgggttacaggggccaaaggccatggggaccagaaagtggaaataaccagagctcggccatttttgtttcatttcaaaatcaggagggaaggtcagaactaacctgattatcctttctgtgatgctaatcaggatgttcttagtataatgccttttggagactgttattttaaggaatgttttgctaagaatcagttgccaggacatagaatgaagagctattgtatagcttcagagtagttctcttttaagaaggatataataaattaaaaataattttcttgaggtcagactaaggaaaagtcaaagatatacaattgccatctctccaaatttattgattttatttatttattatttattattattattatttgagacagagtctcactttgttacccaggctggagtgcagtggcacgatcataattcactgcaacctcaatgtcctggagtcactgaagcctctcaagtaccttggactacagttgtgtgccacaatgcccagctaattttttttgtactttttttaaagacagtattttgccatgttgcccaggctggtgttgaactcccgggctcaaactatctgcttgccttggcctcccaaagtgctgggattataagtgttagccactgtacccagcccaatttactgacttaaaaaaaaagaaaaaaaaaacaacaacccagaacatattgtaacattctcagggagtttagagacaacataatgaaggtattttcaaggtttggggagctgcttggaacttgattttggacaaaatggaaggaaaacaaccatcctttactgaaaaccatttttcttctgattctgagaaagctgctttgcatttactctctcgtttaattctcccatccttccttcaatgtaatttctattatcccaatttataactaagaaacagagactcaaagaggctaaatgatttgcctaagtttacatgattaatgagtgccacagtttttgtggaacagagacttgtttgaatctaaaactgttactctttgcagtaaaccacaatgaaaccttagctatatatcagttctccactttaaattttatggtaactcaacctctgaaaaggatcctgcaaatagcacagttttcagttcttttcttgagagaaggcagggctttcatatggacatgataaagaagacagctcttaggatgtggatataagattgcatttatgaactttactttagtatttgacagaatggggttttcctcacatgctgctgtgtgtttttgtttaacctaatctgagtctcattaggcagcttgatccagaagacagaaaggtctcctccacaagatgcaccttatgaagcaaacaaaccaatgaaatgcagtaactcccttcaaacttttgtaagctctggaaagccagaaaagacagctattgtaatatattttgccaggccagctgttatcatcacaaacaagcctgaaatagcaatgacttttgaaatcacagcacatttatttacttcttaacttttccataggtttgaaagcttgctccctccctttttatcatgctaaactgtagttgctaacaacattctattctgggtgggaattagctttggcataattaagaatggagatgggggtggataaaagaggttctgccaaaggacttgtcttatatgattttattcttacttttaatctgttttattctttaagcatgtattaactgcctactacgtactcaacactgtgctatgtgggaaaaatatactagaacaagggatggtcaactttttctgtaaagggacagatggtacacagcttagatttgtggtccataaggtgtctgttgtagctactcactctgctcttagataatacacgaaacactcaagactccaccataaacaatacataaataattgcgtgtgaatatgttccaataaacttttattcacaaaaacatgcagtaggctggatttggtctgcgtgccacaggttgccagcacctgtactaaaatgtccctgaaaatagagaactttgttttgttcattggctgtgtcaccagtgcctagagtagtacctggcatgggataggtgaccagtaaatatttgttgaatgaatgaacttataaatgaatgaatgactcagactccttctctgatctcttctatacttaaagagagtacaaagaactgtgggaggtaaaaggtactttcctggaagagagagtgtggagggtcatggaatcagttggtatttgagctggaccctgaagaataggtaagtatatgtcaccagcggtggtaggagaagcacactgcaggtaggagaaacatgcaaataggataagaagcagggcacttgtggtgaataatgaggagatcagatgttttataacaggagtttcctgacttgcttgatcttcaaaatcacctgttattaaaaataggttcccagtaccctccctggagattctgattttgtaagacagggttggccaatgataatttacaaaataaatatttgaaaaggtgtatggctttggaaagttatactggaaccatttctaatgggaaataaagttctcacttttcttagtaaaaggactagtatcaactagtaattgctggacctataattaccctataccttctgtgccatagaatggaggaagtgccctggcggaaatctaccctacttaactgcctgtcttcatacgtcccctgttgatgttgtaggagtaccccagcctttatgatggaacagtgtgtaatttagtcagtaaattgtagtcatataaattataataaatgtatcaaatttgtagctactagctttgttgcttttgaatttctgggttggcaaacctctcagagggcaaatagatttaaatggcgtaatagaaaatttgcattctcttgctgtacctccaattcagagtgtagtgtaatgcccagatttgtttgtagactaagatcactggaagggctgtatagtttaagcctcttttttaataatggggggaaatctgaagcctaaaaggtgggcagggacttgctcaagttctgtcaccaaattattttggcagaaccaggagtataatgcgaatgttaagttactaaatttagttttcttttcatggtgccatgccacatgtatcaataaagttcctaatttacatactttctctcccctttaaatctcacagctttttgctcatatacctcttgtgtactgcttaccataaagttatatcttaatatcttatcctgaacgagtagcccactgttatcccaaataaaggctgagctctgtttccctggagagcttaacatatttcctggcacttagcatgtgttcagcaaataattgtagacttgaaatatcttgagcatcttttcttttcccatgtgttttgactcaagttcctttgcagttatattgtcagaaaagtcaagctcttccagaattgctgaaatacaaagataatttctcttaagcttccttaaaaaagttgaattccctattatggctgagacctttcttaacagctcttctgatagttaaatgtcagttgcttcaaaaaagaaatgtcattaaattatcagggaaataaattacatatttatttgggctgaaatattttaattgaccacttaaaataaagataatagcaaaagactgatacatttcctagcttgcacatttctctcaattgccaggacttttttgtttatatctcttaggagatttcatttttatttcttctgcattatggttatatatgtgcttttgactctcccagtgggtgataagttctttgaagtcaatgtacttaaaaaaattaatctctatatacccacaaagcctagctctgtaggagctaaatactaaatatatttactttaaaaaaattgttaggaaaaggtcagtgttaccttgatttcagtgttattttgcagccctcaagtcaacaaccattttactgaacatccagctttgtgcctttctgtgagcttaacattggtagcaggtgtggattgggacataaaaaagtaaataaaacatagttaagttgacataacccataagtataatgtgatgtggaaatctgagataggtacaaataacctgtactagaatctggaggcaggttaattctgacaaggtgagtccagagaggctcacaaagtgtcaatatttgagatgagttttactgggtcttggtcttctatttcagttgctggttttgatttttctcaacgcaacacacacacaaacacacagatacacacacacacgcaaagtgatttgttttctttttataatctctttgactatagacttaagagaactgcctttatgtaagattaaaggaaaagaggagcaggttttattgtgttatttgaaggtttttcagagtctgaaacacacagcgaccgaaagtatttgggatggatgatgccagtagtgtcatgaaacaaagtacgttggccagagagagacatatactattgtaaattaacggtgttcttttccaaggattttctcgtttacctgttgttgtcttcaatagtttaattacactaaatattctcgttggtgcggggagcatagtatggtggaggaagtttcaactttgaagtcagacagttctgtttctgtacctaacttttcacttattgtatatgtgactgaaggctgttgcttatcctctctagggttgtttcttcatccttgaaaaatgttgtgttttctttttcttttcttttattttttttgagacgtagtctcactctttcacctaggttggagtgcagtggcgtgatctcggtttactgcaacctgtgcctcctgagttcaagcgattctcctgcctcagcctcccaagtagctgggattgcaggtgtgcaccaccatgtccagctaatttttttttttttgtatttttagtagagacggggtttcaccatgttggtcaggctgggcttgaactcctgacctcaaatgatccacccaccatgccctcccaaagtgttgggattacaggtgtgagccaccgtgcctggcctgaaaattgtgatcatggaaagtacctcacagaattgtgggatgaatggagctaatgtttgcaaagctcctatttcagtgtccaggatatgttaggccatatgcctacagagtcaggcacattttcttgaaacacaaagccctttatctagcttaacctcttcccactttagagtcgtgggtgcaggaaatattttgttttcctctttaccgtaaggaaagtaacagtgctagtgtgttgttgaaatgccatgctctgggcatgtgtttggggagagagatgcagtgcgtggtggggaatgggaggtgctcaagagggcatcctctctgaaaggggtgacagccgcttggcgctagctaattattgccacgtggagatgcatcattgccagatttttatgtaaactctttggtttttaaaatgttggcagctcattcaagtatttttaaagcactatgagagatacttcctcatggaagaagaaaaatgcaacttacaatcttactcagtagcatcaactttggctcaaaacaacaacaaagcacgttgtaagtccacactgcaaatggcaaacagaacccgtctaaggaccagatttggcctgcagccctcaatttgcatcttctgtgcatatttttaactggtagagataacagtaaatgatggcaaaacttactgagtcctttgcatgtgctagaaactttgctatactttgcatatatcattcaattctcacaataacccaaagaggtgtctattactattattatcccattttacagacgtgagcattgaggctcaaggaaatgaagtatctttcctgaggtcacacagatgaaatgtgacaggtagctttgaaaccaaagcctgttctcttttaaaatcatacataccagtggatctcagtcctggtggtatgttagaatgattggcgtgcccttaaaaacagtgttgtccaaagtccacccccaagctcattaaatcagaatatctgtgggtgggactcagacgtggctgttttttcgaaagcctcaaatcaatgattagaaatagctgtaagatagataaaatttgtgcctccacatctggcactacctatctcctgtactctattttatttttgagtatttattgttctctgaaaattatgtgcatctttacctgtttatgaattttctacttttaccacactgggatgtaagctccgtgagcgccaggatttagtctttttaagttgtttgttgtatccccacctaggtcagtgcctggcacataatagatgctcagtaagtatttacttgaatgaataactggttcttcatcacagggagcttacactctagtgagggagatagataatacattcttagtcctatgagataagctcataactgggatgttcaatatgactttattaacacagggaatacagctgattatctcttagacattgttaggataaattgtttctatacgtattgaatggactgtggggcatttttggtcacctgcactactacactggatccattctgtgctctggggtgtaagtgtgtgtgtgtgtctgtgcgtgtgtgtaatttcgggaacgggtaacacattcgtattacctctgtttggacacgatttttagtgacagagctaggaataacaggtggaaccttctaagttttgttgcttaaatatcaggccccctcagaattcaggactgatggtagaggatttaccagtttacagggaattcagatattctcttctctttctaggaaagccaaattgttggtcattctgcccccaacatttacagaagcagtttctcggttttatttatccaagattcttatgatgaatagtgttaatatcgcagcacactatgggctgtgatatgcctatatcacagagaaggcaagctgtggtgaagtggaataaatgaaaaactgtctataactctgcttctagatgccccacttaagcaagtaaatgggaatgtgagtgacaatatcatagggataaccttgaaagagtgctagtttttaaacaaaaacaaatcatttggaacgttaggatttaaacagttactgataataaattgcttgtgacccatctgaaaattgatggatcatagtgatagtgaaaatatttaacaactgctatggcccaggcaccgaacaatcgaaaccaactccagtgtaaacagtggtgccatcaagtatgcgctggttgtcagccttgctggtggagtcattgtgtcacgatgaagcaactaagagccagtgctgcacaaagtgttgagagaaacaaacaaaatccagggtgctccccttatgcggagtagagagtagatagagccttgtttcagaacgataaaacttcggtcaaggacttgatcttcccacttattgctgggggctccagggcaaatcatttgttctttctgagcctgagttgttgtttcttcttgttcttcttgttcttgttcttgttctcgttctcgttctccttctcctactccttctccttcttcttcgtcttcttcttcttctctcctcctcctcctccttctcccttctcccttctcctttctccttctcctcctccctcctctccttctccttcttctttttcttcttcttctttttttttttttttttgatatggagtctcactctgttgcccaggctggagtgtagtggtgcaatccctgctcctgcatcctctgcctcccaggttcaagcgattctcctgccttagcctcctcagtatctgggattatagacgtgcatgaccatgctcagctaatttttgtatttttagcagagatggggtttcaccatattggccaggctggtcttgaactcctgacctcaggtgatccacctgccttgccctcccaaagtgctgggattacagtcatgagccaccgcacctgtccggagcctgcgtttcttctaatatacagtggaggagagtaatttttgcattacctactttgcaggctctggagttagattgagcgcacctgaagctaaggttaaagatgatggctatgggcatgatgacagtaattgttcttctctggttggggactgattgatgatccctgatttctctgtttaaacgttgcccaaaacaaaggttgagaggtccttaggggagaggcgagataagcagaggtaggacttgcctttcttctgtgcttctccagaattagttgtgtcctgtggcatccacagacaaaaattgagcaatctccttcatagttgagattgtataattcgataaaataggtttaaatagccttatgcctgtataatattcatgaaaagtgtcatgagtgaggtggcttgcttgttttgaaaatgggctgattttgacaaaggggaaaaatcgggattcatttactgtaagttgaaagtaagaaacaacaaagttgaatattagaagaacttggctatcgcaaaaaccacatactttcacatcagtaaaacatggagttctgatctgagtgaaatgtgaaacttcttgcagaccacagagagtaaaaaggagtacttttgtttcattattaataccattgtccttatttctttaaatgagaattgataatacccataacagaatctttcacacaggccaaaaacagaaagataaattaaacaaaacaaacaaacacccaaaacctcaccaccaccaccatgactgccaacaaaacccagtgctgtgaggatgcatcagctttaagatctctttaagtcattgtgttctagagaaaggggttctttatttgtttctatcaggatagagtgagtttttgttaaagttgtctttcttttttttttttttttcttcttctggaagactgacgaagttggccttttgggatattacaagaaagataactttgtcttctaatgtctgcagtgatatgaggcaggtgactgtgtgtattctgtggtgatccatgttcacaaggagagacaggccaaggatgcccggttgatgagtgcgctataggtgcttgggagtgagaaggcaagaaagcaaagtgaacttaaaaaatagctagccagtggaattgagggagaaatgctcattctttgctgacacatgaaataattgttgagggagagttgctcaatctttgcctacacattgaaataattgtgttgaagagtctatgaaaagggggtcaatagatttgagttttcatcactttggccaccacctaattatagatggcctccactgtgaaatatgtgagttgaaatagatttttttaaaattcattttctggactggcatttagaatttgagtttattcaatccttgcttcttgggcagttagggtgtcaatggcaataggaagggtagctgaggccagagtggtgggggtagatgttgggtggaatgtgtgtggttgagcagagcattattattattgctattattattttttaaaagaatccttatagtaaagagagccaacattgattgaatatatgttccttgccagaacttgggctaagtgctttattataagttatcttatttaattttcacagagacctgttgaagtgtaagttttagctttctgtttcacagctgtggaaactgaggtgctgaaaggatgaagaacttccaaaaagtcgaagatattaagcagctgtattagtcttcagatcctgatatctttctcatagttattctgatatgccgtattaagttgcagaattgaggccgggtgcagtggccccaattttttttttttagttattcttattttctaattattttatatgctctctctctctctctctgtctactgtcaaatcccggcactatgggagtctgcagtgggaggatctcttgatgccaggagtttgagaccagactgggcaacatagtgagaccccatttctacaaaaaaatgaaataaaacaattagttggtcatgatggtgtacacctgtagtcctagctactcaggaggctgaggcaggaacattgcttgagagttcaaggctgcagtgagctatgattgtgctgctatactccagcttggataatggagcgagaccctatctctaaactaaactaaactaaactaaactaaactaaactaaactaaactaaactaaactaaaagtaagataaaataaacttacggagttggaacattgcaggctatctatctggcttccctgccctgaattcatcgttctctttgatgtgctattgtccaacatttcttttttttttctgttttttttctgttttctgtcttgctgtcacccaggcttgagtgcagtggcctgatgttggctcactgcaacctccatgtcccgaattcaagcgattctcctgcctcagccttctgagtagctgggattacaggcacccgctgctatgcccggctaatttttgtatttttagtagagacagagtttcaccatattggccaggctggtctcgaactcctgagctcagatgattctcctgcctcgacttcccaaagtgctgggattacaggtgtgagccaccgcaccaggcctttccaacatttctttaaagaaactaaaaattaatttgaataagtaacacaaaaatatagtttaaactatagtataaaattcaaaactatgcaatgacaagtacatctttattttatctctttacttctcccacccagaggaaagtataagttctttatatatccttttagaaataaactgggtataaataagcatgtgtatacacacacacacagaaacacacacacaaacacacacagatatgtatttatattccagtgtatataaatacatttatatacatgccatttatatacacatttgcatttctgttattagcgactctaaacaccatttgaaatgagccgtacccatttgtaattccgttttctgaactgtccttcacttccttttccattggattgctgaatttttgcttattgatttattacagttaagaaaattaacttgtagtctgtgacaggaattgtaatgctttaccattttgcatttcttttttaacttgcagattaaaataaaaagttttatatagttaatccttttttgattttatgtttctttgattttgtgtgatgcctagaaatgccttccccactttgtgatatttaaaaagaaatttccaatttttcttctagttatttcttctgctctttctcaaatctttgaaccattgaaattttattttggtaaaaaatgtgaggttaggatttattttgatatttttctggatctgcatttctaaacactgtttattgaggagtccatctctttcacactgatttgaaaagctacctttattgtatattaaatttcttaatacttaagtatttaatacttaagaacaccgtggaatactatgcagccataataaaggatgagttcatgtcctttgtagggacatggatgaacctggaaaccatcattctcagcaaactatcgcaaggacagaaaaccaaagaccgcatgttcttactcacaggtgggaattgaacaatgagaatgcttggacacaggaaagggaacatcacacactggggcctgtcatggggttgggggacgggggagggatagcattaggagatatacctaatgtaaatgacgagttaatgggtgcagcaaaccaacatggcacatgtatacatatgtaacaaatctgcacgttgtgcacatgtaccccagaacttaaaatattaaaaaaaagaaaaaaaaaagaatttgcatctatttttagactttctgttctattcatctgtcacttcatgtgtcattattatgctttcaattattgtagctttataatatgttttattatctgacaaagattccccattcctattagtttctctttttcagaaaatttctggcttttaatgcctgtttatttttcattgacctttataatgaacctatctagttctggctgggcgtggtggctcacgcctgtaatcccagcacttcgggtggctgaggtgggcagatcacttgaggtcagaagttcaagaccagcctggccaacatggtgaaaccctatctactaagaatacaaaaattagccaagtgtggtggcgggcacctgtagtcccagctactcgggaggctgaggcaggagaatcgcttgaactgggaggtggaggttgcagtgagccaagatcccgccactgcactccagcctgggtgacagagtgagactccgtctcaaaaaaaaaaaaaaataaaataaaataatgtaaaaaagttctgttgatatacttatgaggtttgctgggtttatttgttagcattacatgctatacattgtaaaaatgttgattctttttcttggaatactaatgcctttccatttgttgaaaccttctttgatgttcccaggagcactgagatttttcttcatgtagaccgtgcctgtttctaataagttaattttgtagatattttctacttgctctagttaatgtaattattttctatttcatttaattatatgtgtgtgtgcctctgtgtttggggtctggatttcagtacattgattttctgctcagccactttactgaattgtctcattatttgaataattttagataaattttttttgagtttctagttaagtaagtatattatctgccaataatttatcctttctttccaatttttacaacacttatagctttcttctaactgtactaatacctctagaatagtaaatattaaataactgtggttgagtaaatgtccttcttttgtgtctgagtttaatgggaatgctcataatgttccctgttactagtgacattggctttcgatttgagaaatgtattgtgttgaaaagtatccacacttattttgatagtgttgttattgttgttgttttaattgagactggttgttaaaaggttatctagcttttttttttaaagaaactttgaaagtaatcatatattctaaaaaaattttatgtttttctcttttgtcctgtaaatttgctgtaatatatgaataaaattttcaaacatgaaatcttgttagtattcttgctaaaataattatcaacttgttcattgtttctgtattatatatttttagtgttgctagatcctagagatcattaatatattaatgatctgtgcttcaattttcataagtgagattatttgaaaattctgtgtgtgtgtgtgtgtgatcgagaccatcctgaccaaaatagtgaaatctcgtctctaatgaaaatacaaaaattagctgggcatggtgtcatgcgcctgtaatcccagctactcgggaggctgaggcaggaggatcgcttgaacccgggaggcagagtttgcagtgagtgagattgcgcccctgactccagcctggcgacagagagagactccatctcaaaataaacaaacaaacaaacaaggaagcttttcttttttctttattttgaaatagtttgataacatttacatgggttatttctttaaaatatggtagaattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattgttttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaattctttattttctctttaaaatcttcaataataccttctactttttctaggtttattttgttgtttttctcattgtttgaacttggctcttaatttccatatttttatttctgcttttttattcatataaataagatataaattttcctgtaagagatgcttatttgtatgccttaagttttgctaaatagtgtttttaatcttattttttagttatttgactatgcacaggttcttaaaatcccagacccattagaatgtaagctttgtagggacaggaaccttgtctgtttatttattttgggtctaccgttgtgcctgtcatatatttcttaagcacttgctaatgtgcttaagaaatgcttttgtgtgaataaataaatctccagggaattatggaatttgtggctgattcagtcctgtaactctagttcgtttctgcctcatttggatattctctctaggtatctactaatgtgtaggaataagaacatattagacatgcttcaaattacctttttaggtcatgatattaatagatttattttaaaagtctacatagtttttctcaaatcaagtatacctgggtaaaaatgtctttctaaagattagcctgtctgggcgcggtggcttacgcctataatcccagcactttgggaggccgaggcaggcagatcacctgaggtcaggagtttaagaccagcttggccaacatggtgaaacctgatctctactaaaaaaatacaaaaaaaccagccaggcatggtggcaggcacctgtaatcccagctactccggaggctgaggtaggagaaccatttgaactcaggaggcggaggttgcagtgagccaggatcgtgccattgcactccagcctggacgaaaagagtgaaactctgtctcaaaaaaacaaaacaaaacaaaaaaaagattagcccaatctatttctagctacttgggaggttgaggcaggaggatcacttgagcctagaagtttgaggttacagtgtgctatgatcatgctacttcactccagcctgggtgactgaccaagaccctactggaagaaaaaaaaaataagaattgctcaagaaaaaatacagttgagtagaattagaatgctagcagtgttgcaatagcagagatcacatgatgcccatgatgtttgtgaccttggacactttaggctaaattttgcacagaagcccaagtccaggatagaaatgataacgatgaacctgctgtagtgcagggaaagatgcagagctggggggaagcccaaacccctactgatggccactttttcttctgacctcttcctatgtctcatttaaaaaccagtagctttacttcgaaaactcaattttcagatgagaatcaaaacaaaaatgcaaagaaggcaaatgattcataaaagttgctgagtgaattagaactataatgtgggacaaacactccgcctttctgtctctgcagctagtggtatttccaggttcccagggaacctcctgtcccttgctccactgtgcatttttagatggacctgatatttggttacctcccttgtcaggcccaacaatccttgctaaggcacagacttgtgtatttgctgatccctgaggggaaagctgtgattcaggctctgaagtctaagaattgcagacttagtttcttgtctcccgatgaaactgctaatctgggtgccaatggtgtttctgctacatggacacctgcccacacagcatgattagaaattataatgatgacgacgatgagtcttccaggacacccacgttctttgcaagatatttctgctaatcgtttctaccagaatcagttggaaaacttttttttttaagttttttttttttctctgtatctaagtcaaccaaaaatgctggtctaattcaggtatagattaaaggtttgtcctcaccattaatggtgtgttattattcatgcagggcatcctagaaccttgggcacatagtgtaatggaaagcacgctgggccagggagatgtggattcaggcttgagcagtgccaaaaattttcgttatggccttggtaaaggtgatttcccatctctgtgactttgtgtctccttctgttaaatgggcattcaaatcttttgtacctaacttattagggccctgataatcaaattagccaataagtaagaaaatgttttcttaaccacactgtaaattaagaggattcatattgaaatcacttttccattattgctgtcttagcctgctaaagttatatttagtgtagtgcaactaagcagggttgtgagagctgggaaggtagactgttgtattgggcagggtcagggcagataaaggaccaaaataatgcctgaaatgctgtattaacctgctctaccttgaactgctgtcttgaattggggggaaaaatgaagctctgaggggatggtgcacagggagaaaagagagaatctcaggaattgaaagtctcaatggagaagaggtgggagaagaataggaggctagagtgagggcatgtgatcgtggagtaccgatctggagacaagagaagaaagtagaaaaatgccagcactgtctttggaccctgtgtatctggagtgtgggaggacaggcagacacaaatagagaggctctagggaaaacagcattctcatagaagatccttctccacaaaaagccctccaaatgtcctccaggagggtagaagctggttttaaagctcctcagggtcaggaagatccttctcttatttttctttgcatcgtgcagtttaatttagcacagtactttgctcacagcacttaaaaaattattctgggccttgctttttaattttaggcccaaatacctgaaaaaatgttcaggaggaattctgataagaaagagctaacttaggcaattccatttctttttttggttcactgtttcctcatctgaaaagtgttgggctccatgacgtggtttctatgacactcagtacctttgttgaagagaaaacatttttctaaaactaggatttccaaaaaaacaaaaaaaaaaaagaaaaacaaaactcatgaatatgtggatatttttgtgatagtgatgaaggtttgggaatggagtagaatgtttcctaaagtccttttcttttagcagaagacttgagtttgtaaactcggctcatataatttcagcttgcctgtctaccttccttccatctacctacctacctacttacataagtacctacttatatatggagaacacggtggaatttaatttttcttattcttttcgactttggttggcttggtgaatcaagtaaactgtgttgaagaaaaactaacttttgagggaaaaaattgaaaaaaaattatgattctttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcgcgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaaaaattatgattctttgaaaaggatttttctcaggttagtttatatagtttcacagatgcttgagataaggattagaaagttcagacactgaatctccacagacccctgtgaatgtgttggctaagcaccttgtcttctcaggaacacacactggaacagactttctttcagtaaaacagggccagaatagtctttgaaacatccaacggtggtttgggaagaggattctctatataatgcctgtccaaatacagaataaaaattttcaacaattagcaaaaatgtggatttttcagttaccaattccttatttggcacagttggtctttctcatcttattcattcattcatttatttcattttatttatttacttttaaaatacttgtttaattcacctttcttgctcccattgagccttttaactaatcaaatgcatttgaaatgctattaatttatgataacagtaagacccaagacatcactttatgtaatatcttgtattgtagttcattgttgtcagctctttttctgatggggttttgatttagctggaggcagtttaagggtgttcattccccaataatgtttgtctgttgaagctggtgagctagactaacagtacaaagagttcctgtgtacccttcacccagctttccctgatgttaacatcttatataaccaaagtatgtttaagcaaagaaattatcattggtgtaacatgactaaagaagtgattatatcttttattggcagttttccagtttttccactaatgcctttcgtttttttcctagatctagtttaggatgctgctgtgcatttagtcatcctgtcttctttgtctcctcctgactgtggctatttctcagcctttccctgtttttaggaccttgacacttttttagtgtaacggtcaggtattttgaagaatgagtgtcttgcaacttgagtctgactgatgctttctcatgattaaattggggttttagatttctgggaagaccaccacagaggtgaagtacgcttctcattgcttcatatcacagcgtacatgatgttaatgtgagttattactggtgatgttaattgtgatagtggccagttttgttttattttattttttaatagaagaccagttgtctgggactatacacactccaacacatttgcaaattggtggcaatgattattgactagtcctcaaactactaacttcatgataatggaaagccgaaactcccaaatcacatggacctcaaagttcaattagaaaatttggttaggacctgacgacaatgttgcgatttgctacagcctgccctgcagtctcaactctggggtcccctcagtggtgagctcagtcacagtgctgcttctgtgtatacttacccagtaaacaacccaggcattggggcctgtctcagaaaccacatctccaatagaaaggagaacacttgggaaagcaggaaggagtaagaaacggaactcgcccattcctgacaactaatccttttcctttctaagtatggcttagtggatgtcagccattcactgttcaggacaggatagggatgaggagagaattctttttcatttgacaaggacattgaattttccttatccatggatcaagactagaaggtatggagaggaaaagggcttctcatctctttctttcagtagcttcatgcactgatgcatcgtacttactgaatgttttaccttctctgtgctcttctcagaggatgcacagaggattgggaagaggaagtattggtgacttgatctagaaaaaagagattgtttcaagccacaaaaagtttgagggtaaaatctcaagtcctgtgtgtgatgaatcagtagaaaaggtatcccagtggccagtgtgagtaagctgtcatattttcggtagtaatccttggtcctgtttgattttcctcatcctcacatataagatggagccatttctccctctggcgtttgccatcacagtgtcctgcagtctcttggtcttgagatagaaggttgagagaaacactttgcagtattgggagaactgggtctgcctgtgggagtacttgtatctcaatcaatattacagaacttggctccttgtttccaacaaatgttttgctctgttctcatcctgggagttgaaggttgaggcgaggtgggagatgtgctgtataatatggcagccactaaccacatgtggctgttgagcacttgaaaggtggctagtgccacatgttgaaaaataatattttggatatatttgtaaaataatttttttcaatgagccttttgaaatgtggctactagaaaattttaaatggtgtatgtggctcctatgataattctattggatggtgctggcttagagcctgggaagaacatggatcagagtcaattgaccttgtgttctcccctgagttctaataatattgtcattaaaaggagaagcttcaacagccataattttcattttaaaaagtctaattcagaagaattggctcattttatattattgcttggactggagaaaaatctgacatttggtattttcataattgagaacataacttgctgacttaaaaaaaaaatcacaacattttgtgcttggccttaggtaccagcctttgagctctttgaaaatagggattgggtctttttctctttctaccatcctttttcccccaaaaccacacactaacacgtagaagatggttaactggcatttgttgaaaaccaaaataactttaaatagagaaaactttgtgaagctaccttgtatttatggttggaagagtgaaatacctttataaggcatcccattttcttaagatagccagcaaaaatgaagaacattgatccaagtgtttatttacttattgatttaattaccattctcatcaggtgtccctgtcatctcagcttatgataaggaatcttttcaagatgcttcacctcatcactctctaggtaaagggggacagaaaaggatgctgcttacatatacgaatccccatctttgctcagatattatgtctaagggcctaaggactggataatcttattttttctgtggcttgatcctttccaacatttaatctatggaggttgtgaggataacaatgaaaaggcaagtttaagcttggactgtagatacttttcactgggtggttttattttattatgcttcattgtgaaccagagcctctgtgaacatatgacttataggccctcaggcttccactgtgtccctttccctgattcgtccttcttcactgcatgccctggtgttgggtgagggagcaggctttatgtgatgtcattttctcagagccctgagctgggaaattcaagagtctccatgattcctagttaggcatggaagagaccctaactggtccctcaggaacatgtttggttggtcagaggtaactcttatagaatctatgatggcttagtcgttcactcttcctagaaaagacctctttaaaaaggccttttggttatatacggcctgagttttaagtaatatttgcaatgttgattctctggtagaagagaatgaaaagttgtgagtgctcttggaagagtgccggacagctgtagtgatgggaaaagtattggccttggagtcagacctgtgtttacttcctggctctgctattttctagttgtatgactctatgcaagtaacttctcatctctgagcattaatttcttcacctgtttgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaatagtcatcttccatcttcactttagaggtgggggaaaagggcattagagtgattgtgtggtaaaatccactctaattctagctgtgagaaaaagagcggtgaaaatgtggtaagcaattgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcagatcagtggagctgtacctgtgaatcaccttgggaaagcacagtgtgggtaactagaaggaaggtcttgtggctcattttgtacccacttcctgggctggggaaatatctaaactaacctttcttacttgtcaatatctactaccgttcaccatgcatcttcacagatgagggcctctttctcacatcttcactccaaacacattactgtgtagacagccacttattttctgggaagaaaactttgcaaagcagtagcagaataaagtcgagggtaaacagaggccatggaaaagcactagagtttgagtgcagagacatgagtctgagcatgagcagtgaatagctcatgaaacactcaagttgcattctccttatgtggaaataaaataagtcatggttgttctatgcacgtggcacctgaccttgggtccttattgctatgctgctagagtctatgaatcaagatttgccagttgtgatcttgaaatttagtcagattaaaagggaactctgactttgagggtgaatgccccaagtgggcatcttattctcctatggattcagcttgttaggcagaatggaagtggaggtcatagattttagggttttctcctgggattgaatccagctgaagcaggaatgattctgggtgagctatataacgtctctgagcattagtttgtcattttcttacataggaatagagttattgccagatttggagatagtacatgttgcaatgtggttgacacagaataagctttcaataaatgattggtattgttgttgttgtcgttattatctataactacaataatttccctagccttattttatagggataggttgtggcaacatgaaatgtgacttggaaaactgatttgcactagatagatagaaaccatgtttttctatctatataatgaacaatgtcatttaagaaagcttagaggcaattccaccagcaccatcttcttttttatttccattcctagattatttgccctcaagtctttggtaatttctttttgccacatctcttgaatgtttcttctttactatattccatctattattaccataagtccaacgttcatcacctcctgctccactgttgttcctgtctcctggctctcctagagccttggttctcaaagtgtcattcacagagcagcagcatcacccgaaatgcgtcatctcaagatctaccaagacctcctgaagcatgaggcatgttcacccccgtgttgtaggacctccatataactcatttaactacttctcctgctcagagtacatgcttggccagtgcgtgtttgttctgcctccagaatgttttctgactctgattgctatcattacttcttttgaatctacctaaattcaagttaccatccattgccatgactatggcaatagtctctgaaattgtcttctacttttatggtttccccttgtggcctttttccacaccatctggagagatctaaaattgttggtcagatcatatcacacccctccccttaagccatacggtggctgctgtagtatctgcagaaggtccctgacttatgatggtttgacttacaatttgtccacttcacactgagtttatctgggtgtaaccaaccccatagaaatcaaggagcatctgtagaaatgtttgaaaggccctttcatggcctgcaaagccctgtgagatgactctatgttctctcctttttttttctttctttattttttttgagatggagtctcgctcttgtctcccaggctggagtgcgatggtgcgatctcggctcactgcagcctccaccttctgggttcaagcaattctcctgcctcagcctcccgagtagctgggattacaggcaccagccatcacgctcggctaatttttgtatttttagtagagatgggttttcaccatgttggccaggctggtctcgaactcctgacctcaggtgatccacccgcctcggcctcccaaagtgctggaattacaggtgtgagccactgcgcctggcctctctgcttttttcataccactcatcactttacacagtaatctgtagacacactgaccttcctttagccctctgtataagccaagctttttcccacttgatctttctctgattctgtgcaaaactggcttggaagtatctttcaaggcttagctcaaatgttaaagccttacctagctcttccccattctttagctaaagtagcacacatacccccctccccatcattcttctgtcattatcttgctttatagtctacaaagcatgtatggttctctaaaagagtgattaccatgcttttgttttctttatgtacattgcaaactgttttggtgagaaatattttagtaataataataatggtgaagatttagtgagtgtttgctataggctaggcacactgtatggtaaattaaataatttaatagatcatttatttggattatttcattctatttagctgattatatatttatattttttgtgttcctcttgttttaggatatcagcttcttgagagcagggtccatgtttgttgcatctgtatctccgcctgtagaagattctctggcatagggatttttgtgcaggaagtgtttattcaggaactgaatggatctcagaagattatcatttgggaatagatctacatgacaagaaagaacaaagagtctctctcattctttttcccagatatatcccgggagaaaataccctcgactttttcttatctttaatctgagaaggaagcagttgttggaatctgatttaggattggctctagtggccctgtgtgcagacacagatcttgggattcatctgaccatttggggagagaggttcttgaggggcaccttgatgataacgagtctttctaaagctttaagtttggcgtttgaggtggttggaaataccaggtcttccgacttttacgttctttgtgcgcacgctggtgatgtgcgtatgtgaacctttattattatggactcagccagcagtaaccatggtgagtagacctatcacacagcatttttctgagtcagtttaaaatgctgacaattaaatataccgtactcttttaagcaatccatcagtctctcttgttgtcatggtgaccggagtatatttagaaatgtgacaagtacactgagttcaattgcacttttgccaaaacatagttttgcagctaaaattgaatttcctgattgaagatccaagtgctgttaagggggcatgatcgtttctatacattattctggaagtataacttaacgttattctgttaaatccacagttacgagtcttatcaggtattgatagttaaagtggttgtacttaaagttgatgaaataaagtgaaataaaagtgacatgatgctttttctattgaaaatgaaactgggccttactaatataactagtttaatgattagtttctttatatatttataaagacattgtaggtatgtacctgtctgttcttcagaattatatttctaatttaaaattatatatcatggagatcctcccctgtttcctgcttgtattctattcttagtattgtgagggcattcttttttctttgggtctgacctctgtttgataagcattcttatttttcctcaatctcaattcttctggattttaaatgaagtaaagagacacaatgaacgtgactttttgcccaaacaaaggaaaaacgaaactcttctctttattcaagaatgtagattaaattcttactttcttatcatcctctgtcctgtcaacatagtgctgagaatgatgttgtgtatcaactcatttgaccacataaagtttaggaattaatgtagtggctgggtcatgattacaacactgatttcattcctggccaaagactgattcttctgctcttgaggtgagaaaagccagtactcctggatactttcgcttctctatttttatctaactgaatgagtctgcaactgggatagtttatgagcctctaataatatacggttagactaccattatctctttcgtgaacattgccaaaagtgtttttttggtaagagatatcttagttataataacagtttgtaggatttatggagtgtttactacatgctaggcactgtatatagtaagctccttaatggatccttatattggatctacacagaaatcttatgaggtagttcccattgtattcttattttacgttaaagaaacaggtttggagagatactgtcttttgaagaagcatataagtggagcagtagtggagtctgaattctgatacaggtcctagtaaccactgcctgttccatggaaggcacacagtgagtattttttttactgaccagtggcctcttgtatggtgacatcatacagatgtttcagtgtttccagaggctcaagaaagtagcagctatataaagatagacaggtagcagcgtctgaaagtagagatgagctactctttatctttcctagtggtttagagccaaagtagattagtgctagggagagagggaacataagtcctgtctagttcagtggtttcatctctgaactcctttatgttcttaaaaatgagcttttgtttgcatgcattatgtataatgatatttaccatattcaaaaaagtaagaaatgaaactacaattttaatgaaaaatatttgtataaaaaataaatatatttgtgaaaaaatagtgacaaaagtgggagctggattctgcatttaatttgttgtgaaatattgttttgattgatgtttatgaagaaaatccagtctctcacagctatgtatttgaaaaaggaaggataaaaagtaattgtggattttcttctttgatactataccaaaacttgacagttttcacattacctaaagttagtagtttcttataggttagtttcaatgtggaatgtgaaatcatattaatggactttttataccctattatattaaaatccattggtcaaattttcactttgattgagtctcctatgattttgtaaaatcatgcattggtcatttagaaagtcgttggtcactcacttattcagttcttgcaaacactgatcatttcattctataatataaaaagtcatcttcattaatatcactgctcattcatcaaaaaagcatttgaaatattagaaaggtgtcaagtgcacagtagtagatgtaaggttttcaaaattctgatttttacttgaaaacatgaattttatttttggctacaaatactgttgttttccttgaaacgataagctctcttgctttatttttgagaaaatctccggcaaaacccacatttaaagaaccatagttcgtcagtcattgtttcaaataaaaatgatgttccatgaaaaaagcgattggttagcagctgtcaatttaaacagttacacaaagtgcatttcttagagacaatcatcgtagtttgatcttcagcaggtgtttcatggtacttcccagaggtcacacagaatgtaaaaaagatgtgtactcaagaatattaaaaatatgtctactttttgattatgctaacattttatgtgatcaggtttctttagtaaaacctagtcagacagtactcaaggactgagatttaataagattgatacgtttcaatgcattaaagagagtcttaagtgaaactggctccctgtcccgcttattgtatgtgtcttacagtgaaatcactcccttgattcactttaagactgcaacagtttttttacccactgttatttttgtagcattaatgtaaatttcaacacagggaaacggcttcttagtatgattatgaaaataattttgaacttgtggactcttgaaaggtctaagggactcctacacatgtatgggtcacacattaacagccactcattgagtccagtcccttcatttgacaggagaggagagtggtggaaagatgtgtctaagatggcagcacaagttagtggcggagctgggacaagaacctattgttacttaactcttctttcttttcttttgatttcctgctccactttcaggaatttaaaggtaactcaaggaattccaaacttctttgtcagagatggtgatgacaaatatatatagtttgtatatcttttatctgaaatgcttgggatcaaaagtgtttcagacatcagatttttcctaattttggaatattttcattaaacttactggtttacattcctgatcaaaaaacatgaaacccaaaatgccccagtgagctttcagcgtcctgtctgtccttgaaacttctggattttggagcattttgaatttcagattttgggttagggatacaaaacctgtataattattgaactttttgggaataattccgttttttaaaaaatgttaaaccttttgcatattttccctactctccgctcaccactactatctcttctgcttttcaatggtaaccactcatgcctttttaaacaaaacatgtgttgtatttgccaagacacaggggaagcgaagttaaaggtacagttgactgttcattttctgaataagatggaattctagctttgtggggaaggaagaatcagtgagttttcgttgaaggacccatgccattctttacctaaattaaagttgttaaaagtcacaggaaagaaaattgtgcaagcaattatcatcctttatatcactataacccatcttactaggcaaactgtgccctttgctccccaattattctctattaaagtttcttgctctccctccccatccttctctttctctctccctgtctcctcccctttccttctagaaagaggttgcccaataaaacttgctcttaactttgcttttggttatgttgatattttatgtgacttgttttcttcactaaacagtagtcagtctatgagactgtattgaagaatgctgagaaagtcaatagaagtggacttagaatactacatgttcttttaaatatgtctcttatgttatagagtaactttttggggagctaaggtttgcagacaatgctgcgtgtgaacatatgtgagtaaatctgataagctgtggaaggaggcttgcaaactttcaaatgtattgtgctttcattttcaacttaattggatgttcttttgcaaggtcttgtttttttcctagttctcattcaccgttcagttgccttcccccacctgtgagctttttgagtcaaactttgtttattagcttttttcctgattcttctttcatgtctttctttcctatcccaaagtatgatttgattagacctcaggttacccttctgaatgagctcttcctcaatcctaggcctggccaggcatggtgcctcatgcttataatcccagcaacatggtaaaaccttgtctctacaaaaaacacaaaaatgagctgggcatggtggcccatgcctgtagccccaactactcaggaggctgaggtgggaatatcacttgagcctgagaggcagagattgcagtgagccgagatcgtgctattacattacagcctgggcaacagagggagatactgcctcagaataagtcagtcagtcagtcagtaagtaagtaagtaagtaagtaaataaataaataaataaataaataaataaatacgtaagaatcctaggccttggtgacttactctttttaattttttttcccacaaaactgatgtgttttgcccttactttcaccagaagaccatttagtcttcttattttttcttcctgagacttctacatttgtttttttctagccatttatattaggctcgcaaattgcatagtgatagctgattgaccccttcaaaatgcctgttttctgcctccttgtctcagcttcttgaggatggtgctatctcatgcttggtgtatcataggagccccatggatatgttgaatagattttgctcaggggtctcctctttagagagcgttcttcacatttttatctggagatctgagcttttatgtatctcccactattgggctgctaaatctcccaaacccagaattgcaatgtccatcttttaatgcagactcccagccactgccaggatatcacatgtcttctctgacagatggctatgtagcctccacttgaacttttgcagctctttgcaaggcaatttgttctactgctggacagcttcatgtttaatgttttcccttgtattacactaaaactgattttcccattattttaatccccatatttctagcattgcatagtttgaaaaagtataatattgcttacacatgacatgtccccagatactcaaagatagctctaattcccccatctgcctcctttcctcctttagaccttctcttgctacttacatcccatagaaggctttggatgctcatcctcttggtgctttccccatttctacatcactttctagattttggtcctgatgtccaactctaagggactccctcaaggccacattttatctctgatggtactaggagcagtatgagtaaatggtatgtgtatgagtctgaaagctgagatatgaattctggtgcttattagatgtgtgaacttgattaggttacttaatctttctaaacctcagtttcccaagatgcaaaatgaatataatattaaattccaagactatttttaaggattaaagatataaaatgcttagcttagttactaaaatatattatgtttagcttgatcaattatttcatcttttatctatccaacaactccttttctttttcacacatgtgcacttggttttaaaaattatttcaagagttcttccctcctcctttccttctctcttttcttctctctttaaattttataacgtatatactcttataaaagttaccatcatgtttagatttccttctaaacttttatatctagaatttaacatgattttcttgacaaatatgttttcttctatgtgaattttcgcagctgctgcctacatttctgctcatgtgtttagcctctgttaatcttcctgtgaaaattgtgacttcatcctgccaatgggttaatgatgactggctcattgcatgtcacttaactcctcgctaaatgcttcacttgatcactcagtaactttacaatcatttagttgtacaatacatttaaaaaaattaaaagttcaattaatttcaatttcacaaacacttactaatcccatcttatatcacatgcattaaactaggtgtgtgttatagtagttgcatagaacattttgttcatttgctcattcattcattcattgaatgttcttttgagtacatactaaagaccagatgctggatagactttgggttcggattcaagaagctgtgttagacaaagagcctctattcaagatgcatgatcaactaaaagtgataaaacaatatggtaattttagtgatccagatataaaactaggcattatggtagttttaagaaaggctgcttcatcgaacatttttgcattaagaagcttcttatcggggagacactaaatgttgagtagggcctcagactctactagaaaggtaagacccatattagggcttggttttgtttgattataaagccattttgtgagaatcaacctccaggctccatgtgttatctttggctcctcaccttcacccccaccctcccaccccagttgcatgcatgccatatttttccttcttcttttcaataaggaagcatcagaatcaacagaataacataaagataggtgtggtgacattataggctcacttctggggcgtcattattacattaatttttctatatttccaagtaagaataacaatgtaagtacataaaaataatctcatgatagtagaacatattgcatagtatttctctattcatcattccctttacttcttgtagaaaagcttagtgcttgtggatttccttaaataagtgtcttaagcactgtatctgatctgatagatattagcacaacaattggcactgagtaattatatttggagaatttggaaggaattttttctctattgcaaagtggtcatgctgtgttgtctgcttttatttatatcacaagaccagatctgccgttaactagatgtctaggaaagagttcctttactactctgtgccttagctttgtcacttgtcaaacgagaatatactaggaacagtatcagttttgcctcactgagctgcagtgaagaataaaatcatttatctgtgtgaaaggacaatgcatacagatggtaacaattataaatattaaactaagcttttgagtgaccggattggctacttctcttaaagtgagttctgcttaattagttaattcttacttattgccccaaactttctgagatagcttcatgtttttttcctctctaccctgaagtgcctgcttgcaagcactatatgctcaatgagcatttgttgaatgaattttttaaaagtatttaccttttttgcttttattattattttaaattaacacataattgtacatgtttacggggtacagtgtgatattttgatacatgtatacaatgtgtaaagatcaaatgaaggtatttagcatattcatcacctcaaacgtttattatttctttgtgtttggaacattcaaaagccactcttctagctacttgaaaatatacaataaattgttggtaattatagtgattctatagtgctgtagaacactagaactgactcctcctttgtacttttgtatccatttaccaacctttggctatcctccccctcctgctacttttctccacctctggtgatcagtattttactctctatgtgatcgatttctttcagcttccacatatgagaaaggacatgtgacaaataactttctgcttctggcttatttcacttaacatgatgtcctccaggcttatccatgttactgtgaatgacaagatttcattcatttttttatggctgaatagtattacattgtaaatatataacacattttctttgcctgtttatctgttgatggatacttagattgattccttatcttggctgttataattagtgctgcaataaacatgggaatgcagatatcttattgaaaatgttttttttttttcctttggatatatgaccagcagtgggattgctggatcttacgatatttctttcttttttttttttttttttttgagacggagttttgctgtgtcaccaggctggagtgcagtggtgctatctggctcactgcaagctccgcctcctggcctcctgggttcaagcgtttctcctgcctcagcctcccgagtagctgggactacagacgcgcgctaccacgcccggctaatttttgtgtttttagtacagacggggtttcatcatattggccaggatggtctccttctcttgacctcgtgatccgcccaccttggcctcccaaagtgctgggattataggcctgagccaccatgcccagccaatatttctaattttagtgttttgaagaacctctatactattttctataatggctgtactaacttacattcccaccaacagtgtatgaattcccttttctttgcatctttgccagcgtttcttattttttttgtctctgataatagctattctaacttgggttagatgatatctcatggtggctccattttctgtatatggatgtccagttttcccagcaccatttattaaagagattcttcttgtttcctttgttgaaaatcagttggctgtaaatacgtggatttatttttgggttctctgttctgtcccattggtgtatacgcctgttcaagaactatcttgaataaaagtggtaaaagtgagcatctttgtcttgttccagagcttaaaagaaacctttcaatttgaacgtgtccagtatgttgatgactgtgggtttatcatgtgaagtgtttattatgctgaggtaaggtatgtttcttttatacctgacttgagatattatatcatgaaggaatgttgaactttatgaagtgctttttctgcatctaatgagataatcatggtttttgtactttgttttgttgaggtaatgtatcacgtttattggtttacctgtgttaaactatccttgtatccctcggataaataccacttgatcatagtaaatgctcctttaaatgtattggtggattcagtttgctagtattttgttgaggatttttgcatctatgttcatcagagatcctggcctataattttctttttacatgtttgtccttgtctggttttggtatgagggtaagaatgcattcatgaaattctttatttttgagatttattcttttttattatgtctatctttgttgaatttcttcttcatattgtgaattattttcttgatttagtaaaattgtctatctgtattttcttgtatctcactgaggttccttaagatcattattttgaattccttttctggcattttattgatttcttttttactggagtctgaaactaaagagctacattcctttggtggtgtcatattttattgctttttcatatttcttgtgtcagtgagttgatgtctttgcatccggtggaacaattacctcttctatacaaactttctggagtggttttcataaaaaaagacttccgcttgcaattagggttggtgttacagttgggaggggtgtgatgactttgtttctgaatagatgcagtgatagggtctccatgcagcttctaaagctacgttcaatgtcagcaataactgtgggcacctcagtagcttaagttgtagaaatttgtggcagtggtggtggtggcatagattattaatgtcctcagtgtcaagggcttttgaggtcctcctattcttatttttttcataatggggagatttagccaaggggactgctcttcatgtcagatatcacatgacctacaagcaagtgcagtggtgctgagttctaggtgcaggtgcttgaagtggctgtgggactagagtcttatgcccaggatcttgccaacctattgtgacacctgggtcttgggttacaggttcactctctgtgctagggttggatgtaggcttcccacagagccaggatttgtgactctgagacattactctacaaactcagtcccagctgtgagtggctcaactccaggaaagaaggagtgcagggaagtttggacccagagagcaggatatgccctgatttggcaacatgagccagtagggttcagtggcaacttggatctcaggggatgaggcaccatgtagtagtgattcttgacccctggatgttgggactcagcagtaccttagactctgtaagaccacatgcggtagcagtaccccagaatggcaacatacagctgttacttgtgccctgagtgggggcagagtacagcacagtggtggctgtatgccacagggagaggggtatcttagcagctctgacactaagcaggtagaccagctccagggaaacagcgtattagagttgttttccctttaggctggagtgtctcagatcagcccagccactgctcagttttccaaggatgtgggttatcacatcagctcagctttgggatttacagctgctcagctgagcgatggcaccaattcaccaagggacaatatgccacttcagctcaggcctgggggacatgacttttctaggcagcccaggtaccatttccctgggatgaagggtgctacttcagattaagtactggggtgcgtgaccgctctgagtggccaatgtactgttttcccaggaggcagggtactgcttcagcactggcctgaaggggagggtgaaaggtagattaagtgactctaccttcacctgggcccatggggaagagtggaacagttgctggcagctcggcttggggatgtcgggccactgggttcgggtggttcaacggtagcttagccttagtgatggagtgtcatagctatgcactcccagagcaagagacactccagccaaagctccatttccaagacggcatagcgcagtagctgcgcaggccacagagggcaggtcacactggttgctctttttcttggggaagcacggctatgtggacttcaggcaggtccctcagctgggacttggctcctgtgaggactacatgagactccatgggtgaggtctgtagctgttcaaggtgttgatggggcttgctgggatccttttgtgtaccattctaccctagagagaagttcctccctgtttccagcagatcccaagtgggtgatgggtggtaaagaccaggtgttttgtttctattctctatgtggtcattctgagtttcttgctatccagggtttctgttacttctctgatgcagtctggtacactgccttagttattattttttcttcttctgtttttagttcatctttttgtttttttctatatagcaatggggtttccctatgttgcccaggctgctctcaaactccagagctcaacagatccactcaccttggcctcccagagtgccgggactacaggcacgaaccatcgtgcctggcccagttatttttgttaaagtttagttgttgattgttgttgtggctgtctttgtgaaagagacgagagctaggggcctctggttggccatgctactgatgtcactcttaaagtacttatctttaaaagtccagtgctggagatttgtaagctacttatatttctgctcagaattcctaaagtctctcattttatttctagattatacattccattgatagagcccttataaatataacattaagaagttgagcattacctttaggccaaagcaatttacttttaaaaaatctgattaatttcaacacaatcaaccagatgtcagaagatttcagtgcctctgatagatgctgacaggtgtggaaattaaaatcagagagggaagcaattaaatcctggcaaacattactttaatgagacaaccaaatcataagctatggaataccttgtattcttgataagtatcttagggtggcatgagagtgcactttaaattgtatgtggtatttgatgactggaatgcagggcagtccatatttgtcatctaattcctttggcctgatttaacatttcagttgcttctggggacagacttctatgtttaaaacattgttttattttaataaatgttaggttaagtaatccttttactactacctctgttgccacatgaaacttatgaaaatgaccaaattattattggccttttcgcagtggttttgggataactgtgaaaagagaaacacagaatgtgtattttatgcaacttctaatcaaaagatttgataattacagcactaaaaccagaacccagttcctccatccccatttcattattcttttcaatatgattccccctattcggaatgaatatcttggacaccagggtgaaagaggtaccagtttattgacttagtgggagtttttataagatactcttatattgcttattgaggtactaaagcacttacaaaatatcaagtattttgagttagctttacactggttcaataacacttagaatttttgttcataatactaagataatcatcttagggatggttacattttgttgtgaggtgtggtggaaaattcaaaggacaccatggtttgtgaaaaacccattgcagctgatctctgcacttttcatttccatgtcattccattttcttctgctttttctttaccccctgttattttcttgcttctctctctttattatcttaccttcatttactccatcctgtttttctccaaaatatagttgcttctgtaaaattgcttctgagggtgagcatatttttgaggggagagaggatggatggtttgacaaaggatgcagacatgtcaggttctgggtcagcagttagttataaaatacacagaggcagccaaggataactggcttcattaccaaaaggctagagtgggatttgtcagttgtcccagatgtctgtatggaattatggaaaactccattgcattatgaaacactcaggagctactcaggacacatgccactcaatccacgtgaagagggctggtgaacttcttagctagaaagacttcagctttcctattgcttaaaatgagactgattggtgaaggatttgtattagtccattctcacgctgctataaagaactgccagagaccacgtaatttataaagaaagaggtttaattgactcacagttccacattgctggggaggcctcaggaaacttataatcatggtgaaaggcaaaggaggaacaggcaccttcttcacagggcggcaggaaagagtgactgccagcaggagaaatgccagatgcttataaaactatcagatctcgtgagactcactcactatcatgagaacagcatgggggaaattgcccccatgatcggattacttctacctggtatcacccttgactcatggggtttacaattcaagatgacattttcggtgtggacacagtcaaactgtatcacactcttcacaaaacttcactggtacagacttgcgtatatggcttgtgcttcgacactttgcccagggatgttgcatcttgaaactttcctggtgagatctgagaaagtgtttatggtaacactgcatcaaacactccttttgccttagcttagtaatgtgtcaccttctggttagaccacagatgtgaagtctactctttctcctttcacttgctaataaagcagaacttagaactaagtgtgtgttagtgcttcgacaattgaattttctgtgctatacactcggtttccctttcctgaagttgtttagttaccctcttcaaatagcaattgggaggctacgtcatgtagtaggagggtgcttactgattttggtatcaagatacagtgttacatttttatctgctccatgttaaccatgtgatctttgaagtttggtttttgtatttgtaaaatttgggtaataaggtctcattggagttataaagggaatggtttgagacataatggtcattgtgatttttcaagctataaaataaagcatgatgttaaaagatgattaatgttttcatttggtggtagatgacaagtttcttgcagggcatctgatcaatcatgctcttttttttttttttttttttgaaacttttattttaagttcaggggtatagttgcaggatccatgttcttttcttaacctgttttgagtcctttatgtaaacgggacattttatcaaaacttcctagaagtcttatatttctcaataaatccatccattctattaaaacaaatttgctttgttcttagagtctggtggaaactccaactctctgaacctagggcatgattatgggcacaaagttgaaaatgatgtgcgattcatcagcaggtctttcaactaaagcagtatctgttttgctttttaggggtcaaggaaacttttgattttaaaatcttaaaagtttttgggctgtctcttgttagatgaggtcatgtgagagtgacatagattaatatttcggtgttttaaaactaggaaacataagtcaaagagatattctcttgcctaatgtgcttataatgttatcttttgatcatataaatgtggatttatgggaagaaatgttatcactgctctctataaccatatatatggaataatggagagaaatcttatttaaaaagtttaactaagggcaactttggctatggagtatatatcataatcttcacatacatatgaagaaattgacactcatggagtttaaataacttgcctaaggccattgattaaaggaaatctgactggctcgaaatcctatgtacttttcccatttcctcatttcaatcaaatagctggttttattttattttctctctccaccaagccttgtgaattaagacaatgagttgctgtttgtctttgtctttccctagcctaataacctaggaaaaactgaagtagaaaggaaggattactggactagcaggcacaaactttggctccaaattcatgccctgccagatactaaactgtgtaatcttgggcaaattactttccttttgtgaacttcagtttctacttctgtaaaatgtggacaataatattcattttatatggtttctgtaaagttaatcatgaggatggtgttagttcctttctcatcctttctgtccctctttgagcttctgtttcctcacctatgaagccagtagaatcatctcttcctgcttcttcatcgggttcctgtggggtgcaatgaatgtgaaaatgttttgtaaaacaagaaaccattatgtagatataagaggttatgactattaatgaataaatatgggtttggtgtctggaagtaatttttacttatttcatttgtaaacactagcattgcagttggctgaaccttgtgtcaaccatccattccaggagccagctatctgaggtaagagaggaggcgtgtcttcttgtttatgaaatactaataggcatctgagccagtaatgttgattttagaagaaatacaaagaatagaagaaatacaaagtactttatgaggaaaagaactgaaaaatggccaagacagtgagctgacctctctttttatttttgtttttttgatttatttttttcccttttaattcatagcccttaaggtttaataccaaaaccaaaaatctgggccacacagacgattcagatttaatgtgtatgtatttaagtgtccataaaatgcaatggagtagaatgtgcttaaccattattttattgtatcctcaactagtatgtggcaggagggctttttacctggtttcctaacccttgattgagcgcatttttgactacactatactgccagtgttacctggctctgaaggggccaaatatttatggctgggtcagtcactctctcttagctgccaaacaaaatcatctcaaaaagctagaatccaaagccacaacagaaaaatcctaagaacacagaaaattgagttagtcttttgaaaccttgcatccattgtatctgaatgccactctcctgggggactgttgggaatgacaccaatccttggcagaagaatacatttgtcttgagtttgccaagaaaatggaggccaatggagaaaaaacatttaaaggaagcatcatagttgtaaaatttaccagatgcgatttttctcctaaagtcaacctgctgaatctgtaccttctaatgagctctactgtgttttatgtaatgtaacttaaccaaaaagaggtgaagtagtcaatatgtagaatagtaactttgtagaagatttgatatcattatttagagtactatacacatgtattctgctgaatattttgttaattcctttggtatgttatatctatgacctcgaactgcaaccatgacttcagttgcacagacctttgagaagaataaaattggttggtattgccccaaatttgtaggacttagaaaatttagaattgagaggaaattaaggtgtcaggtttacatgattttcaaagctaatatcatatatatataataagaacacgtgcagacaaggtaggttatgtatggactatgaaatttctgtaattaaaccagacataacagccacttaagttatttagattttcttctcattcctacaaaaaaagaacattgtttttatttttattattatttatttatttttcaagtggaatataagctagtttacccaggaagttttttatttatttatttacttattattttactttaagttcttggatacatgtgcagaacatgcaggatttttacgtaggtatacatgtgccatggtggttgctgcaccctatccacccatcatccaggttttaagcaccgcatgcattaggtatttgtccttgccttgccctccacccatcaacgggccccgatgtgtgatgttcccctccctgtgtccatgtgttctcgttcaactcccacttctgagtgagaacatgcggtgtttggaagccatcattctcagcaaactaacacagaaaaagagaacattgtttttaaaaaaggtagtagcaaaaaatgtaagaatggctcctgtccaccttttatttcttttctagtccacaaaataaccctgcaaaaacttatttctaatgttttatttttacggataaatatatcagaaaagaatgtactgtagatacctactatcatagtttttgacagctctgtgaggcagagatctaacttgttcatttagaaactgcagttatcacactaaccttccctccgatgccaattgttaaatattaatagaataagctttgaaaagtaattaactgtatcccctgtccccacagaaacccatcttgaaactatcaagaggagttttaagcaagccctgaaaggttacaaaaattactctcaagaaagaggaattttctctctttctcttttcgttatattttggaggtggggaatggtagagagggaatgatagaaacctctcaagtaacctttgggaggtggagaagtaaatagtctgggagcatgctgtagaaatttaaaataatcctgtggcaataattggtatcagtggcagtaatgaagaaagaataacagtttcaataaataattagacttgacagtaaatgtgtcaacaggtacccacttaatgagtgtaatcattgtttttctctgctctcaacgttgatccactgactgcggtgtgttctctgtcccatttccaaaccaaatctatttaaagctgcactccacggaatctgcaacagtataccctgtttactatttagagctgatacctaatgttctttaataggcaagatctgtacttgaacgagaacaggcttctggcctcttgtagacggttgattatccctgttttccacagggtgattcattagcaaggatgaataatacccaattaaatctcatggacttgtctatattgccagagtgaattgtttattataatttggtggaaacagtcctagtctgctttaaataaaattaatcagttaccgttttttgaagtggaggtagaggcagtagttataagtgaaattacctctgtaataacctgaatagaatcacattgtttttgggagcaaagcagtatgttgtatgttatgtgcaccagaagccatgagaatccttttctaatcccagctgtaatgtcacctggctgtgtcacctaggcaagtcaccttccctctatgaggtctgtttcatcatctaatgacaaagttggaccagttgatcatggcattacttccggttaaatgttctcttatatatgattttatttcctagctagtcccttctctctcctggtgccatgtttccaaaatcataggacagtcctatgactctactgcacagccactgtggaaaattagttatttttctgcttagcttttgcttcttttacataccagacatgcagttaatgacttttattatatatactgtaagaatgggcatttatacaccggtagcggtagtcccttaccccagcaacttgcaattccttgttaggaaagaaaagctgttttcctccacatttctttactctgtgacattgttccctgatctgggtcttatgagaggatctggtaaacttcccccctattaagaccgttaggaagaggtggatgcttcttccattatttgatttttccagagcaaatcactggatctgtaaaggagatcagaatgtcaaagccagaggggacttcacgaagtaatctaaacaaattatttcatgtcacagatggagattttagtgtctgggagggaatctgatttgtctaaagtgtttttgactgatcttggactagaattcttctgactacatagttgtatctttaagtagagaaatctttttctataaactatcctttcacttcctagttcttaaaaggccattatcttccaggcaaaaccaatttcattttcagcatggggatgtgagatgtccttaaacataaatggactccaggtatcttcattaatttcatgaagacatggcacagagggttccggctaccttctgctttccgtgtttattaaaagactgtggattcccttgcagttcttcctgtaagaggttgtttgacgctgacatcatcactctcctccacccgcctcctgcccttttctgaatcagtgaattataggaatctgagaatgagctcctgtttcctgcacattgttggggaacattaaaaaaaagaagacagatgagggatttataagcaagaggacagaagaataatagccaacacaatgaagtctagttcaaggcctgcgattcccaattgctgggctacacagcattaatagcagtgtctctcaccctttcagacccttctctcttatttcagacccttctgccttattcttgtggggatgggctgggactgagaaacagctagtataatcattgccaaaatgaaactcacatgtacatgggggcttccaggtctggagaagagtgtagtaattgttacccatccgatagaaggtgcttagagaccactggacctaagcacttacctggaacctcacagtacagaggttcaaagagtagaaatcagttgactgagtctgaggttcaaatcctggctctaattaatttgctatgagtttagtgaatgcctaactttcctctgagctgcactttctccatctgtgagatgggaggaggagggtggcatagatgatgtcaaaggaaccctctgattttcatgagtctcagatttgcccaaggacctgcagcgaatgtgcagccaagccagatcttgaattcagagcccctttttctggtttgagatggtcatcattataagttccactacccatactttccaaacagtatgtttgcagctttcagccttgttttattaaatctactttttctcttttatttgacagtccctttctgtccagggacctgcctaaagtagcaaatcttttttttttttttttttttttttttgagacggagtctcgctctgtcacccaggctggagtgcagtggcacgatcttggtttactgcagcctccgcctcccaggttcaagcaattctcctgtctcagcctcccaagtagctgggactacaggtgcacacccccacgcccagctaatttttttttttttttttaagtagagatggggtttcaccatgttggtcaggctgctctcaaactcctgacctcaggagtccacccgcctcggcctaccaaagtgctgggattacaggtgtgagccaccgtgcctggcctaaagtagtagttcttaatatacgtgtgtgtatgtgcgtgcacacgtgcatacacatgatcctgtgtttggggcagatgtgaggattatggaattttcagaaactcagatgaatttatgaaatagttggaaaatgcagaactccagaaaatgctatcaacaagtttaggaggtttgtagatgctctgaaggccatccatgagttaagcaaaagttttcattctatgtgggaagtatgagatgacatttgagtggcatacatttccttttgctgttggattttccccgtagtcacctattgttatactctgagtgttaggctcgttttgtagcatgacttttggcatgtatgtatctcaaactattgagtgatattttaatattgaaactcttattctacttcattcattcactcatgcattcaaattcaattttaattcagaatttgctaaatgctagacatctcaatacattattgtatataatcctataaaatagaaaattgctaggtgctcagagaggttgagtaatttgcccaaagttttacagctaataaatataaaatctggatttaaatccggatttactccaaaatatgtgaatacctccagagataacattgaagacaaatagagacaatgatgcaagttcataaaccatggaaatttctggtagaaaatggtagatgggccccagaggaatacagagaatgtgtactatgggattttaggaagggacaagatcatacattatgaattacttcatatcataattcgttaactacgtgtttatctggctccttaagaaagaataaaaaaagctagataatcatatgaaacacattatgcataactcagtttttttcttgttcttcaaacttctgtcaggttagtgctctcaatatcttcatttggtaagtgagatgaggagatgaagagtagttagggtcatagtgccctgatcatactgagttttcacctaaataggaatttcagtgctttgggtcatctattttgttcccctcctcccggcctacccccccattatattgagcttgagacttttaacagagataacttctgaccacgcacagatcagcacaaatgcagatgtgagcagctagaatttggatgctgccaaattgtgatgactgccacatgtgtgaagctaaagcttagcacctgatgacccactgtgagtgtgtgggggggccagaagagtgaaaggcaggtcagagatggaagacgcctcggagtttctcaatggcagtaccttcaccttgcagatgcagaaatggaggtggttagaaggggtaagacttactaaaattcacacagcaggttaatggctctctgagaataatggcaaaacaagaacaaggctttataccagcaatctacagtagtatctacttttatttcctacctttccgttggcatatactcacactgataggcttgacaggcagataaacctgtatttgaaggtcagcaggattagttgtgtggccttggataagttacttgatttacttgggtctcaggtttgttgtctgtaatagaaaccataccctttttcttttctttctttcttttttttttgagatggagttttgctcttattgctcaggctggagtgcaccggcatgaccttggctcactgcaacctctgcctcctgggttcaagcgattctcctgcttcagcctctgtagtagctgggattacaggcatgagccaccacgcccagctaattttttgtatttttagtagagacaaggtttcaccatgttggccaggctggtctcaaactcctgacctcaggtgatccacctgcctcagcctcccaaattgctgggattacaggcatgagccaccgtgcgtggctgaaaccatacccttttaacaggactataccagtgtactgttcaatatacagaaatactatcacccatctgattaataatccttatcacagcccaatgagacaggcacagatgttctgcttttcaagattctatttcctaacttcatcttgacagttgtaagtctcttgcttctcaaagtttggtctgaggaccggaagcatcagcattacatgggagcttgttagaaatgcaaatctcagatcatactctagaacttctgaatgagaatctctactttaacaagagccccaggtagttcatatgctcattagtgtttgagaaacattcacttcggccctcgccctatttcaaggctattgctgtggtgtgctgacaatgcctggcatgctgccagcattcttggggcatgctgtaccatgccttgagatagcggggtccggggggcggggatgctgtgaagtcactccttgggaataatggaagactgggttgaagggatccagcaggctttatctttttaacacccttcatttccttagaagttactattcagaaggggtcaaactgggattggattctaagtctttctgatccaaagtccatgttcttttcattaaaccacgatgtctcagtcaagaggaatgctgggttgtgggtgataactgttcattccctgtagtgtgaatatttccacactggctgctttaccctattactcaattcctagaggggaagaatttttttaaaaaaatttaaaaagcctgagttgaaagccaggatcctgcagcttaatcagttatttttgctttttaatgagggtgactattgtgaaataagtaattattaattactcaaaactaatgaaatattttagtttccttgctcaaaaagcatatggatgctaaaagaaagcatatgggtgctttctgggaagcatattggtgaatggacaaattacagtggtgccaatatgcctttgctgtctggctggggccatcaaaacgtgtgctggcatctgagtcctcgtgtgtttaaagggattttttaaaattcccatttgataagtgcctggggttgcctctggagttacacagcgctgtctcatcaatctttctgccatgctttcactcagacattactggctgagtataaactcggtataaacctttgctgtaagtagcttctgtggctctttctttccagatgcctcctatcctctgcaataggttcagtgggcctgccccatggatggcacgtatggagactttgtctatacaacattttaccacagtggtaaaagcagtagccgaaaaggtggcagcactgagacctgtttgctccatcagggactctgtctgaggccctcggccagctgttgaattgctgcactgcaaatttcttacttgtaaaactggaatgataataccagtgctcctgagctcacaagcatgctgttcatccaatttgcagtccatgccctttgctcttcctctcctttccttcatgcctcttctcctttgctgcacgttcagctggtctagtaaaaagcttgatggatttggaggtggctgaaaccattttgcttgctctggggattgcacacttctgagcttgtcagaggcaggcaacatggcatgttttagaagatacttggctgagtgtccacgaactgtggctctcagaccaacgtgacttagtaatcatttactcaacacctacaagcaaggtagcttgctaagaaattgaaggagggagctggcgggtctgtggaggtgagtttgattcagggccagtcaagacttggtgtgatgtgtgagctcagtaattatactttgagagagacagaatttggagaactctttcctattggaggtttcttatagaactagggacaagagctggctttgaaagattattaattggactttgataagatattacaaggatttgaagagtaagtctctgtcaggcaaaaaccagcttgcagtgggactcggaagcaggcaaatatcaggcatggctgaagaactgggcatcaatcacagacatgtgtagctgagagaaatcacttccttttggtgaaccctagactctatctgcaaaatatgagctttgaacaagatagttctcaggaagcctcaagaactctagctgaaattctacaaagtctcttatcacacagccaggttatccacttagcaaaatcctggcactagaatagcagcaatggagcaaggcctgggacccaggtgtcctgcctctattttatattcttcttactgtccacagagcattatgatgaagataggtggggtggacattattattctagtttttaatgtatgaaacataggatgttaagggaatctaagacataaaacgaataagagatttaactatcccagatattgatcacccttccaccacagagggccagctcttataaaatacaccccttgccattttgcctgtgtgggccttgctttcctgcctgaggaaccagcacgtaccccttctcccacgaaagtcatccctgtctgctctttggctctggaattcagtcttagcaatggactttgttttataattaaactttattttgtattgccatctttccatgtttccacccccatctcatccctcatacatattttaaaggctttgaatttaaggattactttctgcttctctgagttccctgtagctcctggcacagggccccagacatagtgctcagtagagaagcaaatgactatgttctgcaatagtttttctctctgcctattgcttgtttctgagatggatatgagacttataggcttaaagaatttcggaactggaaaggaagttaaaacctatctagtccagctcccccaccccagggaagaaatgacttacttaaatttgcctgcatagttagtggcagttctgcaaatcgtgcccacatctcaccaagcattggagagatggttggcacttgagtctcttcttaggactctacaggctctgtctggagtccttgtttctatgaagaccactaagaataaaggtaatacaggtgctgctgctgctgtattaaacagatggaaagaagtagacattcattgtatgtctgttatgtgacaggccttgtgacaggtgttttcacatagtttagcttggtcagtcatcaaaagctagaattcccattcctccatgagggagacagattgtttctaaataggacatttagcagaagctctttcctgtaagctctgaaaggcactcggtagtggatagatgcttccctcctagaacacgggtgtagggctctgcagagtagcatgcatggctcttctaagggatatggattgtagagactgtgaaaataagcagaagttgtgatcaaaattggcgttgggggacttgtggtcacccgagtgtaccagaagactgagctcttctactctcctttccacacatacatctgagtctttggagagctgcaacctgagtgcctcgttcttgagtgtctgtagcattggcttttacttgcacttactacattttactcctgcctcttccctagctagcctcgacctcaacgtgtattatttcctccccccttgtcatttttcttctattacttttgcttcttccccttcctccttctcctgacttaaccttgggtggccgcaggtcttaaggctctgtgatggcagagtcttctgtattggactgtgaagattctggcagggaagacaatacacaaatctgttaaatacacaataaaaatagcttatgatctatgggacttggtattaagcaagatgatattaacgaggtttgattgctgttctgaaatgtggcagctgcgcacacgtattggctgctttttctccccacctttggcagcttgtgagcggtgttgccatgacactccttgggctctgtttagatcagctattttctgaaggagtcgctgaccttccccacaatagaagctgttgatgtggtcacgtcagtgcctcttcgggagctgtgtgactggcgagccctcagttgccacttggaaacggttggaaactgtagatcaggcacagacattgaatgtttaggagcaagaagggcttgtgaatatcccgtactctcatttgatgtgtgaggacagtgaggcgcattatgcggaggtgacttgctcaaggccacagagtgcatagagagaaggctgggagaggaggtcaggtcttgtttccctgcttgttgatgttccagctgcatgcacggcactgagccctgcctgagtgcgcacttcagtcctgaaagctgcagagggatgggctggtgacactgccgtgcctaggagtgggcagagaaggtgaagacacggagagtaactcagtgcagaggcagcgacgggaaagtgaaggagagtaagaagcccagagtaaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttcattgtcagtaccatgctttttttggagtactgtataatgtcaagtatttttccaatagtttatatgtgaaatgtggtctccgccacaagattacagggtcctcgggagcagaaattgtgacttaaatgggcctttctcccttccactttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacactgtctattattatccttattttacaatgaagaaaaaaaattcaattgactgctcaaatttacctctaggaacaggtgatggagatttgatttgcatttagatcttttgtctccaaatattgtaatgttacttctgctttcccccactacataccgaagaggtcttacttcattgacagtggttcagccttctgctgaggagtcttcagtctttttatgttgtaatctgcctccttatgagtttgggaaaagaattatggggcctcaggtttaaatgctgttatgctttgggtaacactttagctgatttgttttcagtaaagccagaaggaaaatactgcatttctgtcttctttaatttccttaatttgaaataagccttgaactagtttgtaagactcctttaacttttaacaaatttaggcacatatgtaatataaagaaaaaggcactctgccctaaatgaattgactaattaagctgagaacaaaactagaccacttttttttttttggtttcaaaaaaaggatgcaggaatttttaaatgctacagctaaaacccagattttgtctgatattgatgttctgtaggttttctcaatatttgccatattcattagatgacattcattatactttcctaacttttataggatttagatgaggtttgttgataacattctatattctttctgaaaagaaaaacacacacacacaaatgtcgagcagtcttctttttttaatgtatattctcaggaaaaacaccattgactaatttaaatttcagtacggaggcaaagctgatctgtagtgaatgtaacatcttgttaaatacaggtttcatgcttcttttttgtacctttccaggcttttaaggaggagaataatttgaataataatggcataatgtccagagggaaagttgaatacgtaagacagagatgcatgtgggcctatttctgtactttgtgtgcgtgtctctgtgtggtggctttatggtttttaaaataaagttttctgtattttcaatgtatataataactttggaatcaccaaagaaaagttgatattgagacttgggtttttagtggggaggaatggatgttttttttcttttacagttttaggcaaagtgaaactttagaaaattatattatttgaagttagatggaaaccaaacactatctttatagtttctttcagaagaaactttgtcttaggaatctgggcactcttgtaaactttctaaatttcttcagccctcattgatacccacactttgcttaattcagttgaatcagtttacagtgaataacgtccctgggaacattaatcaatgaacacacacacgcgcgtgcgcgcacacacacacacagacacacacacacagggaggacaaaaaggaaataaaagcatcactttgtaccttcctcaattcaaacctgtctgctttcttcagaatttcggatgtatgtgtctgtttcttccagtagattgggagcaccctgaagacagaagagacatatgtatatatatatatttttgtttgttttttcttttttgtttttagacagagtctcgctctgtcactaggctagagtgcagtggcgtgatctcagctcactgcaatctccacctcctgggttcaagcgattctcctgcctcagcctcccgagtagctgggactacaggcgcccgccaccacacctggctaatttttgtatttttagtagagacagggtttcaccatattggccatgctggtctcgaactcctgaccttgtgttctacccgcctcggcctcccaaagtgctgggattacaggcgtgagccaccgcgcctggctagaaagaagagacattttatgtatgatcgtcataatgattttgtgaactcaggtgtagtaaggtaaaacgccctggtaaaatcacttactgggacttttcagaatctgtttagaagtcattccattactcttgaaatccctctgctttatagactttctgagaaataaggaaagtccatctgcctacttgtcatagaaatgggtacttcagcagtaaaatagcctgtttacatactggctcaaactgtcaatgtaggaaaaggtttcgtgtattataaaatgttacagagctagaaaaaatatatacaagtaatatatagagtgcatatatatgtacatatatatgatctgttccttgtcacaatatttaacccaaagtgctatttacagtaatgaatcaaaatgtcagtcttaaaaatatgaagtgtcaaagtgttcccacgttgtagaaaagtttgatgtgacagtttgttaatcatatgactattctatcaatgtgtctcataatgtcttttgctcaacactctcgtaggctcctcacacttttttcatgaattcctagcttaagttactaacccaaggagcacatttgagttgcgtgtctcccacacctcacacaaaggcggctatgttttgctgtacttaaaactgaatggatttcacattattttagagtggtttgattttgtgcctgacgcatttatggatagtagcttaaaaaatttctgtaattttgctgttttcactacagaatcatcaaatgaaactttaacttatagcgcggatgttttttgtttctccaaagtttcccaagatatcagatgtccttatttgctagtgcccattcgttgaacttggacacatttttgaatttttctcagcacattgatgatcccaacttctttttcctactaaaagggcagagtcttagaacataaatattatatatgtggaaaagggcaacatagtttctttcgggaggatttttggccatgctactcactagttcgtggatcacacttaatctctgtgcctccgtgtcttctggagaaaatttaagggtgaaattagattagatcagtgaatttttaaacttatgctctagaagccctaggattctgggtagaaatgaagctccaatgattgagtgtggggtgggcagtggggactctgggcccttcaaaccaagcagctctgctattcgcttgttaaaatttagagttttataaactgtttcacttaaagaaaggttctactgcttaacctgcctacctgttggcatcactgtcttaagtgatctagagtcagtggcttatttcccacaaggattcagtgggcaactgtggcaatagttcttggctaacctggtcactatggaagttctttccgtggaaaaagattctccatccttcaatttgagataagatttactaattgagacctcatttgtttctgattttaatctttgcatcattttagttttaataaactaactttccaacttaccagattttcgggttgacaaagaccattatttagagaaacacaggcaaaggaaagtctaaaagctttggctggaatttcaactgcttctggtcaagaatatgaattttactttgtacggccaaagcgtttcaaccattctggggaggtgggtgaatgcccacaacttgaacttttcattccattgctttccatcctcaagtctctcccttcttctccatacacatgcaactaccaccaccaccatggttctcttcgcatggcctatgtatgtccccagacatggtggagcagaaaagtaaaaagttgtgatttacaaaccaaggtagagactataagaagaacaaaaatgattaaggggcatgagttagtgacactaacaaaaagccttcatgtatcaacataaaaaaatcaaattgaagaaaatatttttcatggacagaaaacctaccctaaagacaggaaagaaggtgaacggctatttcactagatgctgaaacatcatctccaaagttcctcaggaatcaaactatgggattagattcaactcttttaatagctgaaatctagaagggagagagtggttacgtctatagttttatgaatgatgctgaactctttctcacaataaaatgctcttctactaacaaatttaaagacttgagcacccagaaacagcagttgcatgccaagtcaggaatattctttttttaagtcacatgtcagccactggggatgcacccgggtttaggctggaggttggagagggttcatccaaaatccatgcacaagatatttatccaaaattctggagtggttccttgttcattctctgaagaaattggtgagataaggcaagcatcctaaacaaatgttgagctctaaaaatacagtttaaataaaacagaaagcattctgagtatagttttggccaaaatagaatagtataataaatcatttggctggagggtatgacatgagaataaacaaaaaaacagcatgtttgctatcttttctgtttattttacttatgcatcaacccccttctgcctccttttactccttgctagagtgtggaaggatcttgaattcagggccttgtctgtcttgtttttcagctggctggagtcacacttggcttatttatgagctcaataaacattatgaatggatgagcaattttgaaagattgacatattgaaggaaaaaaatgacgtgaatctgaaaaattctgacatggccacttctaaactctctgggacttgtactaaatgcttatagatttaggtagcattctgagcattacctcacttattcctttcaaccagcctctgaggaaggtactgttattatcaccatttcacagaggaagaattgagatccagagatgttacataatttgcccaaggttacataataataatataatagctaaagccaggatatgaactcaggtagtctggcttcagcagcttctctcttaactacgaagctatattgtttccacatggtgattataattataactgcctgttctactttcctgtacgttgtgaggctgagtttaggtgtgaaaggattagggaagaagtatatcaactagtgaaggcgagacaacacacaaacaactataacttaaagtagatagaaacttgcagagaaagttcagagaagaaaaaagaactattatttccaccagggtgaagggcaggagtcaaagaaggcttcctgtgggaagtgacttagtttggccttgaatgagtagaattatagtaaagggagatgctttccaagtaaacagaataaacagtggaagagatgccagtctaatgctgttgagtttagcagattctttccgaaagagtgtgcgctgagaagtggggagtggagagggtttgtggtggaaggaggtggaagccctgagaagggatctgagtgggaagatgcaagcgttccaaaagcatattcgcaatctctctggaggtcaatcctgggcaaaatgttgcttttgtcatgctttaactcattattttttgatgcattgtccgcaaagactagtccaaggaggtaccactccagaaagagtggccacacgagtctggaaaatgctgcaccctctggtgctctattaggtgctgacagtgcgtgttaacatgcccagtcttcgaggaagtcccgtgagacagcaatcaccttgctttctttgactgtagacctggtttgttgttttactttgagcaaacccctgttaacatccctcagaagacacacttcaggagccctcttccagccaaccagctggactaatttgtgtaaactttccaacaagttgtgtgcttctgctgaacacaggtcatctcagagtaaaacttgctccattctcaggacagccaacagtccccttttgaaagaagttagagcacgtttgcctatagaaattgttatgtgtcagttagaaagcaagctgcatccgaggtaacaaacttgaggagctgcagcccctctgacgaagtaaaagtgagaagcaggaagtgaaggagtctcagctcttgaaataaaatgtgcatacgggtgagagttgccaaccacaagaactctagctggctgccctgagaacatattaggagaaaacatggttaaagtcggcacctgacctattagctgcaggggcagctcattatcttttttattctttcaccctgcattggcccgaaaggggaagagaggcagtaagtggactgtaaagagtgcttattccacgctgggcaggtcattagaattgtcatgtcaaattcccttccttaatcccctcaactacccagtggagtcaggattattaatctcttcctctatacgtgaggacagtgaatccagagtggcttgctggtgctgaatagatcatgttgtcttacaacttgagcttttcccttgttcctttccctatttgtctgctgaactcatctgtctccaggttgtaaatgagattctcctctgaagagcctctgagccccctgtaactctattcttgtattgcatgacgatactcttgttctttaggtttatacctctttctccccttaagacctaaaactcgatctgggttactctagagcccacaggtttatattgcactgctctgcccacattccagccttctccactttaacatatgacttgatgatagcttttcagacccagtccctcacaagatacctctttttcaacccattattttagaccttctttacttgacatattttgagttttctggattctaggcttccttatcgttagtgtcactttccccccttctgttacatgtctgttaccttcttgctatttgcttaggtcctaccttaactttgaaggaacgcttttcaaacccggcctgcatcggaattaggaatcccaccctcagaagttatggtttagtaaacctgagagagtgtgggagaatttgtattgcactcccagatgatcctgaaactgtcattctgtgggcttatgtttattagcacttctttaaagcatagttcaagacctctgttttccaggatatttaactatcttagtccaaagtctttcctttcttccttgcctccttctctctctcctctttgtcttttcttcttctcttcctcccttctttctcccaccctcctctctctttcttctcatgaagtccatatgatatcctgtctgaattacataactttttttttctttttgtggagatggggtctcactatgctgcccaggctggtcttgaattcctaggctcaagcgatcctcccattgaagccttccaaagtgctgggattacagtcatgagccaccacatctggcctgaattagacaacttcttatttatgtggatctcagaagctccatcatccacttcttaagcctggtaaacacttttattagataagagagacagttttgcataaatgaacaaaaatctagatgaaaagttctcgaatcctgaatcacatcttgccataacctcttactagccgtgtgttcttggacatcttatggactggagtttccttgtctctaaaataattattccatttccttgtactgcagaagctcatgaaaaaggtcaaatgagatagcgggtgtataaagtgctacacaaatgcaatgatgctaatagtaaattattgttgatgttttctttgtttctgtacagttgactcatttgctttatcattaatgatgaggcatgaaagaaatgctgcttgtttttaatgaactatggaagactaggtggagctgacgggatgttgggatttcaggaaagctcttttaggtttctggaaatgatactcataccaatagttgtgagcttaggttgaagagcaatgttgtatttatactataatttttcttcaaataaactgtgataaagattttgaatattactttcatattctgaacttctcatgtacacttgaaaagagtcatgaaatagtagtagcggttgccatttataggggtcgtagggtgttgttatggttaaatttataaatccttaaaattatgatttctatcacaaaaatgcctaaaagggtgcattctctaggttttttccttctttcattcccttccttccctcccctccctccctccttcccctccctcccttccttccttccctctcctttcctttcttctcctttccttttccttttccctctcctctcctctcctctcctctcctctcctcccctctcctctcctctcctctcctctcctttcatttttcctttcctttctctcgctctgttgctcaggctacagtgcagtggcacaatctcggctcactgcaacctccacctcccgggtccaagcgattctcatgcctcagcctcccaagtagctgggattacaggcgccctgccaccacaccaggataatttttgtatttttagtagagatggggttttgccatgttggccaggctggtctcgaactcctgacctcaaatgatttgcccattttggcttcccaaagtgttgggattacgggcgtgagccactgtgcctagcccctctaggttttcttaagaaaacctatctattcctcaagtgcttactctgcaaagcctaggtctgccaccaaggaataaaaatatggctaaatgtacttcctttcctcccagagttcactgttcaataggggacacaaacacataaataactagctcttgcaccaagcgaaatgtacagtgcgacaaaggagaggtacagatagtaggctgtgggcccgaaggagggtttccgtgggcgtgagtatgaaggaggggtttcctgaaggagggggtatttgaacaacccttttgaagactaaaaggatgtccgcaaatgaaatttagggtagaaacatgccagaaaaaggcacagtgttttcaatacgctaggcatttcttaaactatttatagctgaggttatgggaaaagagatagtagaaatatgagaatatcttctccaaagattctatgctaatatcctgatccatctgactatgcttatttgactgctttttgtgtttgtcttcttctttactggatatcctttttgccgcttcctttctggaattttctttcctggccattagcctctctctcctacaccgttgccttactctcactgccatactcctttggacatcctccttctcttgtttcctgatacttttacatccccttccatcctttactccttagcttttgtttttatttgcagtgttaaagatagcctctttttatttccctgtagtgattagatcgacgtgtttacaatatgaacacacacgttttctcttcttcaggctctgagtcatcgagttcacaatgccatgtctagtcagtacttctatgtgtgtatagtgcccattgtggccgagtagagataaggtcactgcggaagaaaataaatcgctaaaatctgttagaatacgtcagcttccaggtttgtctgaggatgcagtggaaaccacgttctgtggccagcatgtcagtagcttttgatgatcagagccttccattttgatactttaaaataatgtaatctaagttcacatcaactgaatccagacagtttcaccatccaccacattattaattccagatgggaaaattcattagggctcaaattttgtttgagacccaactgttttttaaattattattacaattattatctatttattttatttattttttttttttacaactgatgggaagggaaatttaacagctgtgtgattagcagggcatgaaattaaaaacgttttgcacagaatcaagaggttgtttactacagaatttgtcatctgagaattaagtgtcattaagactgcccacaggatgatctctttcaccattcaagctttgatttccacgcccggttttttgctaaaaggcctttaaccttttctggaaggaaaatgcatgtggatttatcacgaaggtaccatcagcatttcaaatgctaagtcaaggtaaaaacgacactcttgtctgtcacaaaataacagtacaactagatgttcagcctcactgctctcagcaaagagtgagttccaatttgaggaaatcaggtaaattagaaaaggctgcagctggattagtggcttcactctttccctctaaaactgtaggagtttcatatttccatcaaggcagctcaggtccctagagcatgatgtttacccttacattttcctaggtgtatgggctctttacgtctttggtctctttgcaaacgccctccttcgactgagctctagaaagtactctgtcctgggctgagcgcagtggctcaagcctgtaatcccagcactttgggaggccaaggcgggcagatcacgaggtcaggagttcaagaccagcctggccaacatggtgaaaccccgtctctactaaaaatacaaaaattagccaggcatgatggcgggctcctgtaatcccaactactagggaggctgaggcagaagaatcccttgatcctgggaggtagaggttgcagtgagttgagatggtgccactgcactccagcctggacgaaagagtgaaaactccctcccaaaaaaaaaaaaaaaaaaaaaaatactatgtacttgttcctttgggcaagatgttggcagttttctgcagaagcgtggtcaagcacattagctggactgtcttggtcgaggtttgaaggcaatgccatttgcttgggcaagttacatggactctctgcagttcatttgcctcatcatcctccaacttaatgaaggtaatgacagtatctacctcaaggattactttggggattcagagttattaccaaaaatgtttaaggccctgcccgactcattgtttatgctcagttaatgttagctatctccatgcttttcagtcaatatattgcattgtgtttggaagtcttcatatctagtttcatacctgacacagacttgcttaacttctgccctggaatctttttgctatccctgtcttactgtctttaatagagcctttcttatttgatacttatttatatacttgccttcgttcgttttttagacaaattttattttcatatttgttgaattaaaccagacacagcttctacacttatggggtttcctttctgggagaatggggctggtgacaattaatgcagaaaacttctattggagatagacatgcaaaaacactcagagatagagttgaggaatttgtagtcattagaggagagagatgttagttttggctgggattggagttaaatggagagaaaataaaggaagactttctggaggaggagggttttgatctggaacctgcacgctcattagaatttgaattcgacctggcagaaaggggaaaagacttcccaggctgagtgaagttttggagctgcacattttattttatttttcatatttgtttcctgctgccctctggccaccattcagaccgtttggaggcctgttattgtaggtgggacctaagttccagcaccagtagatgtgtgagtgaggcttttatagtattgatgtcttgtatttaaaatgaacagaggaagaagccctggagtccattctaataaatgtatttcaaagggggctttcttcttttgtctgagtgagaggcaggaataggaatgacagaggcagcaagtgttggatgtctgtagaagaatcatagagttctctttagagcactaaacagagggctaataaagggctattgagtcctccttatgtttttttcctctctcagatgagttttaagggtaatagaagcgcttttttttttttttctggtgacctcttaatcttacttttctctctttatctcttccttttcctagaagctaatattaaaaccactcttgtcctctgccattaaaaataaatctgggtaggtttcagcaagagagtatttcctagaatgcattatattctgggcagtagaagtgtatgtttaaatacttttcctgtagaaggtcattatgacaacagaggatgccaccagcaaccctgcagtatgtggtgaatgtgtttccacgctgtgtctgtctcgcctctgctctctgccatgtcaagctgattttaagtttaccgtcacttttagtatgtgacttgatgaggcaccataatgtgtgtgttgctggccaaacattacatgtcatgactgtagaatcatgagactggagttttagcctagaccttagaacacgtacctgcaagaggtagttattcgagcagcagtctttgtgagactggaattcaggcacagggaacacttgttcctaagttgctgccccgttgctcaaaacatcttggtaatgtctttctttctttcttttcttcttctttttttttttttttactctgttgaatgttatcttttattttgtttttattaaaaaatcaatttccagctttatcaggatataattgacgaaacaaaagttatgtatagttaaggtatacaacatattttgaggtacattgcattgtgaaatgattaccctagtcaagctaattaacataggcatcacctcacagttacctttctgtgtatgtggtgagaacgtttaagatttactctattagcaaatttcaagtgtacaatacagtattaactacagccaccgcactgtgtattaaatctccagaattattcatttggtatcactggatctccctttgaccaagaaccaagatctcctcattcccctggtcccggtagccatcattttgctctgcttctatgtgtttgacttttttaatttgcacatatcagtgaggtcacgcagtgtttgtttttctgtgcctggcttagttccttaagcaacatttcctccagattcatccatcttctcgtaaatgacaggatttccttctttgttaaggctgaataacattccacgtggtaatacaccgcattttctttattcactcttcaaatgatggacatttagatcgattccacatcctggctattgtgaataacgcagcagtgaacatgggagtgcaggtgtctccttgagacactgattttgccttagaggggattctggggctgggctccgtggtgaagggcactctctttccctcacctggaggttatgtcagcggtgtgctgggggttgtacaggtcatgttaagctgtccttcctgccttcctcaatgcgtcatttcttatttctatgttccacccaggtgctgcactctcgcctgaattccttaacgtgtgtgaggtattttggtgtgtggctagttgtttagaagtttctgagagggaatgagtgctggaaactctattttgtcatttgccaatgtaaccccacattggaattgtcttcagagataatgaagagccactgctaaaatcacagactcatgagatgtgaaagcggggaatctgtttagctcacatgcgtgtgagaaagctgagaccctgagacaaatattggcctgtgctgcaggctttcagttagacagggacagcatcagttctcattcccttgttagctctatgcctgatgtcttctcactgttttgctgcattataaagaattgattttttttttttttgagacagagtctcgctctgtcgcccaggctggagtgcagtggtgcgatctcgcctcactgcaagctccgcctcctgggttcaagtcattctcctgcctcagcctcccgaataggtgggactacaggcacccgccaccatgcccggctaattttttgtatttttagtagagacggggtttcaccatgttagccaggatggtctcgatctcctgacctcatgatccacccaccttggcctcccaaagtgctgggattacaggcgtgagccactgcacctggccagaaagttgattcttagttaagcctatgaatagttagaaaaaaaaaagagaagagagaaagttccccttagcatggcctattatcacagggtatgtttgtagcagagggagaacccagtccttatagagtgggttatggcttcttctacattccaagaaaatctcaagaagtagaaatcactctgagtgtcaaatattttagttgcctattgtcacatctattataaaatagatctggtatagataaaaatagagttaaacatactagttaatagatatatctggtgtggataaaaatagaatttagcatactagttaatatataaatatgatgtcgataaaaatagagttaaatgtacaagttcctaattggattgtagaacttaacattcaggagtaaggatgctgtcaagtctaaagctatgcccttatcctagtcagttgttatattcatggcagccttttctaaaatgtgctccatgaaatactagattcataaatggtcaaatcactgtgggactcttgctattatttccacccattgtggagattcttgatgcatccccaacaagtttaactctgagaagtcgaacaggcaaaagcaataagcacaactttcttttctcttatgttagattcaggttttgtccaatttattttataatggaaccattttgtggatgatttcccagacttgtgttctgtggaacattctttggatagcatgactttattgttaaaattcttaaggttcacatctgtcatcttataataatcttgtgtgaaatataaagtcatttgggctaaactgtagacctccatctgccctcccttccccacaggagaaattacaggtttatttaaggatcaaacagttttgaaatgaaatgttgttaggagggggaaataaaaacctttcagagcttaataattgtagaaagaagacagtgttataccggccaaaccaattttgtgaattagcactttaactcagagagttgttcctgaaaatagcttgtttttaagcaaaactttgttggcttctggtggtacactttttcaccatcaaaggcacaaatatgggtgattttaaactgtggcatactttttttgcattcaaaaccagggcttgtggaagaaacaacacccttttttaacttttcagaaacagttggcttgaccatcatggctttttttttttcccctatgtctttaggatattagcttttcgttaagctggaagggtcctcagagatcttgtccaagcccacccttgacagatgaagaaatagagggccagaaggctttagtaatctttccaagtctttttattagttactgacaaaatcagaactaaagtcaaggtctcttacttacctgtcatttacctgttcaatgcctcttttgtttgtacactctgttaaaaagaaagaggttaactgtttcttttggttataactgttatactacaaacacacacacactctcacacacacacacacacacacacacacacacacacacagagagagagagagagagagagagagagaacagatgaaagccatgattaggaacattttatgctcaaggtgagaagaccctctataggacctcgaatgtcttcttttctaaagaacttcatctacctcgggtcagtcctttgatactattcactttgaaaactggtttacctgaaaggaagaggtgtgtgtgaaagagagggtcacccgccacattttatctctctgtcttatttcaggcagacagattcactacatcaagatggtgtttacagttatcgccatgagatgaactagctcatctccaagtgcttaagggatattgcctggttataaatcatcatgtgattctctctcctcccacccccatttacagcttctttcttctttctccactgcccatgtctaaacctggggaactatctcactgcatagacagaaaaggaaggtcagatccaaggtagatctttctttctgctaggtttaacctagtgatagcaacaaaaacagttcttatgcctctgagtttcttgttttaggcagaagcatttgataggttggggatcacaggaaagtttttttttttttaaattctccattaagaagatgctaatgtacttgtgaaggcaagtacattaagcttagtaatggaagatatgggttctaagctgcacctctctgccaactagtagtgagatcctggggaaatcaaacaatcgtttggaaccacatgtggcctagtcttttcattatgacttcaggagtcataattcttgtcttgtcaacctcctggggttgttgtgaggattaagtgagataatagatatgaaaaggcttgtaaactacaaagcatctcatacatatgtgtaaggcattgttattatcaataataatagcaaccacacactgctgcctttgagctaggtactgttttaagtgctttccgtcgataagctcacttaattctgacagcaactctagtgtaccaatgaccagtgctgggcgctgtgaatcagcaggactggcagctcaccctgattagctggtgatttcctgtgttcttgggcatgtcctttcccttccctaggcctgaattttactctttgtaaaagaatcacagactcaggttggatggaaggattcttctgttctgtcatttgtgattttgtcaggcagtcattggccccacaggctaagtcactgattatttctatttatttatttatctgagacagagtctctctctgttgcccaggctggagtgcagtggcaggatctcggctcactgcaacctccaccttccggattcaagcagttctctgcctcagcctcccgagtagctgggattacaggtgcctaccaccacacccagctaatttttgtatttttagtagagacggggttttaccgtcttggtatgactggtcttgaactcctgacctcttgattcacctgcctcggcctcccaaagtgttgggattacaggcgtgagtcaccacacctggccagtcactaattattaatcacagcccacatttaactgagtacagtcattagtttcattctacagctatacagagagctcatgtaaattcctgaaggctgcaccgcctacaagtggtggggctggagttcgcacgttgctcttgtgccctggagtgatggcagcaagatagatgtgggtaactctctagcaatcccaggtgtgttatgttgtcagcatcctcatctaatcaacatgatgattatcattgagccttttaggttttcagttgttgttatcatttaactcctcaattagattccgagcatctcgatggtaggttttctgtactgcaatgtgtattgccagtgttttatgcaagatatgatgcaggctagtgtctcacagtttacgcaatttgttttccgtccatcctttcgatcctttgagcctctcaaggaagcctgggttggcatctgcccaactgtgttgggcagaatggtttttttctcgttgcccgacatggggctgggaaagccatttgaggaggtcgctgtggcatgaatctggacaagtctttctataggggaaacctgtttcaagctgtggctctttcactttctacatggcatatggaccctgatttttctcacgcctgcgtaactctactggtgtctcttggctgtcgcagctttgttttgctttgccattgttttattttattttttctgaagacttggttttcttgggctctgcttatatacaacacaaaatttgtagaccatttgcttatgggaaagagtcacacccacggaaattgggagaaaattaactcttggagcccaaagaaactgacataaatcttataccacgaacatcttcaatttccgactttgccttccttctctgtatggtgctgtaccaagatctcttattgggaccaggtttcatggagggttactggtaactattaacccactcaatgtacttattttaccattaacctatcatgaatagcctgtccaatccccattaaatgacccactatgggggtcattaattcatttatttatatatgaattatctacattcatttatatatgaattattagatattatctacactgaaccaggcaaaattggggataccaaaatgaattagacacagttcctgctttcaaaaacctcatactctgaagaggggagatttgttaattctgtcaagtcatctttgatgcctaccatgaccaggtatcagacatgccactggaactgtggacatctggcaggtacaagcctattcatcacagggtttcaggtctagggaagaaaaacatcatattaataattttacaaataattatgtagttatagttgtgataggtgccacagaggaaagactgagtggtgggaaaatatatatatatatatatatatatattttttttttttttttttttttttttttttgagatggagacttgctcttgtcgcccaggctggagtgcagtggcgcgatctcaactcaccacaacctctgcttcctgggttcaaacgattctcctgcctcagcctcccaagcagctgggattgcaggtgtgcaccacgacacctggctaattatttttgtatatttagtagagacggggtttcgccatgttggccaggctggtcttgaactcctgacctcaagtgatccgcccgtcttggcttcccaaactgctgggattacagacgtgagccactatgccaggccagttgtgggaattttataagggctttttcttttctttttttttttctccctctggcctagtttgtggggagaggtatgtttccccaaagatgtggagttagcctgttgatgtaggcatgggagagtgagcttagacagagatgcctctcatataaggtagaaagccttccatgcccaacccaagtgttgtagaagttgaaaggggaaaaaactttttcaaaattggcttgacagcaaaactcctctcagtgtcttcttttttgtccccctctataaatggtaggttttcgtagtatcatgaccctttttagtaattataaattaatataagataaatttatggtattccttactatatagatttgttaaaataattcacgatatttcatatgtacacacaagctccttcaatccaattagtaagaaaaacacttcatgtcactgttaaataacatgaaaataaacaactggttaaaaaacaaaacccaaatacaaagcgttgagcttcctactggaatctgaatctgggagtgtcttgttgtaagaaatgttttcagacctatcattttcttttgtttctttttctttttttctaaacagactcttgtcagttctcttctgattagtgttcccctgggcttttcttcccaaaataaagttaagtgcattcaagtttctgggatcttctttacatccttttgaaaatgcagagtaaatattatgttggcttctttttgttttttttttttaaattttattattattatactttaagttttagggtacatgtgtacaacgtgcaggtttgttacatatgtatacatgtgctatgttagtgtgctgcacccattaactcgtcatttagcattaggtgtatctcctaatgctatccctcccacctcccctaaccccacaacaggccccggtgtgtgatgttccccttcctgtgtccatgtgttctcattgttcaattcccacctatgagtgagaacatgcggtgtttggttttttgtccttgagatagtttgctgagaatgatggtttccagcttcatccatgtccctacaaaggacatgaactcatcatttttatggctgcatagtattccatggtgtatatgtgtcacattttcttaatccagtctattgttgttggacatttgggttggttcgaagtctttgctattgtgaatagtgccgctataaacatacgtgtgcatgtgtctttatagcagcatgatttataatcctttgggtataaacccagtaatgggatggctgggtcaaatggtatttctagttctagatccctgaggaatcgccacactgacttccacaatggttgaactagttcacagtcccaccaaaagtgtaaaagtgttcctatttctccacatcttctccagcacctgttgtttcctgactttttaatgatcaccattctaactggtgtgagatggtatctcattgtggttttgatttgcatttctctgatggccagtgatgatgagccttttttcatgtgttttttggctgcataaatgtcttcttttgagaagtgtctgttcatgtccttctcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttatttagatcccatttgtcaattatggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccaatttcagctttctatatatggctggccagtttccccagcaccatttattaaatagggaatcctttccccattatttgtttttgtcaggtttgtcaaagatcagatagttgtagatatgcggcattatttctgagggctctgttctgttccattggcctatatctctgttttggtacccgtaccatgctgctttggttactgtaaccttgtagtatagtttgaagtcaggtagcgtgatgcctctggctttgttcttttggcttaggattgacttggcgatgcaggctgttttttggttccagatgaactttaaagtagttttttccaattctgtgaagaaagtcattggtagcttgatggggatggcattgaatctataaattacctttggcagtatggccattttcatgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaacgggagttcactcatgatttggctctctgtttgtctgttattggtgtataagaatgcttgtgatttttgtacaatgattttgtatcctgagactgctgaagttgcttatcagcttgaggagattttgggctgagatgatggggttttctagatatacaatcatgtcgtctgcaaacagggccaatttgacttccttttttcctaatttaataccctttatttccttctcctgcctgattgccctggccagaacttccaacactacgttgaataggagtggggagagagggcatccctgtcttgtgcccattttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatgttgaaccagccttgcatcccagggatgaaacccacttgatcatggtggataagcttcttgacgtgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctctatttctgttgattgcaatagtttcagaaggaatggtaccagctcctctttgcacctctggtagaattcggctgtgaatccatctggtcctgaactttttttggtcagtaagctattgattattgcctcaatttcagagcctgttattggtctgttcagagattcagcttcttccttgtttaggcttgggaggatgtatgtgtcgaggaatttatccatttattctagattttctagtttattttagaagaggtgtttgtagtactctctgatggtagtttgtatttctgtgggattggtggtgatatcccctttatcattttttattgcgtctatttgattcttctcttttcttctttattagtcttgctagtggtctatcggttttgtttatcttttaaaaaaaccagctcctggattcattaattttttgaagggtttttttgtgtctctatttccttcattctgctctgatcttagttatttcttgccttctgctagcttttgaatgtgtttgctcttgcttttctagttcttttaattgtgatgttagggtgtcaattttagatctttcctgcttctcttgtgggcatttagtgctataaatttccctctacacactgctttgaatgtgtcccagagattctggtatgttgtgtctttgttctcgttggtttcaaagaacatctttatttctgccttcatttcattatttacccagtagtcattcaggagcaggttgttcagttttcacgtagttgagctgttttgagtgagtttcttaatcctgaattctagtttgattgcactgtggtctgagagacagtttgttataatttctgttcttttacatttgctgaggagtgctttacttccaactatgtggtcaatgttggagtaggtgtggtgtggtgctgaaaaaaatgtgtattctgtcgatttggggtggagagttctgtagatgtctattaggtctgcttggtgcagagctgagttcaattcctgggtatccttgttaactttctgtcttgttgatctgtctaatgttgacagtggggtgttaaagtctcccattattattgtgtgggagtctaagtctctttgtaggtcactaaggacttgctttatgaatctgggtgctcctatattgggtgcatatatatttaggatagttagctcttcttgttgaattgatccctttacaattatgtaatggccttctttgtctcttttgatcgttgttggtttaaagtctgttttatcagagactaggattgcaacccctgcctttttttgttttccatttgcttgatagatcttcctccatgcctttattttgagcctatgtgtgtctctgcacgtgagatgggtttcctgaatacagcacactgatgggtcttgactctttatccaatttgccagtctgtgtcttttagttggagcatttagtccatttacatttaagtttaatattgttatgtgtgaattcgatcctgtcattatgatgttagctggttattttgctcgctagttgatgcagtttcttcctagccttgatggtctttacaatttggcatgtttttgcagtggctggtactggttgttcctttccaggtttagtgctttcttcaggagctcttgtaaggcaggcctggtagtgacaaaatctctcagcatttgcttgtctgtaaagtattttatttctccttcacttatgaagcttagtttggctggatatgaaattctgggttgaaaattcttttctttaagaatgttgaatattggtccccgctctcttctggcttgtagagtttctgccgagagatctgctgttagtctgatgtgcttccctttgtgggtaacctgacctttctctctggctgcccttaacattttttccttcatttcaactttggtgaatctgacaaatatatgtcttggagttgctcttctcgaggagtatctttgtggcattctctgtatttcctgaatttgaatgttggcctgccttgctagattggggaagttcttctggataatatcctgccgagtgttttccaacttggtttcattctccccgtcactttcaggtacaccaatcagacgtagatttggtcctttcacatagtcccatatttcttggaggctttgttcatttctttttattcctttttctctgaacttctcttctcacttcatttcattcattttgtcgtccatcacttataccctttcttccagttgatcgcatcggctactgaggcttctgcattcgtcacgtagctcttgtgccttggttttcagctccatcaggtcctttaaggacttctctgcattggttattctagttatccattcgtctaattttttttcaaagcttttaacttctttgccattggtttgaatttcctcctgtagcttggagtagtttgatcatctgaagccttcttctctcaacttgtcaaagtcattctccgtccagctttattccattgctggtgaggagctgtgttcctttggaggaggagtggcgctctgatttttagagtttccagtttttctgctctgtttttttcccatctttgtggttttatgtacctttggtctttgatgatggtgacatacaggtgggtttttggtgtggatgtcctgtctgtttgttagttttccttctaacagacaggaccctcagctgcaggtctgttggagtttgctagaggtacactccagtccctgtttgtctaagtatcagcagcggtggctgcagaacagcggatattggtgaaccgcaaatgctgctgcccgatcattcctctggaagttttgtctcagaggagtacccggccgtgtgaggtgtccgtctgcccctactggggggtgcctcccagttaggctacttgcgggtcagggacccacttgaggaggcagtctgcccattctcagatctcaagctgcatgctgggagaacctctactctcttcaaagctgtcagagagggacatgtaagtctgcagaggttactgctgtctttttgtttgtctgtgccctgcccccagaggtggagcctacagaggcaggcaggcctccttgagctgtggtgggctccaccgagttcaagcttcctggccgctttgtttacctaatcaaacaactaactgggcaatggcaggcgcccctcccccagcctcactgccgccttgttgtttgatctcggaccgctgtgctagcaatgagtgagactccatgggcttaggaccctccgagccaggtgggggatataatctcctgatgtgccatttttaaagcccattggaaaagctcagtattagggtgggagtgacctgattttccaggtgccgtctgtcatccctttctttgactaggaaagggaattccctgaccccttgcaattcctgggtgaggtgatgcctcaccctgcttcggctcgtgcacggtgcactgcacccactctgctgcacctactctctggcactccccagtgagatgaacccggtacctcagttggaaatgcagaaatcacccatcttctgcgtcgctccctctgggagctgtagactggaggtgttcctattcggccatcttggctcctcctccctatgttccagacatatcattttcattccacatgtatttctttgtttattgagtgccttccatgtgttaattactttattggattcctgggggtgagaaggggaagggtgtgggcagggccactgcttacagctgctcaagttgtgccttgcttgagggcaggagcgcaagtggggctgaagtcctgccctccccactagccaggccaagataaggaccattttctttctttttttttttcttcctaatttgcacaaaagatactaatgattaacagagatcctggtatggaaacataagacacaagtttggttttgtctgaaagcactggtagtttagttggtgaggcagccacaaaactaaccaaaagtaattatattgccagccacaatgaaatatattaaccagagatacaaatgacattctgagggggcttggtggaagtagtttaaccctgatagggtggggagaatcaattcttacaactttcgaagagactagttggatgggcaagttttcttaatagctttattgagacataatttaattaattaactcaaagagtagaattcagtaatttttaatatattcatagagttacacagccgtcaccaagatcaattttagaatatgtccctcaccaaaaaacaaacaaacaaaaccaaaacaacaacaacaacaaaaacacatagtggtcgtttcttatttctcccaaatctcttgcatccggtactaagcaaccacgaatctactttataatctgtgaagttgcccattctggacattttatataaatgtccatacatttatataaacatcatacaacatcatacaatatgtagtcttttgttactttgtttctttcagttaggttttcaagattcatctatgttgcagcatgataagtaggcttttgattggtgaagaatagaagcaagtttaccccaaaatgatgcattagggagagctaagagattaacctttgtaagaaaccacggtctgtgtttgaaaggttgaaagtagactattgggtctgctgactagggcctgtagggaatgttacaggaattgaagttagaaatataagttgggagcagatcatggagattatgaatgcttggactttttctgagatgcagatgtttttgagaggggaatgatatgactagagatgtgtatttttctcccccataatgagaaaaattgatgaagctgtaaggtcccccaggttggtagtggagaaccaggtgtgaaatcatgaacaactccctcccaagtacttttccctcatattccactgcctcttactttttatgtttgttagctggagcaagtagaaaaagcacagatgatttgttttctgttataattattttttaaactactagaggcatggtggaaaattaaactcgatagattatagttataaatgttgttctttgggcacttgccatgaggcagcattttcatggcaaaccctactttgtatatttttgtcatattatgagaaagaggccctcttctgggtcacatgtttgcctctgcaggactctgacctgtcattttagatattgagtctatccttgttttgatttcctttggactcatggccttgagtatgtcccttatgttcatttgacagattcctgccaatcaaatggaagacaaagctatcccgagggtagttggcctgtgtttgcatctcttgtagccaagagaaatccctcattgcttgtttctgagctactcatgtcacagacttttgcaagaggaaggatttttgagattacatggttcaaatgttattaaattaaggtttagtggtccatgaacctcctgaaattgtttgcaaaattatctttaattgtgtggaggtgtatttttctcccccataaaattctcagatggattgcatccctgtaagggggaagaatcatttatccaccaacaatattgaacttttattgagtatttacactatgccttgtagaagacttgtgttatctcattcagtctttacagcccattctcatggattaggaaactgaatcatacagtagttaagttgacttgcccaaggtcacagagctagtaggtgacagaacctagattcagaccctggactctaaccccagagcctatgtcttcatccttctgcattttcaaccttcatgcctgctttgcactattctagtttaccttttataggctctggagttgatggagtctcctttaataaatgggtagtggaggcccagagagaagtgaaacatgtctaagatggtcctgtgattaaagacacatagctgttaacgtgtgacacgaatgcaaacaccaaagtcagattatgaggctttaacacataatttctaaatttaatttaaaatgctcctttttgacctttacttctgctattgattttcatcttttctcttttctccttcttaccccttctcttctttcctcttctgctctcctttcttcctgcttttcctttctttcttcagcaaccattactgagcatttaccttattggaattattggattaggtggaattattggtaattgtgtgttttcatgttactaaaatggactgtccagctcttctgtggccaacatctctttactctagaaggttctcaaaggagttaccacacatgaaagaaggttggggaaagcaaagtacccgaagccagtgctttacactggtacacaggagtaggtacccactttccgattcgggggactggattgtgtcattcattgaaatatgaaatagtgaaggaagcttcacttttatatcggttgggggtagcgtgagagttgtttgagcttttcacttttgagagcttttcaaatgaatcgccttatagttaaagctggagattagaagaaagatcaagactaggaaactctttatttaaatgtcaatatttaattgacaattaactgttgttgatttaaattaaatatatatatatgtatagagtcttgctctattgcccatgttccagactcaagctatcctctcacctcagcctccagagtagctctgactacaggtgtgacccgatacacccagctatttttttttttttagattttgtagagacaggggtcttgctatgttgctcaggctggtctccaattcctgagctcaagtgatcctcctgcctcagcctcccagtgtggtgggattacaggcataagccatcatgttcagccagggaatgtttgaagatagagaaaaaagccctgctttctccattccttctacggtttggcacccagttcatatcccatttgcccagatgctcccttttaatctttcctaatgcaggccatagacattggtctcagaattcttgtaagtctacttttgtcactcaattgtgtgaattgtgtgtttgtacaggtctcctgcatttactaaatatagtggaaatcatatttgcctagagatcagtagacctgtgcattgaatctaggctttgttatttgctatttgtgtgattcattgattgattttctttcagcatcaaattctaagttaataaaatgagattaataataatgtctaccctgtctctctcacagaattggtggtcactttttaactgtgaataatggatgtgatggctctttaaaaagagccttttaaaacaaaatgaatacttttttctacatttacatgtgtaattatgatgtttgtttgttttttcccactctctgggttaactctaaactcctttggattttaaacgcctttggacacttttctttttaaccctccttcatacctaagacagtgctatgtatattgacatttaaatgtacagggctaattatggtttcgtttcttcacttttttgttgttgttgttgttccttttgttacacatttattttgaagattttgttttcctggaaattagtgggatgttaacgtctccttaaagaactcattctttgtctttcctggttccccctcttatcctctgtaacctgtgacctcctcccaccatctgaggtggatgtctcctgaagttcttactctgtcccagcaatgatgaccttagtgtgtctactgactcttaaaacccgtagggacataggatccaactgcctcatagaaaagtaaggccgagagagggttactcctatatttggttcaagtcaatctgggtgctggtttataaacaatgcctattcagtgctctgcactaaggcatactggtgttatgcttctatttttgcctttattatttttaaagttttttggatgaaattactgacgttgatcacatattaaaaatttatgaggattctatttttgggttccattctatttaattctagctgaaatttgcttctcttttttatcctgttatggtacatttgttcctagacataatcaggaatgacaccagacacagactatattttggtgtgtattagtgagaaaatttagtatgtttcttttgtcatgttgaatgtagacactatggacaatgtttaattaattttaattgatttttgttgttgttattatctttctcaatttcctctgctttcttcttacttccttagcatggtatgccacagatagggacacatttcatctgaaagatgtatactatatatggatgtctttgcagtttcttcagtccttttaattacataaaaatcttaataatattaaaacaacaattatgtaaattttcaaaagaatttcaaaagcaatgaagaagaccactgttcagaacctcaatttctgaacctctccttacttttccttcttccttttcagccagtccttgctcaactctgaatatattttgacaatgtttcaattataatatatgcagaataatttacttctttcacttaacattatttttaaatgtcaatgttgctacatattccaaattactttggaattcattatatattattattcttttatttccactagatttatacttaagacagaatctcaagagtgggatatttgggtcaaatagcatttacattttggctcttgaaataactaacagcatgtcatttccaaagagacgttaatcattgataccaccagcagcaaatgttctcattcatcagaccacatttgttttacacgttcctctccttagaaagagataagtatggtttcttttctttagttcttgctaataggatacccaacatattgaaaatggtactccattgttttaattctcatcctctctgaccattagaaatattttgctccatgtgtctttgacgaagtttatgtattgttttatgaagtgtaaattcttgcccttgcccatttgatctattgagtttatgccttctttctttatttgggatccaaaatatttattaactctctgcctgacctatttgttccaaacattttttccaagtctgtttgcctttttagttatggtagtgtatgtatgtgcatgtgtgtgtgtgtgtgtgtgtgtgtatagatctacatacatgtgtacacaccatatatatatggcttataatggggacagaatcacttagcagatgggcaaccctgatgatccaggtatttacgaagggactcaaaccatcttcagttgtctaggtattcagaagaaaaaaattcagaaggctgggcgcagtggctcacgcctgtaatcccagcactttgggaggctgaggcgggcagatcatgaggtcaggagattgagagcatcctggccaacatggtgaaaccccgcctctactaaaaattcaaaaatcagtcaggcatggtggcacatgcctgtaatcccagttacttgggaggctgaggcaggagaatcgcttgaaccacgaagtcggaggttgcagtgagctgagattgcgtcactgcactccagcctgggcgacagagcgagactctgtctcaaaaaaaaaaaaaaaaaaaaaaaaaaaaaaaaaaaatttcagaagtcccggagtcctttccatgatgcatttgaagggccagagagatagaggcatgccctatgtagtacatcttgctgctgtccctcgtgtgtttaccctatgggtcaaatgagatggtgttggagcaatcaaaggatacagaccagtacccagcctttcttgtcaagactttgcctctccttgggatgttcacacacacctacccctattttctttagggatctagttgcttacttattttagacagtacatcctttatggccttgctgaaatgtaactccttgatggaatctcctctggtttctttctatctgtccacctcaattgagaactgatttccttcccctgaacccctcaccttcccatagtgctttagctgtagcttctttattcaatgtttcactttttactttggaccagagatatttatgaactttacaaaatctcttttaaggcagatatttcagttctctttgcattaacacaggacttgttggatgattgagtaagcgtgtgggggggtgtgaagagagggttcatttgttccttcctcgtgacagagctgagaggggaagggcccttgctggtggtggatgggccctgagggttaattgggctgagtgtggccacaaagcagaaagacttgctgtgctttctgaacttacgtaagttacaaacactattaaaatgtcacaaacaaataagagaatgaggactgtacttaggttccatacttgtggtatggaaagctatctaaaataaaattagctacatatctctgcagatttctctgattcactctacaaagaagcaagtgtttaatctaattctgcaaatatttgagactctttaccaggcgttgtggaacatgctttatgactggaaaagatgataaaggcatagtttctgccctaaggagctgtttgtgcatctgttggaggatatagatattttaacaggaagattctaacactaggtaggctgggtcctttgtgataaagtctgcattagaaatatgtgagaagaaaagattaacctgagtgcggtctctcatgaagttgctagtatactcttctttctttatgcatttaaccccaaaattatctctactgagatgattcttcttttgtatgtcaaattttacttggcttctccctcaccctgactcctagtcccaccattttaattttatcatgatttgaataatatcacaagggaatgaagaatttattctttttttcaataggtgaacaaaaaaaagtatgagaaatgattgatgtgtatttcaacattgagaaaacccaaggaattaggaagaaagttctctggcatatcaggaaataggaaatgatctcaccaattgctagaagtggttgctcagtctcttggaaagtgcaccttcagtagatagcacttaagtcatagcatgcgcgcacacacacacacacacacacacacacacacacacacacacacataatctctctgccttattagccatttattctctactgtctttcagtagatgatttcttttaccttgttcctttctaaatattacctccactgggacctaattacaacccctcaaaattcacattacattggaatagatgtgagctcccaatgttatctttaggcattacagaatattagaaactgactgtggttatccattgtgtatgcaggtatataaacctcttttgcccaaatcgttgtcagactgcagtgagaaaagtcaaggaaatatttcttactagcttctgaatgttgtatgaattttccccgaagaatgataataatgcaagctgagactttttatattctaaagtaaacatccaaagccagttttccccttctattaaatgaacctttaactgagctctgaaattgtgaggaaggacatactttgatgcccattattctgttcaatagccatattcagaagagaagtttaattcaaactccagcccatcaaagcattttgcagggttttcaaagcagttattgtaatagagagtaattaaatattactgttttcaactgcttatttataatgtacgaagacattataatgaccccaaagttggtttgcctttagaaaaataaggatacaaaatgctgtgtagaaaagaatatgctatcttaagtctagagagctgggttctagtcccatttctgcttgtgacttagtctgtggccttaggaaaaggcttttcttatcgttgagtctcattttcctgcctttaatgacaaagaaattacaaaccttatatctgtaaggcacttaataatttgtcccctcttcttaaacttgtacaagtgaagttacaacattctatcaagttcagaacatgtagactgtaaaattttacacctacagaacatgtaggtgtaaaatagagtcacccataaatctattacccagatacaggtgcaatctatcatgatcatatttatgtattcctttcaagtctttagctattagcataaattacccatcatgctgtgtatctcttgacatcatacattaagcattttccatatcactgcatattcttgaatgattacaattttaataactttaatatttcattgagtgattgtgccatatcttaattgtttcattatttgaaaattttgcgatgattaacatttatgcataaatgtagcttacttcttcaataatcttatatatgatgtctgagggttgagacacacgggtcagaggttaattttttttttttttttttgaggcagagtctcaccctgtcgcccatgctggagtgcagtggcatgatctcagctcactgcaacctccgcctcctgggttcaagcaattttcttgtgccagcctcccgagtagctgggattacaggtgtgcgccaccacacccggctaatttttgtatttttattagagacagggtttcatcatgttgataaggctggtcttgaactcctgatctggtaattcacctgccttggcctcccaaagtgctgggattacaggcatgagccaccctgcccggcccagaggtgaatatttttatggttatttctatctattgatgacttgttttgtgaaagggattttttttttttttagctttagtaggaatgtgtgagtgagtcagcatctcccctatcatgctagtattaaatatgttgtttttttggtattagcatttctctggttatttgtaaatttagatatgtttccacatgcctcatttccagttatttttttttattgcctttgaagatgagtactttccaatctttaggatcccattcacagcaaatcaaagaggaaacattttagtgagaattgtgcaattgtgcatgtcttataaaaggttctagaacattttttactcacatgaaggactgtttgaataagttgagacatgccttattcctaaatggaaacatagaggttgttaagtagttgttttccctacatttcgtgcaatcacagttagtacaactctcaggtcaattattcttgaattttaaccaaaaaattctaaattgtcttgacaataaacaggcaaaataggtaaaagaaatctgcaaaataagtgtaatgagcaactgggaccatcctagccagatgctgaggtgcatttataaggcaactctgattgaaggaggaggtggtgctggaatagatgggaggtcaaagcagtaacagaacccacccagacataaggcaactgcacgtggaattaattggcaataaaagaaccaccttgctacattccgaaaaggaaggattattctcatggcattgggataattggtcagcgttaatgaaaaacttacatcatgagtatgtttcacaataaaccctgatataaattagtggtcatgttaaaaaataaaacttgcaaaagtcttcaggcaaagaagaaatttgttatatctgtagtaactgaaagcagtaacttttaagtttacacctgaggtcctcaaactttttctgtaaagggccaagtagtaaatattttaggctttgtaggccagatggtctctgtcacaggtcctcaactctttgtgctgcaaaagcatcaatagacaatatgtaatatgtctcatatataaacaaatagagaatatgtaggtttataggaagagtcataatattgtgaatgttaatttcctgacaaatcgtgtcccatggtgaattttatgaatctttcatttttttggcaaactgtttgaaaaagcatttcatggctattttaatttatatttccctgattattatttaagttgtgtgtgtgtatgtatgtgtgtgcgtatgtgtgtgtgtgtgtttggtatatttgtgtgccactgatgtctctttttatgtgaattataggtagagttaatttatctcacttatttcacctctctgtcacctgatgtcccaataccctggagagctttgtgatatctacaccccagtacagactaataggtcactggtttgcttcagaactagaacttctcctgtgcctttgtgcccaagggcctgggacttgacttttggctcagttctacttgtctgctaacctgaccgcttgacagtggattgaggatggagggcactgagcagttttggctgtgcttgacctcctgcttagtttccctccatggtctcttagaaatctgagactgggcgtggtggctcacgtctgtaatcccagcactttgggaggccaaggtgggtggatcacctgaggtcaggagttcgagaccagcctggccaatgtggcgaaacgccatctgtactaaaaatactaaagttagccaggtgtggtggcaggagcctataatcctggctactcaggaggctgaggcaggagaatcacttgaacccgggaggcagaggttgcagtgagccaagattgtgccactgtactctagtctgggcaacagagtgggactccgtctcaaaaaaaaaaaaaaaaaaatgggactccgtctcaaaaaaaaaaagaaaagaaaaaaagaaagaaatctgggtgagttgttgcctgaatcttgtctgaacctgcctatcccctctgggtcctgaaatctaactgtgggtgagatctgcctttgcatttctgttcatccaggtgagcaaacctggagtttggcctcactctgtccaattgtgttccttccaagagataaaactgagaaagtggtaaagtcacttgcataagccactttcagatccatagaggacccacagcatgagattctgactgttattattacagaggtagaagcgtcattttcttggagctgtgtctccgtgtctttggtgtgccacagtcacaggcctgctcctgcccctccctgcaatctttccattgttgtgtgtggtacaggaactgagacaattatgacagagccgagctggtttctcttctcttttggacatcattgtttgtcacaattctgatcaccatttcttcctctagatcacaaaattgtaaaatcactgctatatttacattttcttttgctgcctgggctttaaaaagtactatttatagctttcctttgaaattcctttattaatagtcttccttcacatgtatatcactctgctatttacaaaatgctcttacgtttagtatttcacttgatcagcataaacacccatgggataagctaggcaggattgttgtctccattttacaggtgaggaaattaaggctcagtgaggcctggaaggccctggcctgcagccactgctggaccgggtgccagaactgggtttagacgtcttactagatctctcttgctgtttttctttccgtctacaaaaactccttctcatttatgagtttcaaagattttcttgtctgacacataaggaaattagtggcttttcttgagagatctaagcattactgcatttgcctaatatttcttttactatacctattggtctgagtactttaagagaaaccagtgtctgtaaataatcttccttcttgtcagacatggaggcagaaattttccaagaagagagagaccctgaagacactgtttgttctctgctgttcttaacaagtactgcaaccacaattttggatttttctcctcgaggctttctagttgtaggctgccacagaatacttcggggtcacagattcctattcccttttaaactgtatcgggcatgtgtgttatgtgacctttgtgttctgaccttcagatttagggaactgaagatttaggaagtcttgttaggacttaaatccaagtaaattccctcatgagtacaaagactcatctgtggaggtgtggaatgttggagagaaagggactttcattcatctagccccctgggttagaaaacagggctggtgagtgatagagctgaggctagcgtgcggagatcagactagattcggctttctgctggcttcctccatatcactcagtacttctggagttgtagcatgcctcttccccctggactgggagctttgagagggacggcactgggtgtgctctgtgcacggctcttctagaggtgatccaagtgctttgcataggcactcaggatttatttgcttgatgaatttgaacctgtctgttgttgataaaatatcattattgcccataaggatcttgagggagtttgtaaggatcttgagggagtttcagtcaggattcactataggaaacaaaccactttagatattttaagtggaaggtacttaatacagggtgtttcacagaagtaattagatggactgcatggagcagaatcgaggctgtctccagaaatgaatcacaaaactgcacaaaattattccattttctacaatcaagcaagacaaaaatggtgaagccaccatgggaattactgagttcagtgatacatcacaaaacttgtgaaacagagatcaaaagccatagtcagaatgatggtagctggacactgagacatgagtccagctacttactctttttgtcacggctgctttttgacagccaccaagctgaagactcaatatgagaacacagatgctgaaaaaccccatgtctgtgtcaccattcttctaacagaaaacagggcaaacagcagaaacatgtcttccatcttacttttgcctttcaaatatcaagccaattacatatattttggcagaatttcttttgcaatcaaaccttacctgcaagacagcctgtgcaatatgggaagtttgagtgtcgatctaccatatccaccacattaagggtgatggttttcatatttcgggcatgtcttccataaggctttgtgtgtagtagatattaagttggaaccagagtaacaattacgttctattacatctctacttgtcagtgtagttaattatataacagaatggactgcaacagttttactttagggaatccctaagggggaattcctatttatcagaaaaatgctgtaaggagggaagaccctgaggtgggagagtattctaaactgttttggtttcaaacatcttggaaagtactacatggagacatgcgatattataacatatcagtgcttaccatgtctggggggagttctgtcttaaaaaagcttgcctaccttctatgctgttgctccctcgctgcactgttttgaccccactttcctcctcaccagccaaatacaagttttgcaatgagaattaatgtaaaatggtttctttataacaaactaaataggcttattcttaaaaggaaacatagaggttgttaaaccgttgttttccctacatttcatgcaatcacagtacaactcacaggtcagttattcttgaattttaaccaaaaatttctaaattgtcttgacaataaacaggcaaaataggtaaaagaaatttccaaaacaagcagaatgagcaactgggaccatcctggccagatactgaggtgcatttataaggcaaccttgattgaaaaaggaggtggtcctggaatagatgggaggccactgcagtaacaaaacccacccagacacaaggcaactgcacgtggaattaataggccataaaagaaccaccttgaaacattccgaaatgttgagccttcactgaattcttctgacttttccctcaactctgtgtaaccccaatttagaaatgtgaaatagttgttagtaatcccttccacctttacattgtaccctagtgagtgcatttggatgtattttagacacatttttttttttcctgctccaaattaagaatcaggcaacatattgtccttctagtacttgtaaccaagtatatattataaaatcactgataatctcgtatgtgtggggtcaggtgttaaagatataattgaagtaaacactcttgatttatttttatttttattttaagaaaaagtgacatttttgcttcaggagaaagaggctgagtgaataggttagttgataatagtttctgctaggtttctgctatatcttgcttttctcccgaagattcattttagtaccttctttccttcttaagagcacatgctcctaaagcagggaagcccccaaagcctcctctacttcccgttgctaattgctgtggcctcttatccacgccagtaatgaaccaaaagtatgggagggctttagccatatggaacttctgggagaggacttgactgtattcaggattcacttggactaaacgaccaaaacctcattaacacagtgttttcagtaggtgattatatgagttatcgtcaaaactgggacacttttgcaaaggggcactgttaataattacaccagaacagcaggtataaattggagatgtatggtcatcctaattatacagagccttcaagaacagtgtttgaaatgtgaattaaaacgattcgaaaccagagcttaagtcttagtattttcatgggtttaagtttaccttctcttttatataacaatcacttgctgagatctgatgatgggatatactgtgtattaggtcctaggaatatatagataaagtagataccaattttgtttttttcttcactcacagtattgtaatattttagaccagtgggtttccagtctggcttatagcatactggagatactagggcaataatgcattttatgcttcccccaaattaaagtatgttttgccaaagtgtgatgatttaaatgcccctgtaatggttttattaatttttctatttatacttggggttttgtttatgatttggcatgaagaaaccatttattttgctaaggaaaagtttgaaagctactggtttgagacttaaaaatttatctttaatatttggttataaagtcgtaaggctactttttaaagaggggaagaactagactgattaaagctgaaacacataaagatgtaaactgagtgggaaacaaataaattacctgaaatatataaaggtctgctatgtattagaggttttgtgattctagagggcacaggtaggaccaataggtggtacttatgggaatacaggcttcagctgcagaaaactttctagcagtcataacttttctgccatggaaggggctgtcttgtaaggtaatgagttccttgtcattggacatgtacaaatgaactcacagatggtgggtaagcttcatcttgagctccacattagataaaatgtcttcattaacaatttcacacttcaaggatgttaaacttctgtattggtgaatgttgggtcctttgctacttctttaaaaatatctaaagtgtgtgtgtgtgtgtgtgtgtgtgtgtgtgtatgtatttgtgttttatttccccagaacattagctgagtatatttttcatgtattttattttatatttttacacagtggtcaataattgataaaaatacagaagctactacaacagttctctcatcaagggaaacttaaaagggataatgtccatagatgtgattctgaaactgatttgaaacagcctggttcatttttactgtgttgccattggttaatgcttaaccagattttgtctctgtttcaaaatcttgaaataaaagtggaacaacttccaacatgacttaagaaaaaggtccccagttgaaaatgcttccaatcgttttgctattaaatgtgaaattgcaaaactagcctctcttacaaaaactagtgagaagcttgcctgtttttcataccatttcaaatactgagaaataatttctctaggctcttggaattagagttaaataaaaattatatttcagagtatataatgcatgaagttggatttctttgttttctaaaactgtatctcatggtccttgaaggttgataatttatatctctggtaccactttatttttctattatttgtggattaaaaattttaaatttagcaatatacttatattttgctttagaataaagttgatttttaaaaacttatttagagacagggtctcattctattgcccaggctggagtgcagtggcatgatcgtggctcactgtaaccttgaacccctggtctcaagtgatccttccacctcagcctcccgagtagctgggattagagaggcgagccaccattcccagctaatgttttttagaaattattattattttttttttccagagacacatcttgttgtgttgcgcaggctgatctcgaactccaggcctcaagcaatccagggtctcctcccaaagtgctaggattatatgtgtgagccactgctcccagctgagctttttcttaatagatatttaagatgatatgtaattagagaatcggagattaaactggaaactttaatttacaataacaataaaatattaattcaataatagtaatttaaattacaggccaggtgtgatgactttaatctcagcagtttgggaggccagggtgagagcaccgcttgagcccaggagttcgagactagtgagaccctgtctttacaaaaaaaattaaaaaatttgccagacattgtggcacacctatagtcccgactactttggagaggctgaggtgggagaaatacttgagtctaggagttgcaggcttcagtgagccatgatggtaccactgcactacagcttgggcaacagagtgagaccttgtctctaaataataataatgataataataataataaaaataaacaaataaataaattataatgtccaaactcaattcaaaagctctaagctaatttatagtagttctgatgtaggatacaaacaacacagttgacagttttgtgaacaatatgatgttcaaaaggctgaagtataatctctaactccccatcttgttgctatgattactcttagcagattatgtggcctgaatcaacattggttcacagtcacaagcagtgttatcagatgtaaatatgtcttaacgttcatcaatagtagactcatattcattgaaggaaaaattaagaatttctactttttcaagttataactaaaattgcttttaaaatcttccttattttattgagatatcaaaataaatattcaaaaacagaaaaatacaaacagaatcattaaaaaattaagataattagaacatcctaaagtggtagcaaaatctcatggcctgactaatggtcatgacacacttgtaaatggatatctaaaatggagtgtttacatgttttaatacaagtttgaacaagctgtcagggaaacacagctaagtgagctgcagttaacttgcagacttacacagttattggtaggtttagaaatagaagatgctagataaccgttaaagagattgctaggtctcattagagatcatattggtgatttttcctatcgtcactttttcctgggtgaggggcaaaatctttatgaattaggcacttagcgtctcacctttacaaatccagatttccacctttagaagcagatttactgaactcaaagaggtgcaggctattgttgcctgttttctcttggccttgaacagaaaagcagtctataataatcaaggacttagaagaaacctgctaaggagcccgtttttttgccagcactgcacactccacagactagccataacattgtggatcataagaagttgtgggaggagattttgaaggtcatcattagttgcttattattttaaatctgcagaaactgaggtccagagagaattcacattttcttggttactttgccacgtggaacaattgttatcaaatgtgacctggaatgcaaggttggggccatttatcttctgtgctaattttcagtgccatggttgcgaactttcttggcagagaaattgtttacttctgtgccctattccattgccttttacctaccccatctagttataatctagcaatagagttataagcttgtgtaatcaaactttcccactgcagatgctctttggagacagaatatttgggtttaaacccagcctctgatatgttctagctgctctattacattggataagtttctttagcttctctaaatctcggtatttgaatactcaaattagaagacgtaaattatttcctaagatttctcctagctggggttctctatgaccttttagctcttaagtagtctgtcctggctattgtcaaccatgtctttttttccttgactgatagaaactgtggcaaactaaaggccacttagtcagtatttgttccgtccttaaccttctctcctgagagtcctgatctttcagtgctgttgtttccctgtcagggttgattgtttccttttcgagtgccgttctgaatctgaagtgaaagtgcagcgtggaggcatgtcactgttgtgtctcacttctttttcttttttttttttgagatggagtttcaccctgtctcccaggctggagtgcagtggcgcgatctcggctcactgcaacctctgcctcctgggttcaagtgattctcctgccttagcctcccaagtagctgggactacaggtgtgcacctctgtgctcggctaatttttgtatttgtagttgagaaggggtttcaacatgttggccatgctgatcttgaactcctgacctcaaacgatctgccttcctcggcctcccaaagtgctgggattacaggtctgagccactgggcccggccgtgtctcacttctttatctgagacaatgtttactggtctagacctgatgcttctctcccttgctgcttcgtagtttatttggatcctgaaatgccgctgagtttttcttgtcacctgcagcattgccaagaacaaggagtgcaccattagtgttaatttattttttctggtactctgtgcaaggcagatgggcatttaatgtgctgattccaaccctaccttccctcatctacactccctggtctcataggagttaaaacatagttttgtaagaaaccttagctccttgaacttgtggacttgtgggagaatcatggaaacatgagagttagagggaatggtagtggatatctaatctttagtgtacagataggaagggtcactgaggttcaaagaggttaagaacgaaagtcatagacccaattagtgactgagctagatagaaagtacgcccaagtcctctgcatctaagtctagtgccttttccagtttttccaaatgtctctcagatagcctatataaaggtttggcatttctgtagcgttgttctctcgttacctcttctgagcaatgccagctgtccatgcagagagtggggcacttagccagtgctgggccaaagctgtctgtaagaagaagttgagtgaatacattgacattttcagcccatggtagatcctgctttgcccttccggctctatgtgacctgatgcttcagaggaagagtgaatacatttgctgttcaactaacaattgtgtgtaattttcagcctgccttattcttcaatgctgtcttcccacgcctccaccacatgccacagcatatctgcttcgcaattacgctggtagggacttaccccgtttggaaaaggtttgcctaaatacttatttacttgtgcatgatacatcttgattgataccttgttaatctctgagatcaacccaagaatccttccttcaagggggaggatagaagagtcagggaaacgggtgacagaaaaagagaaaaagaggactgtgcttcctcactgatgagcaaagaggagaattacagatgatatcaaaacaatgaggagaatcacgggtgatatcgaatctgctttacttggcgttggctacttgtaaagtcaagatctttcatagactcataaaagcttgtgagcagagttgtcatttgtaccatctaattccatcactacatttttcgagaaggacacaagatttcagagataacggaagttacacagtgggctcatggcggagccaagactagaagctgggtctgaattctgaagatcaggcatctttccactaaatactgagatgtgaacaataatggagagccgtatagcccagaggggaaaccacattataccactttagtggatgattaggaaagcagttttgaaattccaggaaggtactgacttttgtataaagagaatgtttaaaaaaaaaaaaccttcaaagttataggagagtgttatttaaattgtaacagcttgtttaaatgaagaaaatgttgctaagggacatgaatgctaaacgttagtctgccatcagctacttctgatgtttaagtcaaatagtccctcagttctgtggtgttaatctacgtcccttttctaatatcattcatttattcagtgcacactgaccaagagctaggccttgagttagttgccaggaagatatagggactaatacaatgtcatttaaagattaatagaaatgctctaagtcaattattctcaacccttgaatcagagtatatacataaagatccccatatgaggttagtgtgcagactgttttgataaacactactctaagtttattgcactggatgttggataatatgatgtaacggttgtttgtttttcagttttggtgatctatataaatctttttagaagagtagcatattgatttggacgaaaaaaaggaaaatatgaccaaacactacttctttctgtttttgtgggtgacagtgacttgacattcacatggtatcctgagagaggcttagtagctttgttagtattaattgtcagtttgcctatggcactaagttttcccacctacgtggggcgggtcctggtcatcacatagccttttgtagttatttgctttctgttgtgccttgattttttttttctgttgactattggcttcatcactttgtggtcctgtggcttattatgattagatttgagggtacagaatagagaaaacattatggcaagtagaattcaagagctggaatggaaataataagagcaaaaactactgttaagtgctgatttcctttgaattgtggtgttttcctttcttctccaaatagggaggtagtacagagtgaagaccggagatttggagttaaagatctgtgtcccagcttcagctttgctatttgttagctgtatatccttgagcaagttattcaacctcttacagtcttactttcttgatttgctagatgtgggtaatgatagtgctacctcatatggcagtcaggatgactgtgtggccattgaaaatttgctagacatataataaaccttcaataaacacttgtttattgtcagtctctagtcttcttaggaccgctgggggaacagacagaagagcagcagaggagttgataagtgaaacctcttaggttcttcttaattgcttgcatgtgacaatttctgaaagagcaatgctgaggaagcagcagctccccagctcccttcagcagtaggcatcttgcttagaggagggccactgctcttgctttcctgtctgctgatggtggttgtgtattctcagagcctctctggaaatcttccctttcacttcttgctttcatgatgattatgaacttcgagtgaaacctagctagaatgaggggaagtaagagcagtgtaaatcttggtccagcaacaccagttctcaccactgcttatttttgtgtttacatgggtctctcttagaagccaagagccccaatgatatgtgctagttcatctgttcattaaacttgtgaagtttcatcaaacccatttatcaaaatgaagggctgtaatgaagattttagagaaagaaagcactctaaaatattagagctgattgggactttacaggtattcattttgcaaatgagtgtcatctcttgttaaaggtcacacttgtatagctgagactagaactggggccacagggactctatgtctatactattggatttatcactttccttggatccatcctacatgattcaatttttaatacctggagttttcactcttgttatcttcctattcaaggataaaagctctagcttcttatctttatataaaacctttaaaaggcagaactcatgttatcttttaaaactttcccctaactgttctccctgaatccctcattttggtgccgctggtctgatccctgtcctacagaaatgccttgcttcatacccaagctcacagtattatttctaatctttgccctggttactccagttttcttttatttactcagcattcaaagtcctggttaagggctacctctgccaagcttatgctagcttttctgacatcccccaagatttttcatgtgctttctgtgttgctctctttctcttttcacatttataaatatttcttcctcaaatagtctttgagctctttgagtaaagaataagaatctgattcatctatagctccagtgccaggcaaataaattcattcattcattaaattaacagacatttttattgagtacctatcatgtggtagcccctggaattataaaatgataaatatttccactctcaaggatttgcgagtttagtttggggaacaggaaagcagatgggcagagcaccatgtgacgaatatgtgacaacagtatgtagatgctgtgggattgtactataaggatgtataacttgaactgtagaatatagtgcaagatttgccttcaaggactagtagaaagtaatgcttatgatctaaattgatgcatagtatgttggaagtcatttttagacaagaagtagcttgtttcagagggagcagagatcaaacctaggaaaaaaatgtgaatttctatcagaaaagtactgcaaaatgacctcagaataaatagaaaactactactattatcatagaagttactggcaatatgattaatgtctgttaaaagaagatgtatttagatgactttatgctgaatttggataacctttaaaaaaccagataattccagtgtagttattaaatatcctagacagtagaggaggttggagaaaactcccctatcaaaacctaatcatgataagtaaaacaagcagaaaaaaatgctataaaatgatctttattatgattatatgtacacaaattatagataaaatagcctagttaattcattaatatatcaaaacacaagtgtaacaaaggatttattctaggcatgcaaagatggttcaatatgtagactttatcaacatatttcattacatcatcaaattaagggagggaaaaagagttgaatgtatcagtggttgctaaagagggcactgcagctgtaactagataggattttattccacaaatgccaagatagttcaatatctggaaatctatcagcatgcttcattacatcaccaaattaagggaagataaaagagatgattgtatcagtgaatgctatagcaattctagaaagatatgagtaactaagaaagagtaacgttcattcattctcccatttctatgtaacatacttgtttaaggggcttcctgcctaggcattgtgccggtatagtgagactagttggagtttccaacttgttgggacatgtaggcaggtaaataaatggctttcttgtggattgttataagtatgccgaaagtactaaagagcctagaaaaaggaattaggctactcttccttggagaagttagggaaatgttcacagagttagagacatttgagctgagacaatataaaaatatagggcttggtagaacgtgaagagagggaaacggcattgttgatggtgaacacagcatgagcaagggttcagaatcatgaaaacttattataaatcctgggaatggggtcactgggtcactgctgacatgcagaagaatggtaagagaagatactgaggaggacatctgcaaacaaatgattggtcagaagatgggcctctcaggaggagcagctggaggtgcttcttcatggagggcagcatgcgggtaatttatgatgctggggataactgaaatgactgtggagccaatgatttgcatattgatacttacattttatttatactctcccagaaattgcctgtttctttatatctgtgctatatccgaaaagccaagatgatacagtcagtcagtaacttgggattactatgaaaaatgtgaatctttgcttaagaaaatactgcatcctatattaaccaatttttcaaccttttattataaaatgactttagatttatagagaccttccaaggatagtattaagccattttaaaaattataattaacatttatactaccaatgtgcataatgcattaaaagttttaaacctttacttgatcccttttatttcacacttatattcactttagtcatactgaaagcaaaccagtcacttttatcccaatttagtagaagaccaagcctcaattaaaagcaaaagcaaaaccaaaattggcatttctcagccatgtgagatgggtttggttttggtatttagaaaaaaaaaatcatctgaagttattccaaatgaacagctaaatttaaaaaccacgagtaaaacagacattcattggtagtttttctatattggttttgtgctaggccttaatggtagtttataaatgtgtaaaatatggtccctacccttttaaggaactcaagtttagcaagtatgtatgtgtctttgtgtgtgtgtatatatatacatgtatgtatgtgtgtgtatatatgaatatgtaaaaggtacgggggaaagaaaaagaaaagaaaggccctgtaaccagagtgaaaagccagtaccatcactggcttcaatagcatgtgtcctgattaccagtttagagtctttgtcattgattcatgttatcctcgtcttttaagaaaactatacatcaagctgttcttccaagcaagatggtcataaaattgccattgactttctacaagaatagaggcttctttttttctcactttgcatagcactctatactataaaaagtactttaatatcatctcattggttgccataaaaattctgagagttaaggaagacagaggtttatatgtttgtttgttttttgagagaaggtctccctctgttgcccaagctggagtacagtggtgcaatcacagcttaccgcagcctcaatctcccaggctcaagtgatcctccaacctcagcctcttgagtagctggaacaacaggtgtgcgccattatatcctgctaattttttaattttttgtagagaccgagtctcattctattgcccaggctggtctcaaactcctggcctcaagtgatccttctgccttggcctccaaagtgctcggattagaggcgtgagccattgtgcttggctgagtcctctgagacagtgaaactatctgaggctctagaggcgatgccgttcaaagtcatgccacttgttggtggtgtggactgatgtgaatatccaggcaacactgtttcccagctctcccctccaccctgtctctctattactatgccatgtactgaggcctttgatttctgtgttctgatgctctttgtctttacagacatctggaggtaattgtgtagccctcttaattaattcagttcaattaataaattagtaggtggcttttgggctgggggcgcttacagggtgccttccgggcgtccctgtgctggagagctcttgcaatcaggcttggagagccctcctcggcagcagcctctgagtctcatccccagcaggcaggctgactggagaggtgattggcttaccctgacagaggagacatttcctctcttcaaatattatatgcaatctgatcagagcagcatctgggctgggctgattgttcccctcctagtttaagcaagcttttcatgaaggtccaacatggtatcagctcaacatacaagttgatgggcatttctttgttgtgcggggctgacctttgcattacatgtgttgaatattctatcctccggtcctaaattctaataattgtcccagacgttggggcaaccaatatgcccctcttccccttttccacataccccttggtggggaccagagctgctcctgcagatggatcatttaaaagtgtcctgccaggtatctgttaaaaccctgtttccaaaataaactttcagtggttccttaatgcctgaagaataaatttaaactcaactgtggctgctgagctgtctgtgctttggtttcaacccaccttttagttcttttgcttgctactttctgttattcgccctccaagcacactaaacgtaaatgctgtgtacttttctgcctgtataattttgccaacatttttcaggttcaaccctacttagcactcaaacccagtctgtatatcacctcatcaataaaatcttgttaattctgcccccaccaagaagtgagcctatctttttctgcatctcagcaacacttgttcttaacctcacttaggtaacttagcacttcatttaggcataaccatttaattggtgagataattaatttaatagattattaataaaattcaagctcttttccatcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcctctccttcctccttttcctcctcctctttctattcatgattcctctgcctcttcatttttctttcttccattttctttcacccttctttccagagaactttatcaggatgcatttagtatggattaaggtgaaatagcaatgaaatgaggagtattgtcttcgttttcatgcttccataaaaacagtgtttctttttcattgcagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtaagtgctgggatttcagagttggttacttggagtaggaaaattcagttatataggtgatttgtagtacaaagttgtgtcagaaaaacgtagtttgtgaattcacagcgtgggtgtcataggctactaaaagtaaaggagcccccggaaatagtctagaccaaccccgtcttttaggaaaaagactttttatgggttatatggctatggttacataatgaaatagggttagagctcaaactagaaacctggcctctttagtcacagctcaatgcctttctactgcgttatcttccacctccagctcattctcttgtagggttttagctaccagacagtcatccctccctcttgccgttggacaaatgtccacaaatgctgccaagcagtagtccaatcagaaacttatacaaagtgaacctaataaagtgcatggaattgtttacctcctctggctgtttttcttcccttaggctgctgaaggataagttgtctagagtgttctgtgagatctgcatttgttgaatctcccagacaaatatgagtgaagcctagttccaggggttttaataacaatgcattcagtttacatcaagtagagtttgaaggtctacgtgagctccagctctcatgtgtatgtatacactcacacacgaagcctcagaggcagtataaatggtaccatactctttggttgaaaaggttccatatttttaccagtgaatgttagcagcttattcaaactcaagaaaaaataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgcgcccaggaaacactttactagtctgttagtattttgggtctgatgccagaagcctagttcagatgtctagcttgtgtaaggtgaacacctaggttgggtggtagagaggatcaggcttcagcatgcatggctaagctgcagctgtggatctttggatatccttttcctcagaaagtacaagaacgagaccctcagaaagctgctcttgaaaaacaataaacgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggtttttttttttgtttgtttgtttttttttttttttttttgagatggagtttcactcttgttgcccaggctggagtgcaatggcattatttcggctcactgcaacctccgcttcccgggttcaagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctcatttatgttttcaatgtttccctttgtcagcttactaggggcattgttattttgtctcctaacttttggggaaagcttcagtggacctctctctaatctgaacagaatacagacatggccagttatagagcagaaggcaaaggtgtgaggaagtctttgtaggtatgagagttcttataggcctgagcgttatggtgagggcaggtcctatattaagtgggctcataaatggcatatatgagataggtagaagagaagcatataatggcctcgctttagactcctttactgtgaatttgacatgccctccttgtactatgtgtggttcacccactgtcttactctctaggaacactgaagtgatttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctacaaaatgtttttttttttttcttataaagaaatggaagcttaaaggaggtgacattctctatgatttgcttggagtatgtttctgaactaaggctgctgtccatatccagcatgcggtactgcctgtccttctattcacagcacatgtggcagcaaaccccatattacagtgatacatccctgcatcccttataagaatatatataagctttgcttcctcattgaagcaacaagacatggtttctcactcgtccttatgttcctcatagctcatattatgctactgtgtttttagtaggaatggttgcatatggtcaaatgtatgtctgtgtgttcttatgtatgcatatatatttggatggctggcggatggctggctgggtgagtgcactgctcagtgatgcttctccaaagcagtttggaatatggtataactcagtcttttgttttctgaaattttggctctctcttgcatttctgccaattctcactctttttctctctccccctctctctaaatataataacctttaccttttctgaatatgcaagagaagaaattttcctttaatatataagttaaagacaaatcttgggaacagtttatggacattcagactttttaaaatagaagctacatttctgcatctgctgtatgaaacaaagatgtatccatgtatttgttggaagtagatttgcttttctttatatttaatttaaatgttatcagtgcattctgttactctgaacatttttgtaacttacatctattgtgtttgtttacacatttaaacaatttataaccattccttttcgtttctttttttcatttagaatgttctatactctcagtgaaattcccaagatagtaggtagcacaggttttatttccaggatgcattggtgataccagcttatgctctgtattgcctcagctcatgctgtttttggcttttagagtgtacttgtcccccagtttcctgcttctacagtcttttaattcattgcttaaaagttgacctccacgaagctcaaccacaaatgcagaaagttagaactaatagaaatcacgcaatccatcttgttctgacgtaaatgtgaaaactgcagtctagagagtgtaagttatttgttcagagaagcacagcctgctctgagccgagttggcactcaagtcttttccctctaactctagagttacccaaaccttgtactatattctaatggcaaactgttctttactaccccataccctcatgcattgcctacaattcttatgacaatgtgttttttaatagatttgcttgtatatgcacctgtcttctctagcggagtctgaactttgagagtcaggggctgcctgactcatgccttttccctcaacagcacctagcaggatacctgacacatactaggaactcaatagtgtttgcagaactgaattaattgataaagcacagtaatataaacctacttctccagacacaggttctaggttctcagctacttattagacactgtggttctgcagtttcaacccacgtctttgcattacttttccttcctatgcccattctttgaacttacatttctcaccttggtgttacgtctgtaatctctggagtttgctttcccatgttttaattctgactgtgaaagtagaaaaatacccacatgttttccacatcaacttatctttctggggtacccatatttataatttcttttataagatattctgataataaccattttctaaagggctttggcacactgaaaagtggggcatgctttttttcccagttagtagctctttagatctcagggtccttttattttacttccattgttctcatttcttttcactgattttgtaacaagttgtgttttcatagctaacttagaatacccctacatttccaaatgctttctctgtgttcaatgctttgtgcttacgaactcatacttattttttaattaaatttagtcttcttagagattttttttagttcaatagcttttggggaacaggtggtttttgcttacatggagaagttctgtagtggtgatttctgagatttcggtgtgcccattgcccgagcagtgtacactgtagtcttttatccctcacatccttcccatccttcaccctgagtccccaaagtccattatatcattcttatgcctttgcatcctcatagcttagctcccacttataagtgagaacatacaatatttgattttccattcctgagttacgtttagaataatggtctccaactctatccaagttgctgcaaatgccattatttcattcctttttatggctgagtagtatcccatagtgtatatataccacaattttttatccatttgttggctgatgggtatttagaagatatacagacaataatcatatgaaaaaatgctcaactcactgtccgggaaatgcaaattaaaaccacattgagataccaccttactcctgcaagaatagtcataattaaaaaaataataaatgttggcatagatatggtgaaaaggggacacttttacactgttggtgggaatgtaaactagtacaactgctatgaaaaacaatatggagattcactaaagaacgaaagtagacataccatttgatacagcaatcccactactgggtatctacccaaaggaaaagaaatcattacatgaaaaagacacctgtgcacacatgtttatagcagcacaattcttaaagattttatagtgttaactatttcattttttgtgaaattattttggtatatatttatgatgttgttccatcactttctattctgtgtaactgatgacaacaagataagataatgcaatttttcttctggtcttcaaaatactagcctttagtgttgtttgtcctataatctgggttttcactctgctccaaatcaaaaaataaaaagatacaacaaacaacaaccaccccacccccaaaaataaaacaacaacagcaattaaactcagtcttagactttgatggcagaacagtatagttctttttctgtttttggtaaatagcaaagcaaatgaactttcctactgtactaatataattttttaaagatggtttttgaaattatcttactaatacactctggggattagtgttaggttgcctttaatggcaaaaaccacgattacttttgcaccaacttaataactctctctctctctttctctgtctctctctctctctctctctctctaatttggctgaatgaaatttgataatactttttatccatcattaaaatagataatcatttggaaagatttgtaaagttcacgtttgtgaagctggagttgtcttgtggcctagaattcactttctttaatttctgaaattctttttaaaaaacatttttatgttagatttttgaaaaaacaaattggcatgacatgccagttctcactctttttctttctccctctctctctctaaatataataacctttaccttttctgagtatacaagaggagacattttcctttagtatataaattaaagacaaatattgggaacggtttgtggccattcagactttgggtctgcattaggtaccaattcaacgtgatcattttggtggaatccttttatattggtatactcttttatagtttatttagcagttgcatgttcattgtcttttcatttcagtagaaaattcttactgtcactctctgaggtaggtagaacagatgttattgtcattttgatgatttgtaagtagtagaagtggaagagcttaataaggaatcatgtagctagtaaaagagtagagggagaccctcacacctagggctcttacgaattttaaatgctttcgtttattaaagcgttggctacacagtctgatgtctcctttaacttcattattttattatttcatgattcttctttgaaattaatttcaaaatggtgaccctttttacaaaccagctttgtgaatattggttcacatagacttgtcaagatagatcaagataggtgaggtgaattatattaaatagggatcctaagcctggattatttttttatgacatctttctgtgctttctgctactgtgaggttacgaatgtattattccatggaggggaaacagttatagatgattgctaatctacccatgagtttggggctgaattgatccagaacccaggtttcctaaatgcactcattcagctgtaccactgtggtttatgggaaccaggcaagtttggagcttggttcctaggaactgatgagtcctggattattgatgcttggtggagaattagccattagtgatgtgaagccatgtatcctgggtaggcaggacacatttgttttcttagcagataactaacatgtgagggaaatggatgtccacttatggcattatatttaaaggaataatttagactggattttccccattatttttgctgcgaacgtatggtcctcatggtgtgcttttctgtctctggagtcttattgtccttttccccatgcaaagagaatcttgctctgactttggagatacaaatgggaaacatcttttttggaggttacaaatgggaaacatctttttgtaatcctgacagtcctgttaattgcaattagagactgcagttgtaacatcttggacgtttggtataagtatgcgtgttatgccatgaggatagccacaaattcacggaaacatcaggaactgtaatgaagctcgggtttgcctgtcatgccccttttctggatgagcgtaagcatctcgagcctcatccatcactgcacagtgcagtgcatgagttttaattttcaggtcctcagggggacaaaagaacaagctgtgtattcattaaaggatcaaatattaattgtattaatttgatctttacactgcatctttcagcagagaaattaacttgtaattcttggagtgacatcagatcttaccaaatattcttaggccttattgatgctcaaaagtgccaagatgcagccctggcttgatggtcagtgcagttacattcaagcttcagtttcatcacttggccttgggcatgatgcttttctaatccatatcctctttaattcataaaatattagctggtaataccaactgcctcacaagattgttttgaaagccaaatatgatgataaatgtgaaaatgtttttaaaccataaaataccttataactctaaggagttactattatatacttattcagcagtcatttacttaaaacagattttgtgccagatactcttctaggggctgaagtaatggcactgagtgaaacagagactagttcctgccctcttgggatgtattttcttgctataataaaaataacattattaataataatagtgataacatttgtgaaataaaatttatttaataaatgcattttataactttacatataattaccaataactattcaaaattataaaaaatactttaatataggttaagtaactctaatccaaaaatctgaaatcttaaatgtgaaaaaatctgaaactttctgagtgctaacacaatgctcaaaggaaatgctcacaggaacattttggatttcagtattgtggattagggttgcttagctggtatgtgtaaatattccaaaaatccaaaaaatctgaaatttgaaacacttcatgtcccagatgttttgtatatgcgatacttagtctgtagtaatgaatatgtgataatataagtataataataatttagcatgttatccataagtactcatgtcattagcttctaacaacagtgatagagatcacaatgcctcaacactatataaactgtaaaattctagaaccagggtgaatcttaaaagttatctaatacaacccctttctttcctagatgagaatagttgagaatgtattcactaatacatttcagcgaagtacaggttctttgcccaggagtgctgtaaataaccaatgaaaattcttgaatgcaggcaacaatttaatcttcatttcagagactcagagaggcaggtggcttgttcagtattgcagattagtaagtggggaagccaagccatgatcctggggattccttctctggttgccatagacacgttttgggggacttgtttagaagttacagtgattgaactaatatacccgaacaaagtggattggatgttttagaacaaggagaagtccctgtattgttgacagaaatctcttttattttgtaacttgtcagcttaattaactactgaaatgagttccttaataaggtgatgggtgcctcctaattcttgtatggttcaaaaacaataattaatgctgatttgtgtggtgagatacatattaatcatctttatttttgaattatacaaatatacaatactattgtccctccgtattttacatctgaagagaatttaattgcttttttgataataaaaataaacagagagccacaaagagatatcaccacacatgtattagaaaagctaaaataaaaatttgtaccagatgctgctaaggatgtggagaaatgatctctcacaatgctggtaggcatgtgcaaaattttgtagccacgatggaaaactctttggcggtattttacaaaagtaaacatgtactaaccatatgactcagcaaatataccctttggcatttaatccagagaatcaaaatgttatgttcacgaaaaaacctgtacatggatgttcatagcaacttttttttttttatcataatgacaaaacactggaaacaacccaaatatcctttgatgggcagatgtttcagtgaagtctggtacagccatacaatggaataataccattcagcagtaaaaaagaatgaagtattgttggtatatgcaataacctggacatgcttaatgaaaaaactgtctcgaaaggttacatgtattatatgatttcattttaagacaaagctctagagataaaggacatattcatgattgctaggggacagaaatgggtgggtcgggggggggcaagtactggtcattcctacaaagaggacgcagcaagagtctttgtatgggtggaacagatctgtacctcaattggagtgatgattacatgaatctatacatgggataaagttacatagaactgtatgcacacacaaatcaatgcaggttataaaatggtaaaaactgagtaactcctagttaacaataaggtaacaatgtcagtttgctgggttttcgaatgtattacagctttatgagcattaccatttagggaacctgggtaaaatgtacatggaaactctgtactatttttgcaactttctatgagtccatatttaaaaaaaaattaataatagtaaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaaaacaaagcaaaataaaaaataaaacagaacttcccgggaattgtgattgatgctcaaccaacgtttgggaaccactcatttatttcattaacttcagggaccagtgccttaatctcctttgaaccttctccaagtcctgagagtgtactcttcctcccgtagttaatgatggtagcttttgaagtcttgagagtctttatcttgtgaacattgtacagattcagagacctagagcatctttcatgttgctattcttttccctcagtgctttcattatagacaccaatcgtttgcatatgttgtcctgggtcattttatttgggatccaaaaccagaaaatttcaaacaacaacaaaaaaatggattcttcgagaatgccctagccatggacaagcttctgcattacagagctcttgctattgtgttgctttgggtagcaatgcctgaaatctcagccaattttgggtcacagtaggcctatgtaaattatctaaaaatggattcattatggacattataaaaataaatctgacacctgagcctttgggcaaatataccatataaagaaatcataccctagaataacgattaacctaaagaacttaaaaaaaatcagtatgatatttttatcatcctttcttaaaattactgcattcagagagacctgatggctgaggacagcacctggggcagaggagtataggtcattgggatgtggcatcctgagtcttctagcagtttgctcttccagcactctcccttattatatgttctttacattgttctgtatgtcgctgtcttcaaacagaatagataagtctactagtcaagatagacatataacaggcaccacatgtgcataaaaattgcattatgtaaatttagtgccgtaatataatatgaaggatgtcctctaggaggaactggggaaagcatcacagacgaggacacatctgatctgagtgttggagaatgagttagttgtttaccaagcagaaaagggtggtggacagcatggcatgccaagtaaagggaacagcatgtgcaaaagcagagaatggcccccatcctgacccttgtaattttggcagctctttgctgatgtcctcaggcaatgcatctgggctcctgggaatagctttgcaatgtgaacagagtgacttcactatgggtagacctaaatgttctagcgtgctctgaaacttacctctagaaatagctccaggaagttaggtagcttcagagaggaaggaccaagaaatatgatcttataccacaggcaagaagtactttcctggaggtactggccagaagtactattgctatctctctgcacttgtctgttatattttagaatgaaatgtgcctgtgcatacaaatgctaaggcaagaaagaaaaagcaaaaggcaattctctttaaatctcctgaaataatttcaggcagctttttttacctagtcaaacacacacgcttaagaatggagttgtaagctaacttaatcattttttgttttgttttgctctcttacttgttcacacgttggggtaatcctgagaaaacaggaagcaatgaaagaaggattttattgtgaaatgttcattacaacttgtaattttaaaatgtgtttgtatgagtgtgcacaaatgtgaataaattttagagcactttctcacataatatctagtttaatcaccagaatatcctgcaacgttattatagttcctacattattatggttcctaaagacaaatgaaaaatctgtgattcagagacccaaggttaggctaataaatgtagaagtcacatttgaccaaattttagtatcttcccttaagtattggtaatgtacgataaacactatttggtaataatgaattattacaattactaaaacaacttatctggcagaacagtatcttaactatttgaaaaatattgtagtggatttattagcttccatttcatctgaagtccactttgctttactgcttactttatctttctagctactctgtaaaaaagttattatcaccctcaatctgccaagtataatgtatgtaaagtgaaataactagcatattgcaaagctgggaattgaacccttgtctcctaaatccaagtctgtagctgttcctcagcagtacactgtatctcatgttaatgccattattacttgtattaaatgaaataatttttccatcattattttcccgaattattactatccagagcgatttgaaggttaaggtcatccaaataatgtgtgaaaattgcttaaaatcaatctcctgtgcatggatgtctatgatgtatacaaatataaaacagccaaagtagtctcaagaagttattaccaagtttctcaaatagtgtctcaaggcgacattatttgacaagacctttggaataaccatttggaattttccttagttcagttgaattgtgtcatcttgcttaaacttttcagatatcaggggtagttttattgacattacaatggaattaaaatgacattttattttattttttaccgttctatagaaatggcattttaattcgtcattatttttattattgatctgttaatgttgtaatgacttgggttttagtaagggcatcctctgtaaaaattacctcctgggaaagaaatctccaagttctatgaggtctcccagaaatatcaccacttgaggtgagagtaaagtgtcatgaatgccacccaatgtgattcctggtagataagatttcactgttttatatcttgacatctgcattaaattccgttcttttactgggtcctattcacttccatcttgtgccattgttacttaaccaggctctgtagtggacaggaaaaagtaaaaacacgtcttagcccttaaacagtttatattttcattagaaattcaacatatgaaaatgcccagttaactaacaatataaagctttactgtacagcttctatttgtgaagtgactccatggctaactctatcagaagaaagagtttgcttggagccaaggtagtattggaaggttacagagaagaaagactcagggaggcagtggttaagcttgtagactctggcatcagatagatctgggtttcgagttttgattttacctcttaattctctggaaacttggactcaccaggataagtggcaacctaagttctttcagttttaaaatagagatagttatgcactaggcgtggtggctcacgcctgtaatcccagcactttgggaggccaagggtggatcacctgagatcaggagttcaagaccagtctggccaacatggcaaaaccccgactttactaaaaatacaaaaattagccgggcgtggtggcacacacctgtaatcccagctacttgggagactgaggcaggcgaatcacttgaacacagaaggtggaggttgctgtaagccactgcattccattccagcctaggcgtcagagtaagactccatctcaaataaatgaataaataaaaataataaataaatatatgaataaatgaaatagagatatttgtatcttaaagagttgttttcaaagttaagtcatgacaaaataatgacaaaatcagtggaagctgcaatcattgttcttgctattattattgaaatgaaaatatgaacattagctctgagggttctatccatagttttttttaaaaaattctgattataaaattttaattataaaatcccatatagctcatgctgaccatttaaaaaataatcttagttgtatccttgtttctttttgtatttgctaatagagattttagaattggcttggtgtatgtttgtccttgctagaattatgattccttttttgaatttgcattacacctttgttagaagtagaattactttacttgaactttgtcaatgtggcaaaaaatgattcatgtttatattatctctttgaaaagtagtgtttttactattgaactataagtacagttaaaatgtaaatgaacatttcagaaagaaactattgatttttattaattaaagaaattaattttccaaaatgtcagttgctacagagagattttagggattattaactacacaatctcagaaaaattaatttaattagggattttattttgggttccattcgtttttgagattcatattttggattaagccagtctcctgaaattgtatttaaacttagtctgcgtgtatgtcttttttagggaaagcattcacaacaccatcagaccctcgaagagattcttaacttacccattaagaaaagtaacatctctgtctaggggtcaccagtctctcaagccagttatattgttgctgcttgaataaacaaaacaggtttttatttctgctcttaccaacattactaggctgtgtttgtagcaaaaactgagtatgtggtggtggtagtaactacagtagaaagtgtaacgtgtacacaattatatcatgatacatggtttttaaacacattttatatatgtatatatttaatttattcacacaacaaatatttgcacatgttgcctgagctgtgcatgtgtaaggcagggcatagaaatgaatagggcatgggttctttctgctgaattagatggtaccccctcaccccccattttactgttgaagagagggaagcttggtggtgaggtggcttgccccagaccatacaggtaaaaagtagtccagagtagattcaggcataacttgtttgaaccaaattgtgttctttagactgcaacatgctttctgttccttagcatgtaactattaaccatgtatttttatttatttttcttttacgtgaatttaaaatgtcatatttgttctgcttctattactgcagtcttgaatgatgattcatcagtgcagtggcctattttagtgaaccacaatagcttgggtagaaagaaaaaagatccaacatacacaggaatggaaagcagccatctttttatagctaaaattgcaaacatctggcaattactctattctacctcccttcaaaaaagaagaatcatcccttcaactggagcctgccactgtgtttaatcaaggcagaaagcaagccttaaggagcaataggttttgattcaaggaggccattgcctaacctagttggccaaagtctcttcagaaaataccccatttagtgctccccataagctactgggttatataatgatagtaatggtaatatagcaattaataactgcagaaatccccttttgtttttctgctgtttcatttgtggtggctcttatggcagcttttatattgtgaaagttaattattttggtcagttttgcctgtctccatctgcttaagcttcttgtattccttaacaaaagattcaaccacatcgatacaaccaataattgccaacttgattttattataaacatgtccggtaaaatgctgaaggaacaaataaatttatttttaaagcctggccgtgatcttacagtcaaaaagtggtccaccaaggttatggctcctaagtaccccacccgtatttcttattgtgataattgtttgtgaaactagttcttccctcactggccaaagtcaacactgttggcaggggaagtgagaacagctggtggttcacagtatatgctgagaatcagaacttctgcatttttctcatggggctagtaccagcttttgctctggccttgaccaatgcacgtacctttctcttccccatttacctttctcttcctctaggtctctgaagagtagaggtggatctttcccttcccaggttgtgccaacattattaccaatgttcccttttgttgtagaatattttggtcagtaatcatcagtaatcgctaagtaacagaaaatcaaggttcgacagcacggttttcaaaaacaacctcaaatactataaatagtctgttttctagtgttagcagattatggtacatggaaatcataagcattcagtgggggcctttgagcttacattaaatgcctgccttttgcttttatgtctttgctagaactgtgttcaatacccaaagacacagctttttctttgatataataatttttctaggctgtctttcctgccagtcttcccaaaatcccagtgaagtttgcaaacacctcattaaactaaatgcagttttgggagagatgagattgtgactagggagttttctggtttttacaaaaagaatagaaaaagaaaaagaacaggaactcctaacaacctaaaatgcatgccttgtgcaatatagttatcccatgcagagctacatagtgtaacgatctctggaatctcaaatgaatgtgctcccttttctctgtcttcattcagttggatagttctggtcttcctccctcgtgtgcacatctttgaacttgaactactgtattacagccagtgttctaacctatatgcgtttctctttggtggccctgctaatatagaagaggttacgctaatgttccttaccatatttttctttttggtgtcttctttgtgtgtgtgtgtgtgtgtgtgtgtgtgtgtgtgtgtgtgtgtgttttaattgtactttaacttctaggatacatgtgcagaacgtgcaggtttgttacataggtatacacatgccatggtggtttgctgcacccatcaacccgtcatctacattaggtatttctcctaatgctatccctcccctaggcccccaccccctgacaggacatagtgtgtgatgtacccctccctgtgtccatgtgttctcactgttcagctcccacttatgagtgagaacatgtggtgtttggttttctgttcctgtgttagtttgctgagaatgatggtttccagcttcatccatgtccctgcaaaggacatgaactcatttttatggctgcatagtattccatggtgtatctgtgccacattttctttatccagtctatcattgttgggcatttggattggttccaaatctttgctattgtgaatagtgctgcaataaatatacgtgtacatgtgtcttcatagtagaatgatttataatcctttgggtgtatacccagtaatgggatcgctgggtcaaatggtatttcttgttctagatccttgaggaatcgccacactctcgtccacaatggttgaactaatttacactcccaccaacagtgtaaaagcattcttatttctctacatcctctccagcatctgttgtttcctgactttttaatgatcaccattctaactggcatgagatggtatctcactgtggttttgatttgcattgttctaatgaccagtgatgatgaggtttttttcatatgtttgttggccacataaatctcttgttttgagaagtttgttggccacataaatatccttcacatactttttgatggcattgtttgtttttttcttgaaaatttgtttaagttctttgtagaatctggatattagccctttgtcagatggatagattgcacgcttttttttcccattctgtaggtttcctgttcactctgatagatagttttttttgctgtgcagaagctctttagtttaattagatcccatttgtcaattttagcttttgttgccattgcttttggtgttttagtcataaagtctttgtccattcctatgtcctgaatggtattgcctaggttttcttctagggtttttatggttttaagtctcacatttaagtttttaattcatcttgagttgatttttgtataaggtgtaaggaaggggtccagtttcagttttctgcacatggctggccagttttccaaacagcatttattaaatagagaatctctccccattgcttgtttttgtcagatttgtcagagatcagatggttgtagatgtgcagtgttatttctgaggcctctgttctgtttcattggtctatatatctgttttggtaccagtaccatgctgttttggttactgtagccttgtagcatagtttgaagtcaggtagcatgatgcctccagctttgttctttttgcttaggattgttgggtctatatgggcttttttttggttccatgtgaaatttaaactagttttttctacttctgtgaagaatgtcaatgctagcttgatggggatagcattgaatctgtaaattactttgggcagtatggccattttcatgatattgattcttatccatgagcatggaatggttttccatttgtttgtgtcctctcttatttccttgagtagtggtttgtagttctccatgaaagggtcattcacatcccttgtaagtcgtattcctaggtattttattttctttatagcaattgtgaatgggagttcactcatgattcagctctctatcattggtttataggaatgcttgtgatttttgtacattgattttgtatcctgagactttgctgaagttgcttatcagcttaaggagattttgggttgagattttgggattttctaaatatgcaatcatgtcatctgcaaacagagacaatttgacttcccctcttcctatttgaatattctctatttctttttgttgcctgattgccctgaccagaacttccaatactatgttgaataggagtggtgagagagggcatccttgtcttgtgctggttttcaaagggaaagctttcagcttttgcccatttagtatgatattggctgtgggtttgtcataaatagctcttattattttgaggtatgttccatcaatacctagtttattgagagtttttagcatgaggtggtgttgaattttgttgaaggacttttctgcatctattgagataatagtgtgatttttgtcattggttctgtttatgtgatgcattatgtttattgatttgtgtatgttgaatcagccttgcatcccagggatgaagctgactttttcatagtggataagctttttgatgtgctgcaggattcggttttccagtatttttattgaggattttcacaatgatgttcatcagggatattggcctgaaattttcttttttttgttgtgtctctgccaggttttggtagcaggatgatgctggcctcataaaatgagttagggaggagtccctctttttctattgtttggaataatttcagaaggaatggtagcaagctcctctttgtacctctcttagaatttggctgttaatctttctggtcctgggctttttttggtcagtaggctattaattactgcatcaatttcagaacttgttattggtctattcagggatttgaattcttcctggtttagtcttgggagagtctatgtgtcgcagaatttatccatttcttctagattttctactttatttgcatataggtgtttatggtattatttattggtagtttgtatttctgtgggatcattggtgatatcccctttatcattttttattgtgtctatttgattcttctctcttttcttctttattagcctggctagtggtctatctattttgttaatcttttcaaaacaccagctcctggattcatcgattgttttgaagggtttttctcatgtctctatctcctccagttctgctcttatcttagttatttcttgtcttctgctagcttttgaatttgtttgctcttgcttctctagttcttttaattgcaacgttagggtgtcgatttgagatctttcccgctttctcttgtgggtatttagtgctataaattcccctctaaacactgctttagctgtgtcccagaaattgtgacatgttgtgtctttattctgattggtttcaaagaacttatttatttctgccttcattttgttatttacccagtagtcattcaggagcaggttgttcagtttccatgcagttgttcggttttgagtgagtttctgaatcctgagttctaatttgattgcactgtagactgagaaactgtttgttatgatttctgttcttttgcattttctgaggagtgttttacttccaattatgtggtcaattttaaaataaatgtgatgtggttcttagaagaatatatattttgttgatttggggtggagagttctgtagatgtctattaggtctgcttggtctagagctgagttgaagtccttgatatccttgttaaccttctgtctcgttgatctgtctaatattgacagtggggtgttaaagtctccaactattattatgtaggagtcttagtctctttgtaggtctctaagaacttgctttatggatctgggtgctcctgtattgggtgcatatatatttagggtagttagccctttttgttgcgttgctccctttaccattatataatggccttctttgtcttttttatctttgttggtttaatgtctgttttatcagagactaggattgcaacccctgcttttttttgctttccgtttgcttggtaaatattcctcgatccatttattttgagcctgtatgtgtctttgcatgtgagatggatctcttgaatacagcacactgatgggtcttgacgctttatccagtttgccagtctgtgtcttttaactggggcctttagcctgtttacattgaaggttaatattgttatgtgtgaattttttcctgtctatgatgctagctggttattttccctgttagttgatgcagtttcttcatggtgtcgatggtctttacaatgcgctatgtttttgcagtggctagtactgtactagttgttcctccatgtttagtgcttccttcaggagctcttgtaaagcaggccttgtgttgagaaaacctctcagtgtttacttatatgtaaaggattttatttcttcttcacttatgaagcttagtttggctggatatgaaattctgggttgaaaatgcttttctttatcaatgttgaatattggcccccattctcttctggcttgtagagtttctgcagagagatctgctgttagtctgatgaggttccctttgtaggtaacctgacctttttctctggctgcccttaacattttttccttcatttcaaccttggtggggtaacccaatctttctctctggctgcccttaacattttttccttcatttcaaccttggtgaatctgacaattatgtatcttggggttgctcttctcgaggagtatctttttggtgttctctgtatttcctgaatttgaatgttggcctgtcttcctgggttgggaaagttctcctttctttcagagatgccctgcccagagaggaggaatctatagcggcagtctgtctacagtgcctttgtggcactgtggtgggctttgtcctgttctaacttcctgggggctttgtttacactgtgatgggaaaaccacctactgaagcctcagtaatggtggacgcccctccccccaccaagctggagcatcccaggtcaacttcagactgctgtgctggcagtgagaatctcaagccagtggatcttagcttgctgggctctgtgggggtggggtccactgagttagaacacttggctccctggcttcagtcccctttccaggggagtgaacggttctgtctccctggcattccaggagccactggggtatgaaaaaacaaagtcctgcagctagctcggtgtctgcccaaacggtcacccggttttgtgcttgaaacccagggccctggtggtgtaggcacccaagggaatctcctggtctgtgggttgcaaagaccatgggaaaagggtagtatctgggccagagtgcaccgtttgtcatggcacagtctctcatggcttctcttggctaggagagggaattccctgaccccttgtgcttccagagtgaggtgatgctccaccctgcttagactcaacctctgtgggctgcacccactgtctaaccagtcccagtgagataagctgagtacttcagttggaaatgcagaaatcacccaccttctgagttgatctctctgggagctgcagactggagctgttcctatttggccatcttcatcctaagtcccatatttttcttttactttgggacttggaatctacaaatgttccggaatacagacagtattgtattgcagtggactttacatgtttatagtggttctctatcctcttaacactggtaataatcacctggggaacttcaaaaaatttccagtcttgggtctcaccctcaagtattgtaatgtaattgctctgggatgggcactatatatatatatatattttttttttttaacactatccatttttagaactgctaaggtaggccaatctctcactgatgcttgaattcatataatcactgtcaaggtgtttttcaggcttatattgagtatttctagtgcaggaaactgaaagaacgctttctgtcttaaggaagttctgattttttgagagatcagatttattattatttaaattctgccttcataacatgagattatcttttagtcttataaatttataatttctagccatggagtttagttagtacttaaaattgtaactacctgcccttcaaaaaaacaaaaacaaaacaagaacaacctgatcacgtctttataattgtgactcaatcctcatcagataggacctttctgttcttcacttttgagttataaatcctagggaaaggaacaatgaggaacaattagacaaagaaataaaataagtactttctatagtgagacagcactagagttaccttgttaactagactgagagctggaactctaagcctttcatcattatattgacaatgtgtaacgtatggttaagttacagaagaaacattacattattattattgaataagtaataattatgagttttattaagagggcccagttcaatttatatgtgcaaaactgatgcccttaattgtaacaatactttagaaatgatagtggaagtaagttccttttgcagagaaaatgcaccttaaaatgcctaggcacaaatttaatgagatacattgttctatatcccaataaaaacaaagacaaagccaaagtaatgacctcaaactctctagaaggacacgaggcttaatggtaacagtccctgatgcaggtgggtcctcttaggcaatcttaggtttgcattggccttactatatggtgaaagtgagcatatgttttatttatgcatcatccattttactttagattgaaagtatttccccatgttttggtaaaacctgctgctcctgaaacctacctttgttcctagtcctgcccttataaattgcaaaaaacaaagccaattcatcttgcttatatgagcccgtcttccctttcataatagagatatgtccttcattctgactcgtcttcttttctttaagcggaatagttccactgcagagtctcttaattatttaatgtagtacatccggaaagacctcatttgtaaggaccaagaactgaaaatattgctattgaatgcagaaagggaatggtaaggttctctcagagaattccttttcctaaacaaaggtgcaattgccaggaagcaccttcacatttttctacaccatgtcaggcttccttatagcactgttatatgtggccgtattatggttgacattaaaaaatgtgtgtatttttgaaagaactacttcctttattttaaatagaaaagaacacagcatctctgagagtgagaagatcaaaaataagttaaaagcttttcttgtgattagattaaccagattgattaggacaaatagggtttatctatagcttaataaataagttattatttcctcaaaatttagacttactaggcctaaaggagcatagaggtctttagacttaataagtctaaattttgaggaaataagttggaaaaactagagttcagaatgagtaatagtaaaggcaaaactaagattattaagaaaattatcagaatttcctatgtgatttttttaacaactttccctggcttatattgtacatgggtttaagttatcttacagctctttaattatttttaaaagtaggatagcatgttatcttccttctctctgtctataccaagtgtttgttatttgagcattacagttacacaccaccactatctggttgtaccgtgactgaaatatcagttaattggaaaagtgaaaaaaactctttaaactcaacctatacaattaagatgatgaagtggcagcaatcattgcactcttttacttacctgtgtgatttgttataccatgtgtttgtttagaatgtaaataatgtgcagttagagtaatagatgcagatgactgaacatccttagacatctggagaagcagcactggcaagattatctctgaaaatttctgaaaatctttttgttgcaacctgagaaggcatagacataactgaaagcccaatagtaaggccaagttcagtaaagttgaaaatgctttacaccatcactgatgatgttgagtcttccccacccagctcaacattgagattttttttttatatgtagaagttatttgttccagaatttttcctttaattcattgaattattacataattaactttttttttctttaggatttcttggctctcaaatacttttactctttttagagtgctacagccacagttttcttaaatatagggatttttgaggtatcatattttgctaatggtaagtttatagtattcctaagcagcttatctcatacagttttctctatattgaatatgattcagatgaaaattaacctgcgtgaaatggttgtcatctggaatgactgccttttaccctagaaaacagccagcccaaggttgagaacacatctgagaaactgtgcctattttgagaactaccaagaaatttttattcactggaacagctgccaggaaacttgttggtcatagaccagtgccttagttgggcatttttttcagaagtagagaaaggcaaagctagagtcaccgagggattggaaggatgaaagacgtgtagttgaaagctgggcaccatggaagaccgaaacactcttcaaacattctgttttcaagaataaacccaaccctaggagcacgagacagagtataaagagccatgatttttagcgaagacctcgcatttatcttaaaatttgattttgttgtgaatataatctcagaattatgcagggatggtccatcaaaaaggtctgccagagtcaagctgagtttatcttagccatgctgaaaagtaggtggcagtcaatcaaaatggcaattactgtacaagacaagagttcactggagggaagggtgaatggaaaggacactccctgcattcttgaggcctatgtaaatcaacaaatgactctgggttagtttccacaattgtaaaacaatgtgattgaacaatattgtttcttcacttccttcctgctctaagattgtacaaaagtatgattcaactacagatattgcataaaattggttactcctgaagtgcatggagtaaaattgttcccatagaatatcgtgaatttagttaggttgtgacatgggtcatagtctccgcagtctgtacgccctcagtatattcctctgacaaccccatgtcctttcattctaagctaatatccttacacatctttttctctacacctgagcaaaatatacattcatgttcttaagtgcatgtagttaagaggaagctaacacttaatttgttcctgctgtatgccgggtatctggtatgtcatcttcatagcattatttgaagtttggtactaatatttccatttttcaagtgatgaaattaaggctcagagagatagtaagttgcccaaggcatcatgacttacaaagaatggatcttagatttgaacacaaatatctctaaatccaaacttcatgatttttctactgtatttcatttgctcacttccaaagtctatacaaaaatatttgttaaatgtgcatgtactgagctaccgatatctactatatctgtgtatacagcgatagctatcaaaaggagagacgtcctctaaatctttgataaaagtatgtcaaaatggaaccctcccagaaggacttcatttttaatagaaatcagagtattagctgaaggcacgaagttctaagataaaaatgtagctatgaatcagggtggattcagagaggtctttgtgtgtatgctataggtgatcatgtgtgaatttgacctacggcaagaagaattttttttttttttaaagctcttccaggttatccttgtgttggggaggaggatagaataaagaaatgaatgtcttgctggttcttccaagttgtatgaggataatatcacccagggatgatatgctagataaagacccaggatctttattactttttgacatttagttttgttgttgttgcttaaatttctagtctgttttgatggcattagaacctttaaaaggagcttgtaaccttttctttttacttttcctgaaatgtgtggatgggaggattggacaagagcctcaagggatgggaagaagagctcagtgcgaacacacatgcatttattcatttagcaaacatccattaagtgcctaggacctttaaggtattctgccaagagctgtgcaggataggaatgaacaagggatgacctttgctttggctatgtacaccagaaaaacgagcaggggctggaggactcttgccaagaagctatttagtggttctcttagagccttatctctatctaggctggagattaactcagaacatttttttagtctgtttacctctaaaatgaaaagaaatatatattaagaataaggaggtggcgtggagctttcactgaatgtatttcaactggagtattgaacgttatagtgatggatacagttaatccatcacaaccaccatttcaaaggaaagtggggaaatcctttgtccctgtgtgaaaaataacttaggaaattttggtctgacagttgtgagagggttaagaaagtcaatcattttgtaaccaggcacagcaatcttgtatgaaccatgtcaggatgttgtctgcatgccgtctttgctgatcacagtaatcgggtcataagagaaagggaagtaatagagtgtctcttagcaaccaaccccaggaaaaagaaaattactcaaacccagccatccagccagagaagtagaaagaaaaaaatattctgatagtttgctgaaagagctcagggatgagagagagagaaagagagagagacagaaagtgagagagagagagagagagagagagagaggagaaaggagagagagaaggagggagagagaggaaagggagaaagaggagaaaataggaaggagagagagagatgatggagaagagaggccagagagaaagaggaaggtatggagagacaggagggagagagagagagaaggaaaagaaggaaggaaaaaagcagaaagaagtaaacaaaaaactgaaaccttttatttctttgttttcctttctcttggtgttatctttttttaaaatttttatttcagaaagagagaaagaggcaaagagtgggtgaggacaaaagaaaccctgtctcctaaaacaggaacttgatagtccacatcgtgagagaaagtggggagggtgaatggtagtataacttcatcgtgtcccatgtttctcatggtttccagttgcgatctggattactgttgagaagtaataggaagacgaagtctacagatgctgtgattagtgttctaagacctgtttttgaattctctgcttgttaatcgtgtagcagtcagttctacagcttactgcagtctttatagtaatgactttcgaactttgttttttctgacataaatagtggtaagaaacacatagtacattgacaagagcgtatatatgtacatgtcaatgtaatatatattgtcaatgtaatattatgctaagtgaaattttcatatatagatatatatattttttcatatataggctctttatgtgatgcatactaatgttttctattcaatttcattacaaaaattcttttggatacctgctgaattgattgtatgaccctaatgagttacattcttccatttgaaaacaccagtctaggatcagcacttgccttacattttgattttactagagtggtgccaggcagcaagttcagtcttggtgaagagtctttggccagcactgtgatgttcagaataacagctatttaagctaaatattttcttgtcatctgccaagtagatgtatcctaagagtctgtcctggtttggaatttaaggggataaacctgaggcaattccccctggactatcttcagtttagaaaagtgccacagtgtgttcaagaagcaccggactggactcaggagacttggttgcgcttgatggcatccttttctcactctgagcctggggtcaatgatggatcgaattagatgatgtcataaattccttctggctgtaacatcttggaatttatagctggatggggctccagaaaccatcctgtctaatgtctttgtttccaagatttagttcttgaaaaggaatgatagacttcctactttctttaaagatctgtgctaggaacaagtatacatgaaagactgaagcttagtacataacttcaaacatctcagtgtggtataggagtataccatgcgcacatataaacataattcgaagaaaatatataatttgttaaacactacaggtagggtagaagtaaaatataaaaactcagaaaaatgataatttaatcttactgggaagaatgtctgaatgctacactagtatataaggaggaaggctttgctgtggactttgagggaaggaaaatattgataataataggatgttccgggtagattaaatgttgtagggaatcaaagaatggagtcttaattgtctcctttgagttctgttttttgacctcattgaactcacaagggtttactttttaccactaaatattcctattattttatagctgttttttcttccaatttaacatgactttttaataatgatccattgcccacatttagtgataaggtgaggtttgattaaatagtatttgtacagtactacctcctacttggagacacacgtttatataaacacaaggtgttatataatttgtttctctgttggggggagggggaaagtaaataaggaaatataaattaatacctgttttcttttcaggataaataatatctgaatatgtttctttttctttcttttttcttaatgcaggctttatttagtttgattttacctttagaaatttataaaccatggaaataccccacatttttggggatattggaaataatctctgtgatgtcactttctgaatcagactaaggtttgtttattacatcagttacaggaaataagtgcataaacctgaattaatctgaggatgttgtgtttgtaatgttgcttccattttgtccctttccttgaagcttgaggcacttgcacatctcactcagtcttccttttctctacagctttcctgctgtcctaaagagacaaaaggcatatggctttctccagctgcatttcctgacctgtttccttgccatagatcgcttctaaagcaacattcccaccatttgaacttccattcttcctctgtcccaaacctaatattaacaataacaggagccaatgcaatttttcattataatatggtgttttacattcatagcacacacattactttatttgatccttggaactcgtggatatgtaaatggcaagagttactcttccattgtgtagattactaaaatgaaatatctagaggtaatgtcacctagtaccactgactatagtgttgtgataccaataccagaataacagggctcctgacttctgacccaagggagataaggtggatcatcttaaggttatggctgatatataattgacgttatcagttttagtaaattttattttacacgaagaaactgaggctaaaagaaacggagccactagtgcttagggtgtcaacatcagaatcagatctttgattcccagatttaacatttcctagattctgtgttctaatcatctcaatggacagtgcagatattacttgagaaacatgtttgcatttcgtgaacaactcctgtttattttcaacattttctatgtataaataatgtttgtgtaagcatatatttacttaggacccgatatctgttcagtactgttaattgccttgggagaaaacaaaagcaaaaatgtaaggcctgggatttctatgcaaaaggccaaaaagggcttttggtgagattttaaaaatagaaaaccaattagaaaataattaggtgtatagtggtaggcccagacttgaatttcagtatgaattttgaaaaagaatatatattttaaggcctacaagggcaaaagtagatgggctttaaagtttgtgtaggtaagattgtctgtgggtgaagatgggtagtgggatggtgagcaggcagagtggggttggggtgtggggtggcacggccagctttaatggagacaggcgacttcgatggggggtaggacatgaggtgcacagagcaacagttttcagaggtgcagtagggatgatccaggggatcagagaggaaaagagtaaagactctgccaacctttcagcctggagcctagagccacagtgtgagttaaagatgtaaattccttggaattaagaaccataccttatttagccatttatacagctgcttaccatggtaataattagaaattaagatgatgatcttttatgtgagcaactttcctaaataacacttgatgctgctgataaatgagacttaggtacagtgctttttctgtaggattcaggcctaaatggatctaggaggatactagagcttccgttccaaagtacgtgcatttgaatgatatgctaagtaatgccttgtgtatccttcaacaggaaaagttcctgctattaggataatttgatatgcacttgatgtttgctaatatgtttcaatcacataaatccttcttggatatttttgttctttgtggacttcaggtaagtttaaagatattccacacacttaaatatgtacacaaatgactttataacaagaaagcaaatttgtttaaaaaacaaacctacaattctgtctctctaacacatcaactccattttctctgtactcttttagtctttgccaatatatgtttatagttttcataatatgtaactaaagatagacataattttgcatttttttcacttaatactacagaataagaattccccaccatcatatttagcaatggcattatagttcttgaagtaagcatcccagaatttattgaactattgccatattactggtcgtttgtgttatttcactgctttaagtgtttttatgttagagaacataatgaaggtcttcatgggtatagctttttgagaagctagacatgttgaagaaattgggagcatgctattactagcttctatgaattggtatttactatgtatccctttaattaaattccattctgcagtaagtgtgatagctttgccgaagcacttgggggccaaaaggacatttgtaactggttaagttggaagatatttatttgtataaggtgggtagggacaggatggacaggctatttttcttggccacactcactgaatttaaataggcaatggagataaatcagttgtggcccaactagactgcctggatataatatccttttggactggatcatgtcgtttcattgcagtcaggatggctaagcatggtgatggatcataactgaccaaacagacaggttggttagaatgtatgaccagtcatagctgtgtaactgaggaactgattatattcctgtgactaatgaaaaagcccaatcttagagtagctgtggtaattataatgagaatactagtaaaacattttaaggtgttgtgttccagacactattccatgcattacacacacacacacacacacacacacacacacacacacacacacacagtctcatttaatcctcataatattatgaggtagtgctattattaatatccattttctggatgaggaaactgaggccccaaccagtgaaataacttgctttgagtcccatattaagtagtactacccaggcaacctggccccagagcttacttacacgtgtagtaactacactgttcttcccatttatgaggtgattaaactatggaggcaggcatggcatacctgcagaacaggactagaatctcataggtttttgaacttattaggcagacctaaggttttttacacttcctgaggctatagaacagaactaatctcttagccttaatgtcactataacgtaaaaaccacgtgaagagaattacgatggtgagcagaggataggacacttattatagttgttacctcatttatttaattctttgtttcttagagaataagattctggtacatagcaggttcccattaaatacctattgatttaaagtttaaaacaaggaataatggctaaatgaatcattgaatgcatatgtctatttcttggaggtctaatcatgttttcaaaactttggctcaactgtagttagtgcagagtatgtatggtcattctgctagagcaaaatcttagtataggattaaagaactctgcaaattgttaaaacatgcaggtacactagtttcaaaatgtattagtttgatttattattgtcattttctgataaagaaaggggagtagtctcccctaaagtttggtgattaagtcaccagccaccttttctattttggttgttgtggtaattggtgtttcctggaaattttccctctgttctattaataatgttaaagggggttacagccgtgactcactccaggaagtcaaccatcattcgcttcctcaatctcaccaaccagtccccatgtacaaaatcagcgacttctgcaaatgagttactttacagctctcaagagagttctagaaaatacagcttttgtatttcgctgtgtgcttcctgccttggcagagagtaaaacaaaccttcatgttttgctccttggtagtctcgagataattgaccagttaggtaactagtgtagtctcactcaagagaaatcccacttgctgtctaacaaaagtcccttggcactcagatttgcaaagttaaacctggggacagttcatgaagtccagtggagtctatacttcttttatacctggctttatgtttctgtattcattattttgctcaatgtttaattaagtaatgaatattttaacttgttcaacatataactccgtatgtcttagcactgctgtgtagtagataccatcataggcactgaggatgcagtacagacatggtagctgcccttgggaaccttctatcctagttattgttcactatattaccaagttaaccacagggaaaacaagttcagagaatacataggctgtgggcctgtcctaaaggaatcaatctgtaaccgacatgtctaaagttgtgcaggataggattattccacttaattctgtaatttgttttgtctggaatttatctcatctatgcccccaccctcactcatacacataaacatggagatggaacttaactgtgcattctcgtggtacttaaatttttgtaccttggattatcaaaatttttgttcatgtcctagcttctctgcaagttctttggttaaaaccagtgtgtgacacatctctggatcagaaatgtcttcctttctacctttcaccttccccaaccttcctggtctcctagcacagtgccagatgaatgacagctgtttagtatgtttggtaaatgctaactgtgtgtgatcttagaaaagttagtgaactttgctgattttcagtgtcctctttcgtaaaaaagagaataataaccatttctacttcctaggttgttgtcaaggttaagtattatatttaaagtttttttttagtagtgactagcacttagtaagcacttactgaatgttatcattaataaatgatcttacaaagcagtagcatttccttctaggatttttttgtagtccttcatgattgatagagaagagacatgcagtctaggatttcacatcagctttttaaatataggaaaccagatgtaaatatgctgcttcggttatttacatctgacattcttgcatgcttgctgacaaaacattaagtaaaaattatgctactctttcccttagatgtcaattcatggtcacattaaagtcacaagatttttcctgaaacttactgctggtaccaattttaccataggttatcttaattagtatcatcacacagtggtgcagtttgacctttggggtttgattccagtcctttgtttattctgactgtgaatggaggagtcaggcagaatgacctttacatatctttacctccttctcccatcttctgctggcatagaaaactttgcataaagaaaggcaacagagcaactgcaaaattgctgggattaaaaagaaaattgtatgataatgagaaatccagtgtactctctctcccttaatatgtgtgtgtgtgtgtgtgtgtgcgcctgtatacatcagatatatggattgatgcagtgtactctctctcccttaatatgtgtgtgtgtgtgtgtgtgcgtgcctgtatacatcagatatatggattgatttctttttgtttataaaaaatattcacttttcaaaatgtatttatactatgctatcattgaattcttacatatcaaccctttgtggttgacactgcagagatgatgagctccattttataaagatggggcagttttatctcaacaactagtgtgttctagatcaaggactgattccagattctcaaagtcctacaacagtaatcttcaccatgctgtgtgtatgcgtgcgtatgtgtttatcagaatatattagaagataatttgcaagcagggattggttaaagttgaatgtttatgtattcttttgtagtgttgcttacgttttaaataaaaataaaactgcagtggatgtgcatttgtcatcatttagaggccttcagaccccaattcgtagtttcttcacagttgcctctattttctgattactagtccctggaaggtacagtgtcagagttgaagggatgttctcaaatccccctaaagttttccattgcaatactcattacagtttctttttttcttttcttttctttttttttttttttttttttttttttttgagatggagtctcgctctgtcgcccaggctggagtgcagtggtgtgatctcggctcactgcaagctctgcctcccaggttcacgccattctcccacctcagcctcctgagtagttggtactacaggcgcccgccaccacgcccggctaattttgtttttgtatttttagtagagacggggtttcaccgtgttagccaggatggtctccatctcctgacctcatgatccgcccacctcggcctcccaagtgctgggattacaggcgtgagccaccgcgcccggccgcaatactcattacagtttctaattgcgtatgtgtgtaaaagaacatataacttcctcacagactcagctgtacactctacaggggcatcattgtatcttaggggtctagcctaatggctggtgggcactaggtgcttagcaataactattgaatgaatgaatgaaaaaatgaataagtgaattcaacacaacttttatttatttatttttattattatactttaagttctagggtacatgtgcacaacgtgcaggtttgttacataggtatacatgtgccatgttggtttgctgcacccatcaactcgtcatttacgttaggtatttctcctaacgctatccctcccccagccccacacaccccaagaggccctggtgtgtgatgttcccttccccgtgtccgtgtgttctcattgttcaactcccacttgtgagtgagaacatgcggtcaacataacttttaaaatccagaatgtcagtactaaaaggagccttttaagtattagaattcaacttaatgaaatgttgctacgtattttctctgttctcatcactgacgtagctgctttggagcatctatatctgatatttagatagtggatggcttcttgcaaacacttacattgctcacgtagtaatgtgaaccaacagattggtggcccgggcagcaacatattttctataatctgtagcatgaagccaactgaggtgtgaccgtggtatttcctgaagtggctttcttttgcttttctgttttgattattatgtggctgtggatttagttcacaccatcactgtgaagaattttcgaaacttaagaatcaagctctgtttatacattttcaacgtaagcccttaattacagtcactcctcgggcccagtgattttacagttacatgtcagattgaggggtttcgtcttgagaatgtcagctggctctgtgaagaagaagaagagcagatacgtgagttacccagaggagtgctgattgagtccaggagtctttctgtttaagagcacgttgaaagagtttgtgtgtctatttgtaaaaccattttggagatgataaaaagcattctgagacacacaaattttttttctgttttcaaaggcaagacagagacatgtggacaggttgatgaagggatcattgtgatcttttctctcagaacttgattttcattacttgaactttgtcttctatgcttttattaccaacacctgtacacaaaggtacacataatacttgcaaaaaagagaagaaactgttttcagactggggctctattaagtgttcattgaccacaatctacaacaacaaaaatgacaattcctgcttgccattgaaaataatgcaattgaaaagaaagggcggaagcaagttcttggctgcatagcttcagtctgatgccatattctagagtgaaaaggtattggcttggttttgaggcctgccttcatcacgtgaaggctctgtggcctggcagggttatcttacgctattgaacctcagtttctccatttatccaatagagatggaaagtattggcctgcatttatttctccttcaaatgacatattgtatagaagcgtatcgtaagttgtaggtacttaacaaacatgaaggactgttatgatctcactttctgggctaaggagaaaatggtgggatgagtttcatgtccttttctttgtggttttgactccagcagcttccaaacgacttttgctgatgtttcctaattagcaatgctgaatctcgtgttgtatcaatcctccccattccttaagatggaaacaagtgttccagttatagctataccatgtgcctgacaggaaagaattgggttgccatcagaaccttaatttatcaatctcagtggcttaaaattttgaatttgcagcttaatattattcattaacaaagtatttttcatcccttagctttcctccagggaacaaaaggaaatggtacacactagctcttctaacaggctctcattcaataaaggatggtgtgcccttaattttgttagcatgtgtataaagaatgtacttttagtggacatgcttcactttgcaaatatagtgcataattttcaaatacatctttgactcttcctcaaacctgctcagaagctgtgtttttcctctcttcattaaaatgttccaacctggaaattttctctttacaattcagatatttttcacttcttgggaagggaataactaaataatttcaatactttaaactacaaggatgatgtatttttgttctacacagcattgatatggtggagctgtattctttttctaataatacaaataatatagggctgtaagggtttgtatcattgcatgtatatgttaagaggataagaggtatgtataaaagtaaattttgagaaattataagtataaaccaaaaagtcttatacctttagcaatgcctttaaatcttgaacttgaaagaaaaagttatgcccgactcgttgattgcatattaaataggaaaatacatttgttatacttgaactagattgttcttaggattttgtgaaagaaaatatataagcatgaatttattatagaaaataaaaatgaccctagaagaaaacctaggcaataccatttaggacataggcatgggcaaagacttcatgactaaaacaccaaaagcaatgccaacaaaagccaaaattgacaaatgggatctaattaaactaaagagcttctacacagcaaaagaaactatcatcagagtgaacaggcagcctacagaatgggagaaaatttttgcaatctgtccatctgagaaagggctaatatccagaatctacaaagaacttaaacaaatgtacaagaaaaaaacaaacaactccatcaaaaagtgggcaaaggatatgaacaggcacttctcagaagaagacatttatgtggccaaccaaaatatggaaaaaaaacctcactatcactggtcattagagcaatgcaaatcaaaaccacaatgagataccatctcacgccagttaaagtggtgatcattaaaatgtcaggaaacaacagatgctggagaggatgtggagaaataagaatgcttttacactgttggtgggagtgtaaattagttcaaccattgtagaagacagtctggtcattcctcaaggatctacaaccagaaataccatttgacccaacaatcccattactggatgtatacccaaacgattataaatcattccactataaagacacatgcacacacatatgtttattgtggcactgttcacaatagcaaagaattggaaccaacccaaatgcccatcaatggtagactggataaagaaaatgtggcacatatgcaccatggaatactatgcagccataaaaaaggatgagttcatgtcctttgcagggacatggatgaagctggaaaccatcattctcagcaaactgacacaggaacagaaaaccaaacaccgtatgttctcactcataattgggagttgaagaatgagaacacatggacacagggagggtaacatcacacaccggggcctgttgggcagtgggagactagggagggatagcattaggagaaatacctaatgtagatgacaggttgacggatgcagcaaaccaccgtggcatatgtatacctatgtaacaaacctgcacgttctgcacatgtatcccagaacttaaagtataatttaaaaaaaaaaagtaaaaaagacattgattcattcattcatttattcaggcaatgtttggaactcatgatgtgccaggcactgttttaggaccaggaataagcaatgaccaaagtatttgctctcctgatagattataaacaaataaatatataatagctcaagctgtgaaagtcacaggcacacagagacacacacatctccaacatatgcagcaaggtaatgagataaagaattcctggccattttttgtgatacaggatagatgtaatggtttcctatcagttttatcatttttaaggtctctcttcttagaataaattattttatttgtttcttccgtatgccatttaacagggaggggaagttttctgccagttttgcacccactgtttttctttttcagtaagagccttctcatagtctgcttgaaggcagcggtcttgccacatgtgttctatgcataataatttcaggagagtcttgtccacaatgcttggttgattacggcttgtgggacaccacttaaatgactagaaacagctctctttaataaacacactggtgttgtccatcattttaagtgagcatgagagcccagcttcattttgccactccaatctcacacggcctagaagaactagtgaaagtagcaggtggtgtttgactttcagtttttctgaaatgtgtctctttctgccactctccagacgccgtgccagtcaggccctcaaggtcaaaacatcatgaaattgaccatagattatctcagccttttctttttaaaagtgtcattgtaacctgttggttactgtgtatgtcatttaacttctctgtctttagtttctgaagtaactggttttacattgccatcaaaaggcttctgtgggtttttatttttctttgtttttatttgtttgtaaacaatctccttttctaaactcatttccccaaatttccttaatttttcacggactgatgaaaatgttttgctgcttccagagcttgtcagcttctctttgtggcattgctttcattgttgttctccaagttcccactcagctcctgctttcttcaaaaaaccctttggtttctaacatctatgttttcaacatggcaatggagtgagttgcccagggaatgattggaccgtgattgttttcatggctttcttttgccttttctccatgtcctttttagctctaagcctcatttgtaagctttctagaaatgtggattctattatagaacttctgtttttctcatttttgtagttgctttctcaagagcaggtgctggtgaccacaggacgagtgagagacgagatggtgtctctcctttagcagttggcttaattaaggaggttttttgaagtgtatgggcttcaaaaagtctgacatgtgatttgtggcctgtgtggtctaactctgattcctttggatacagaaccttagaaagccttgagaaaaacctcagagatcatctatgcaatcaattctggctttacctggagggagttttataaaacacaaatgccagggcttcaacttgagagactctgatttcattgttttgcagtgggtctgcacatcagtagtttatagaaatttcccacatgattttgtgaaaccagggttgagaatcacttgattttacagggcatatataaggtccaaagcaaaagtgactcttggctgggcgtggtggctcacgcctgtaatcccagcactttgggaggccgaggtgggaggatcatgaggtcaggagatcgagaccagcctgcccaacatggtgaaaccccgtctctactaaaaatacaaaaattagtcaggcatggtggcaggtgcctgtaatcccaactactcaagaagctgaggcaggagaattacttgaatccaggaggcagaggttgcagtgagcagagattacaccatagcagtccagcctgggcgacagagtgagactgcctcaaaaaaaaaaaaaaaaaaaaaaaattaacctgtcatggtggcatgtaatcccagctactccagaggctgatgcaggagaatcacttaaaacccgggaagtggaggttgcagtgagccgagatcgcgccattgcactccagcctgggcgacacagcaagactccatcttagaagaaaaaaaaaaggtgactctccgggattctatagcagtatggccatagagtagggacaagaacatatgcctcctcatttaccatcagtgctatttctattttgtttactaccatttactctcatttgattgtgtcaaattatctactgttgtactggggggccagagtggattcccaagcctcaaccacatagaagagtagattggaggttgttttcaaactattcaacattatcagtgggttgaatttgtaagctatcaactcaaaatataaagataatttttataacagggtctatattggattgtaaaaagagggtcataggatttggatctttagggctctgtaattcaaaatttgggatgttcattaggactatttgtgttatgttgtaaaacaattgtacttgttggcagacgtcttgggttcaagttatgattttgcatttaggaggtttgggaacgtggacaaactcccttttgagttttccttcaccccgtctttgtaatggagataatattctcatttccctgggtttttaggaaggttacctgagatgactcgtgcaaaagctaacacataatagataataatatctatctatattgagatatctatatttagataaagatatctatatttagataaagatatctatatttagatatctatatttagataaagatctatatttagatatctttatctaaatatctatctaaataaatgttaatttattctgaagtgtggtaagtttatctaacatttactgtagcaaccaaggtggggctaaatatggggaccaatcagaaagacgatctctgtcagttttgcctaggacgttcagtgggacttgggtaggagactgtggactaatctcacctctggaaatttgtgtggcctgtgctataactgagaggaaccaagtaagcctgtgtatatggcaaatggtagtcctctcccaaacaacatttgtaaagaaaatgcattttgcactatttcttagtgtgtctgaggctttttatgttcataaaaatcttagtgagttgttgaaacgtgcttttctgaaaaaccttggaatttacctggtttagaattagaatcagaaatgtgtctttttaaactgtattctaccttcttaaatcttttgccttctgcagcaacatggagcaactctgatacttttttctacttgagggcctttcgtagtcagagattatactaagatagcaaaaaatagaaagtgacacactagtcaaggttggtttattgtgtggtaggaaatccaaaagacgttggaagcaacaacaatagctctgaggtccttggaaccaggagttttgaaacttttactttactgcacgtctgttgacatgattccatgaatatttctgctctttctcccttatgtataccagatccactgggctgagttaaatataagaccccaagcatggtcaattcttattaatagtccttgaagaggctctctcttgtttttgattgactttctttttctttcttttcttttcctcatcctttctccttcttccattctcccttccacctcacagaagcctaacgggcttggaatagcacttataaatgcatgaatttttagaaatatatactattgttttcatttccacaataatcatgcctaacatttatcagccacttcccatatgctaggctctctttcaagtcctttaaatgtaataactataataatctcacaacaaactccatgagacagggactgttatctagtgtgttttatagattagaaaactgagacacaaagaaagtaactttctaagctcacatacctggtgagtcagtagctgaggcaagatttaaaatcaggcaatctgactgtacatctcactcttcgctactttgtccttgtgcctttagatcatggttctgtgctatcgatctgatcttatttcttactctttttactactgttgttgctcagcatagtcttcccccctcaaaaataagtaacatttatattgctattattattattattattttgagacagagtctcgttctgtcacccaggctggagtgcagtggcacaatctcagctcactgcaacctctgcctcccaggttcaagcaattcttctgcctcagcctcctgagtagctgggattacaggcgtgcaccaccacgcctggctaatttttgtatttttagtagagacagggttttaccatgttggtcaggctggtcttcagctcctgacctcgtgatccgcccacctcggactcccaaaatgctgggattacaggtgtgagccaccacgcccaacctgtattatgaattataatacatagataacgtgtaaatatttaatgtcacatattattcgtgtgagttagatttgtaaatttgattagcgctgagacattggtattagttttttctacagatgagaaaacaattacatacttttacaaatgatacaaatatgtgtgaaatatatttaatcacatacatgaataatgctcagtgagcaggcatagaattgtcaggacctttgcagtatctccaatatataccctgcccatagattaggaactattgctgtactattgctcatcagtttaaataattatgttaattcacatttatctatatgatcagcataatctttcaaaaatcgatttacaggcctggtgcggtggctcacgcctgtaatcctagcactttgggaggccgaggcaggtggatcatctgaggtcatgagttcgagaccagcctgaccaacatggtgaaactccttctctactaaaaatacaaaaattagctgggcatggtggcaagcgcctgtaatcccagctacttgggaggctgaggcaggagaattgcttgaacctgggaagcagaggttgcagtgagccgagatcacgccactgcactccagcttgggtgacaaagtgagactctgtctcaaaaaaaaaaaaaaaatctatttacattgcagctcctttaggaggtttactacttgtaatactgtagagtcttccagagtgtgcatccattgtatttcactgattgatttcgttagtgatacacctcaaagtgaggtagtcatatacctccaactcttggctgccacaaatgtactgtcgtgagcattttgtatatgtgttcttaatgattggcagaagttagctcaggatttgtggctgtggggagggtgcttgatcatagtgcattttaatattgagtttcactaggctctgtgttttttgttttttgtttttgtttttttttaaacataaaggcttcactagggttactttcccccagtaaagcattaggattcttgttttcttcatgccatcaccagcacggggtattgcatgactttatattttttgctaatatgatgggtatggaactactagtacctcctggtttctgcttcttttccatacatagtaaacagattcagtctctcaaaattactgggaagaaaagtgatttgtttcataagtgttaagtgtctgtttctggtcatggctatctctgggactgtggtcatagagaggcatactggctattcagcagggtttctgagtgggaaaaaaatctcttgaaaatgtggtgttgtcaaggaaggccattttactgatgttacttcagggcccttctttcattccttcacatttttcaatatttattgtatggcaattgcattgtagaaacttttctaggtacttgggaacaaaattgtgaacaaaatagacatgtcctgtggtttctctggaacctttagtgtggtcaaggggacaggcattaatcaaaatactcaagcaaacatttaattacaaactatcatgagtgctacaaagggaaaggagaagagctctggtatataacggggtagatgatctgtgtgtgcttacttgatgcaggtgtcttttggggatgctataagacagaaaatttagaggataaggtaaagcagtaggaggaatattcagacagagagaataatgtgtgcagagatccacaggcaagagggaatgtggcatcctcgagggatagtgaaaccagagttgttttgaggacttttattcatttattcaacatatttttatggagtgcttactatgctctagaatatgacagtgaacaagacagaacactaggagatgtttgagatgaggccgaaaaaataggtaaggggctcgccctattgtacactcatctcccttggtttgtttttttgtgtgttttcagagagaaacagccgtacttaacaatctggtttcagattcttttaaccttctgtttgcctttctctgaaggtgctacagtttgtttgacaccctcttcaagaggggccagtagaactaaggataaaatttttaagtcttcccatcaagaaatgtgtcgttaacattaattaagtttcctcactgttatcaatgaatatccctccgtatccttctctttcactagctgagcattatattatgtgttgttcaagggcagatagtctgtgaagaagtgctttaaaaactgatagcgtgtgggctctgagcatgttgtgcggctgactggcccccacctcctcttgtttcctttctccccagaaaggcctcacttgctgcatgacaagtcaggctattgtttgctcattcgatattgtcagctaagatgcttcacaattccttaagaatttattattgttgttgttgagggatgatagagtcctcttcttctcatttaagtgacgtgtatcgaaaaggaaaaatgacaaataagaaaggacttgggaaaatttcctccactcctgacttccagacctttagaacttaatgctttccgttcagtacttctgccccctaaccttaaagtcttgagagaagaatgactggtgttgacaggatgcttgtttactggcttctgcctaatttttgaggcatgaagtggccatctcatataaagcaagtagttcacatcctgggactgagactacaacctggtttctccttgtcttgtttcgatggagttattctgtatcctgtgaagaatctctgttttgtcatattgtattccctctttaaatcttttatatctctttctcgtactattttgcccctgatgctgtttctttctttattttaagctttagattcacctcttaagttgtcagcccacatggccatacatgaccatggttcttactggtgtgaagaaagcagattgtagctggttgtttgagatgccttcttaggtggaccaacctctctcgggttctttggttttatctcttgctcttcctcttgaatgtttatgatacttcctggtcacgtcatttctctttgactctttctttcttccttccttaggttccggattcatacaggtatgaatctacttccccatctttgccaaccctggcatcgtgcccccttgattccttggcttttcacaggctagatgcttaatggactctggaagcctttatctctaggacgcctttatctgtaggactgggcttttttgtttgtttgagacagggtctcactccgatcacccaggctggagtgtagacctggggtttctaaacactcttcaccttgtgctcagctccttgtatgataccgaccggatcctatccatggacaataacaatcttgaatgtgttcacaatgcctgggggaataagtcccaatccggccaggaaatgctgatctccttccgacgggatctgcttgtctcacctcagcgccagttgcttccctttacaatctctttgctggccaggttagaacatgtgctaattctctgaaaacacaccatgctttccttcctctgtgtctttgcttgaatggttctctcagtccagaatacattttaaatatttctacttccacaaatctattctatagtatttatcaaaatagtaccttccctattaagtctcccctgattctttagctgaaagttattttgatttcctctgagttcctgttaattttgtgggtacttctgttaggcttcttagcattctacagataaggagatgggacttcgtttaaacagctctgggccacaaatatagcatgtagaactgtggagattctaactcacattttaacctaaaatgccatactctttttatcctattacattcttctcattccatatatgtctatcttatgtagtatgattgaaggcagggtgcttgaataaggtgtaatgtttttgaatacttagcatatcctaggcactgtgtgacatattttgcatttatttaatttggctgtcataaaatttctgcaaggcaggtacagttactattcccactttacatatgaggaagtgaggtatggaaagattatgtaacttgtccaaggttaggcagctagcaggtgacaggcaggacaccagcttaggcagtgtggcatcacagcctatgcttgtaactgccgtgcaatgctgtaggtaagcaagagctaacaatataagcctgaaactactggctttctcagttgatggtatttgagaagtgtggtctatgatattcctcagtaactttcatccatggaaaaccaacatatctcatttctataggttttaggatttaaatatttttaaggatttttctgttgtagactttaaatttacgatttgagataaactgaatgctaaatctttcctgcttgggaagaattcagatgtaaaattgtaatttgtattattggaaaacaactccagttttatgcattctatgcaaggatgagctatgtattagttcattttcacgctgctgataaagacatacccgagactgggaagaagaagagggttaattggacttacaattccacatggctgggggaggcttcagaatcatggtgggaggtgaaaggcacatcttacatggcggaagcaagagaaaatgaggaggaagcaaaagcgggaacccctgataaacccatcagatctcatgaaacttattcactaccatgagaacagtatggggggaccatctccatgattcacatgatctcccacggcatccctcccacaacacgtgggaattattggagtataattcaagatgtgatttgggtggggacacaaagccatgactagaataaaccacatcaagttacctgcttatctaaagttttagaaggtgttcacaatgttattcgaaagccaacttagtgtagtgagcatttggagaagcatcctttatacaagtgagatgacatacattgttaatatgtgcttttatgtttgtctttgcaagatctgagctagaatagaatcatagctctagggccaattagagtgggagatagtttaatagataacacaggtgctattttgtcaagttgcatggtttctggacagtttacagagaaaaaatttttagctgagagcctgatgaagtcttaaggctattattaatagtaatatttggggactagcaaagtgctcacataaaaagcaccaacaaggattaaaaaaagagaaggtactgaccagattcactgccttctattcccaaaaagattattaaaaggttcatgtaaatagaatatgcgcacacccaggagaaagtgatttatttttaagctgaagccgaggttttacacatccctgataatagggtttaattaatgtttggagtgaataaaacacactcagaagaagtgtagtcatatccttaatttccttgattggcaaagtaattgatatcatgtgtgacatttgagtcagtgctattttatcagtcacttgctctctgcgagacagagactgtgattgaaaacagtaggtatgggtacttgattttaaaatgaactctatcataatatactgattacagaatcagaagggcaatgttggtgaatatttttgggcaaaaaatgactgtaacctattctagatatggtaaaaccagctctcagtacttaccctataaagagaatattggtttttttcagaattttgcagagggtctttttacttagggaacaaagagaactgtaattgtcaaatgtggttgtaaaacggtaaatctatttttgttcatggctcattcattcacttggcatttaaaaaaaaatttttttatttgtttattttagagacaggattttgctgtcacccaggcttgagtgcactagtgcagtcatagcttactgcacgctcaaactcctgatcttaaacaatcctcctgtcacagcttctcgagtagctgggactattggtgtgccccaccacacctggctaattttctattttttgtagagatgggatcttgctatgttgtccatgttggcactgggctcaaatgattctttgctttcgcctccccaaccactgcgattacaggcgtgagccaatgggcctgacctcatttggcgtttattgacaccatattagaaaccctgtactacgtataaagattattgggggaaacttctcagctatgcatgtgtgtacatgcatatgtgctcattagatcttggtgtaagtacagtttttcttctagtcatggtttaaaatatctgaaaaggtgctatggggacacagcagtttacaccaacagggaccttataattaagtagatatgactgtaacatagagagcgataacgttataaaagaaacacaggtatgttactataagaatgtgatgaacaaatcatttgataaagatatcagcagaggcttagtgtgggagatgccttttggctggacttgggcagttggttaattctgaatggggtttggggtaggggagtcaggtgaggattggtgtgtgtaggtatgcctaaaggcgtgaaaatatttccaagaaggattgcgtttctttttgccactgatggcagagtcaacctcggcttctgagtttaagaagagtgtgagcacctcgagcaaataagtcagctaaacaaatggagctgaggcattagaaaacgcctgtcgatttttaagaaaaggagctcaactctaagagtgcaaggaaaaataaatgcgtggagtgacaggataatagtctataattacttttaagattgctatattgaggctgtgacagtcacttagttcctgagtcttttcaggaaagggtaagaggtaactagccagagctggagtcactccttgtagaagttaggtggctttgatagtgacattaactcttcagaaactccatgactattatttggtatccaaagcagaaatttatgaaagagtcacagaattttacatctgtaagataatcttttgaaaataattagaaagaattcaggtttagaatatacatgggtgatagacagagtagtgaaaacatccccagaatctggtcctgctcaaaaatggagcagagtttcttagaatgcactgacgtcttcacattgaccctgcacagtaccatccctgggagatctggcaaaggagacatttcagaaatgtgtgagttaggtgccatggcattaagatcttttcctactgtacaacttcccgtttttaaactcaccatcttgatgtacagctaactaatgtaattttccaaagtttctagagaagacaacaaccttattgagatactgggacatctgggtgccagtctagttccagttacatcttacttttgaaagaaaggaaaatccattaaaattagaatttgtctaggaagcatctccctcccaggagcggagtactagctcttcactatcattggtctaagcgcttgaaatgctcccatgtttggaatcccattgtttatgtatcagttctcccaacacttccactcgttaggggtatgatttaagagttaaggccaggtgcggtggctcacacctgtaatccaagtactttgggaggccaaggggagcagatcacgaggtcaggagatcgagatcatcctggctaacatgatgaaacactgtctctactaaaaaaaaaaaatatatatatatatataaaattagccaggcgtggtggcacacacctatattcccagctacctgggaggctgaggcaggagaatcgcttgaacccaggaggtggaggttgcagtgatccgagatcacgcccctgcactccagcctgggtgacagagtgagactccgtctcaaaaaatatcctttgaggtcacaggattgatgctatacaaatagtaattgtattattaatgatagaaatatgaagcatattggtattaaactatgagctgatacatggagcagcagatattgtatttttagttcatttccttaggcaaactcaaatattgtactcacacagttacctcaggcattcacaagttagagttccagtgcaaacagtttgcagcaaatatgaaccacagtggtactattagttttgcatccactaggcacattttccagcttctgaagagataattgaaggagaacttggatatgggctaaattgtgtatatggataaaagattcagcagggatttaagcactttcgacccacatgaaacattaaatattagctgagactcacttgaagatggacttcttgattttgaagagttgtctgcatttttataaaactacatgagcatagtgcattttaactaataaaggaagtgaacacagttgagatgcattatctttcttagccttagggtactgggtgttactattataatttttaaaaatgtatgcttttcaatttttaaacagtttattatggaaatgtttaaacatatacaaagggatgagattactataatgtaccgccaggaatatattatccagcttcagcaataattgactgatggccagtcttgcttcacctatacacctattcctttccctcaccctggattattttgaagatagtctcagatattacgtcagttagtcacttctgcaaattttagtctttagtaggtatgtctaaaacatctctcaaccataaataacatgtcaggagagctcttttgcaagatgtttattgatcttgtgccttttgcatgagtatgggaatggctactgtttatggaaaaggagattaaagaatgcagtgtgggttttttttcgtggccgatttctttctttccttctttttttttttctggaagtaggattggtttggggcatgatgtaggaatgttattgggtaagggtttaaactctatgtggcttctgtggtttggagagaccccaggttgatctgatctactatagttaacaagtcagataaactagattttatttgtaatccttttgtactgaagcccaaacaactggcattcttaaattagctagaatatcacttagtattccatttatagaagagttgtggttttaatttaaaaaatactgtaagtggagctactgaaataggcccaagtttattatagctaatacttcattacagagacttccgccattccctaaatctaaggagggggttgtttgtataccaaacatagtagatgtttctgtttgactagattacctagaaaatggcacctagggtaacaacttatgtgcttaatttgaatgaacacgcccagaaaaacaggagagaggaaaaaaagaaaagtaagagaaaagaggagagagagcacatagagagaggtacattatcaagctgtccacagcttcctgacaagagcagctgagttcttggtatcacagcacatcttcacaaaggcctcataaactagcgtgtctcagaatagttcattaataggagggaggaagaagaatttacgtagcagttcctgattcccatcgttcaaagtacatatttcctttttagtattgacttttccaggaaacttgttttattagtactcctactttccaaaataattctctatgtatggttttattttttaaaatgaaaacgataggaaagaaaattcttcgaattcattgtcatggggactcatactcagagaattggatatgacaatactcaacaccaaacctagttctgaaccccaatatctgattattatcaatagaatcagatcaagggaatacttattttcctcttagcaatctatattgattattcatgggggggggttctttgttctgagatcaggagaatgccctggttatatgtccatgtgtggccttagtcagtttctcatgtttcttatgttcatgtatcttttgcttaaaattggaaatatctaccttcaaggaaatactgtcgaagacatggttgacaatttcatagcagcagtttgatgaaatcattttgcacactgagtaaattagtcaattatgtaaaaattttatctgtagttttgtccaccttatgacaaaaattttggagaaaaacaacagccttattgatttacagacatctttctatttatcagtactagcatcagctttctgggacatgtcaactttcctgtttttgagtctgaatggatccataaacctaaacttgctgcaattggagtgcagatatcaagactattgcagaggtcttctcacacattatctgtgtgccttgagaatgggacctctactttggattctatttcatccatcctatacaaagagatcaagcaagataatcacgtattctctgtgctttggcctttgaagactttaaatgacttagcttggtattaaatatttcatccaggagaagttgggacttgaaaatcaggctttgtcccttgcagaaaacttgactggttccaggcgcagttactgttggaacagaattctctttaatcttttgcggccattatcaacattgattttattccttgtgcagggcagtagagttccagcttctgtgttattacttttaaaacatggtataattttaggaaaccattttctttgtttctgaaggtgtatgtataggctatgttcttcacattagatttttattttgaaagaacatggcaaagtgtggaaaacaaggaacatagttaacatgatcaagatatctgaaattgtgtaattagtgatagcttggataaagttgatatgaataagtaatatagagcagggagtgtccatgaatggagtggagttagcctcatgtcaaagtttactgtcccccagccagacctcagcttgtagacttagtattcaatttggttactctactgtgaaagagatactctcatctggagaagaccagccaagatagagagagaactaggctatgtcttgggaggaactgttgaaagagattgtaaggtgactttaagaaggtgataatcagggataccagaggaagacttagaggactccagaggatagaaatatgccagaatacagaacttaaacagaggcaaattttcattcagtacagaaaaagagtttctgacaaagtgatctgaaggtagaatgggctgtcctgggggatggtgagctccttcccactggaggattttcaagccttagcctagtgacccctaaggatatcaagatgtacaagggtcagtttgtggtttaactaggtgaccttcccctccaacctaaagacatttttgttgtctggctagacatcttacttcccatagtcttttaaaaaataaaattaaaaggcaataaataacttctgacaaaagaaaatagaagccatgttcttatcacccagtaatgaatatattgatatggttctttcaagtaacttttaaccttttacaatatacgtatcaaatgcatgtatcataggtgatatgttcaataatttttgcaaattgtgcatttttgtttaaaaaacacccagatcaagaaatagaacctcactagtcactcagactacttcatctccccatgaaaaacaccattatgatgtctaacagcatagattagttttgcttatttttgtatcatatgtaaaaggaaccacacagaatttattaagtatttttaattgtggttttcgttttttgactcaggcttaaatagctctctttttattgtccacagatttttatatatgcctagtcttgcaaagttattgtaggcagcaccttaatgaggttttaagggaattttgctattctaacattggaaaatttaggctgttttcagtttttatctgttaaaatctttgggcttgtagctttcctatcccctccacacccatttcttcactcatatttctcacaatatttcaaattgatttccatatgtggaattattagatcaaatggtacaatgaagttttaaagtttgatatttaccaaattttaatccaaaagttaccaaattatacttgcattagtaatatttaatagtgcctattgctttgttttaaaaaatgtgctaattttatgagaatggcttttcttcaattattaatagggcaacacttcctttcacgtttgtaaactagttatagatttggtacatgtagtcagtcactgtgctaaattctccttaagaattacgtctcttttttgaaaaactaacttttaaaatagacattattattattattattattctcattttgaagatggggtaactgagaaacagagatactaactaatgtagctaatgaagtgaagctaattagtgtcacatttggagtttactcaaaatatgatactcttcagtttgatatgctactgcccttcatgttatcctttttaaaaaatatttttaaattgattgtatattattgcattagcatatttagccaatttatatgagcttcatatatagcatatgtgtgtgttaccttcctggtaacacaccaaatggctcatataaatttagccaatttatatgagctttatatatatatatatatatatatatatatatatatatatatgcatgtgtgtgtgtgtgtgtgtgtgtgtgtgtgtgtgtgtgtgtgtgtgttacttttttgggtgtttatttttaattttgttccaatttagaagcatataaaagtttgtttcaatgtgttttttaaattattcaagttgtaatcaaactgaaactaattttggtcaaaggtgaggctctacattgatttttaaataatttacccatttttccaatttcatttaataaataatcttttctagccgagcacggtgggtcacacctgtaattccagcactttgggaggccgaggctggcagatcacctgaggtcaggaatttgtgaccaacctggccaacatggtgaaacactgtctctactaaaaatacaaaattagccaggcatggtggggggcacttgtaatcccagcttcttgggaggctgaggcaggagaattgcttgaaccaggaggcagaggctgcaatgagctgagattgtgccattgcactcctgcctgggaggcagagcaagactgtctccaaaaacaacaacaacaaaaataatctttcctttactgattcatttgtggtgtctcttttactgcatatgtatgaacgtgtggggtgtatgtgtatgtgtgttttagacataggatctcactctgttgcccatgtaggagtgagtggcacaatcatggctcactctgaccttgaactcttgggtgcaagtgatcttcctgtctcaacctccagagtaactaggactataggtgtgtgtcatcatgcctgactaatttaaaaaaaaaaaaaaagtttagaaatggggtcctgcaatgttgcccaggctggtcttcaactcctggcctcaggttgatcctcaagtgattaacctaggcctcccatagtgctacaatatatttggcaattatatctgcgtgcacggtttcttcattaatgtcgtcttattcctgtgtaaataacttccactcccatttcattttagattttcttacccatctttgcaatatcttcaaaaagaaagaagacttgcaagagtccaatgctgcataatattaataaacttaattttcttaaattttcttctctggcagagaccataagcagtatgatatttagtcatgctaggataagacctgagtagaaattgtactagctatccagctcgtttgttaatttacttttgatgaggcagagaacggtcatttaaccagcttttgttcagtgtctgttcggtactaggatctcctgagaaacccttgcatcctttatgtacttggtcctcataacattcacactaagcattcatggcagagccagcactggcacctgtggcttctatgttgctttttaccttgcattataccaattcatactaagaaaattgaagtgtgccctaatcacagtctttcatttgtaagtcgactcaatacagtattggatttggagttttgaaagaaagtaaaacctaatttccttccccaaagctattattattctatttagataaatggaaaagcaggtatgtgttgaggtttctagcttttaatctacagtgtttaataggttttaagttatttgttattgaaatcttgaagaaaacacataagttagatttcttgcttttatagcaaaatattttttggatggcttagggagtcaagtgaaccattttaaatacagtatgactaaatctgaaaggcctgatatggtagctgctagccccatgtgaccatttgaagttgaatttaaatctacattaattaaacttaaataaaacatttgtaaaaattagtctctcagccactagtcacattttgagtgctcagtagccatcccttgcaagtattaggacagtatggaacattcccaccactgcagaaagttctgtggtgcagtgtccatctagatgattctacaaatggaagatttaggggaagaggagaagtaagtagtgaggtgtacctaattgcttctataagttttagtacaaagaacccttcctttaaaatattgatatttggtgaaacattcagatatcacgttttaaagtgatttcatggacactaatcaacagagcaacaacatagatatatcattgactacaaggatggatcaatacttgttctacctgtttcataacttagaggattatagggcactctataacacagcaccttaagtatcagaaaaataaaggctgcaggtgtttgaatgaattgttggatgttctgtttttataaacatgtggtcttctcatatttacaccccatttggtttgggatgaatctccattctgagtcccttaaatgttagggaagcttaagatgagaccctttggattccacacaccaatctaatttcggacccaatttgaagctgaaaaaggcttactatggaaaaaaaaaaaaaaaaaagcccaagccccaaaacatacacacacaaaacaaagtagaacaaaaggggataccatgatctttttatcaaattaggataataggatgacatggaattcagaagacagtgtgatattctctgggaatttgttattttatgaatgttcctgactgaaatttaaataaaaataaaatccagagtatacttccccctttagtaacagatagaagtgacaccttgttgaattccatttctggattactctgtttttattttcatctattggcacccaggacctggtgtttggtttgtaactatgatgagtgggttgggattaatatgagaaattccgcaatgagtaagtcggaactattcggtgttatgtccaagaaagctcacatgtcctagttaaggctgtgtgaagtgaattggaccatcctgatgtggtggccccaaacactgggcttaatcctctggtgtgactgctttcacaggtcttttcaagagcctaagtaccataaaatattctcacaaaagccttcattccaaagaatgtgtgtgtcggctcatgtcaagagcttttagtgtagaacaatgtgtcgaaaaccacaatctaataaacaaacagataatctagttcagttttgtctaagtaatataatgtctttattaaactatttcctgcacctttagctctattcagaaggagaaagttctgcgtgggaatgtgtgtatatttactcttaataggaggccgtgtagctcctgtgactggatgtcttgtttttctcttctgagtagctcttgttttccatggtgggaattttccgtcttggtaatttggtattttacttggttttcattgtgaagtgtggaagtgtgtacaccttagttttagaaatgttgttttatcacctgcatctcagttatcaagggccaagtcagaaagttctcacgtgtttttaagcctttctaccagaccttgaactatccattaagtcaaaggggataggctatttccatgaagaaggtttagggattcctggcagggcaggaagaaggggcaagatttgcgaggatcagaatcctaggtactctcctttagactgcctggtgactactcatttgtcatatggaaaatcatggctcaatagttcagtagaatataactttgtggaaatttctgaatattaaaggcttcattttcaacacggcagtgagatgggagagtcagggtcattcattggtattgtccacgttactggttgctttttgtctgatcttgcctggagaattatttttaagtaatgtgcctggaaagtgcctacttacagttaggttaacggccatcttatggcatcaggaggagctttctggctatacctattaaaggaagccttagtctcttattgccattaattgacccttgcattttgagtcatagaatcataaaccatcagtgtcgagagggctactaagcagtttccttggattaataaagcttgtatcttctttataatattcatgtcaagtggccttcctgcctctacttgaatacttccagttatttgtcaatctcacatcctcaaaccaggtaatttctatttaatttttgcccttaatcttcagggtttataaatacctattgataataccttcgttaatatggtgctttgaaactcttcatttttttccctaaataaacttgtaatttttctttctatatcatgacagtagaggctcatatttttatgccttttagtctcagttatatttttgtctgaagagctaaatatacttgaaaaaagtggtttctgtcatctcagaacatatatatatatatatatatatatatatatatatatgctgtgtaaactccacctgtttgctaatcataacattcatttttctcaatgtgatggattttgtcaccacctccccccgcccccccgcctttatggcattgctatgtgaatcattgcaaaaactctgcactaacatttttcattctgtttataaggttcaaatagatagaacaattttctctaggctttagctctggtgtgtataattctggtcaggctcctaatctttttgagggatagtttccttatccataaaatggacctaagaaaagcaatcctatggggacaatataaaacttgtttagctgcaatcttaactcagacttgcttcctgaaattcctcaatctaatattaaataggggttttttgtttaaatgtggtagcaagattatagttacaaaaagaatagaacaatgcattaaaaaatagaagtatcttaaataatatgtttaaattttttaaaaatatgctgaaattataaagaaattcttagaaaatcatgaggaactctggaaaataggtacgatgaatacaagaacttttgctcttgtctatacttgtccttgcactgatgttcctactctgagtctagcactatgtgcagacttcccttcttatggtatgttgtggtgagcagaataatagccctcaaagttgtccacgtcttaatctctggaacatgtgaatatgttagggtacatgccacagggaaattaatgatgcacatggaactaaggttgttaatcagctaacctaagataatgaaattatcctggagtataaggatgggcccaacgctattacaagtgtgatagcaaatggaagaagaggacagaggaggtctttgaagtgatgtgatgtgagaaaaacttaacgtgtctttgctggctttgaagatggaggaaggggccacaagccaaagaatgaggagtagctttgagaagctggaaaagacaaagaagtggattctctggagagactccagaaaggaatgctgccctgccaacaccttgattttagtgcattgatatgcataactgatttctgatttatagaacagtaagataaatatatttctgttcttctaaacaaccaagcttgtggtactttgttgtagtaacaacagaaaacgaatacacacaatatcatgttaaaatgatctgtttatatgtttttctcctttctaggcaatgaattcctcaagggtaacaatgctatctttgaaaaatcattttagtccatttccatatgaaaagaatacgaaatgtcctgtcaaacaccagaggtggtatttactcagtgtgtatgcaccatatgcctggcactgccctgggtattttgctttgaaaattttatttcctgtctgtttaaccctactaaatcttaactttcttatctgtaatgtgagtctatggactagatcaggtttggcaaacttttctgtaaatctggtaactaaatattttaggttttataggccatatggtatttgtcacaactattcatttctgccactggaatgcaaaagcagccatagacaataagtaaatgaatgaccttggctatgttccaaaagaactttatctacaaaaacaggaggtggtctggatttggccatttggctgttgcttgttgacctgtagactagcggacctctttattctgttctaattcctgtctaatatgattattctgtcagtttataacattgtgccgtgtcagttaagccaaggaagtgccagtaagacctgaagaaggaactcaagtgattggatgggtctgtttataagaagaagcataatattggagactcaagtgccaggaaggggactgtcaccatgtccttggcaaatggacctgggacaaattctctttaggatgagacataaggagatccttgaatgccaaagctgagctcgctgaacttgaaactcagtgaactggaactactgctggaggaataaaagggagcaataaatcctttgcactccagaatgaaagaccttctgaggcagctggccaaatgaagcaggaggagggaacaagttcctcactcagctaaattatgtctttgggctggccgacctggtctgctaaaataacaaggtggctgaacttctgctcagaacacgtcaccaaattttgcaatttgggactgtcttctatcccatgacttcctaatctgaggaagtgaagaaagcagagtgaatgaaacccaaggattgacttttttatggagggcctccttagagacaaaagttgatttttcaagagaaccctttatattgtgaactctgtattctaattcaaaaaccgttaagttcttggatgaagaacatccaatagattttggaggtcttgtaaactttgctattgatctgggacttaacctttgcagatgtgggactgtgtgtttatacatcaaagtgggtaaagaagagcccatccagagctaggcagacggaattgggatatgtttgtttgtctgattgcccggttgtggtggttgtggtggtggcggttgttttgacttggttacatcatcgcatttttgaggacaaaactaccctctttgattggtatgttacaatagcttgtttatgtcttgcaaattgttcgagaacagtttgtccattaaagaaaaaagtgacctagtaatactcccctacccaggggaatgtcgggttaatcagttgcacaagggcttgatatgccaagtcagtactaccccgaggctccgtatgcagttcctttccaagatttttaaacattctggggagaacacaatatttgtttatttggcttctaggactttgttttgttatcgttttagttacggtcttatgcttttctctcactccctgtctttcttttacccctaactctttggagccctggtgtgctaagagccatgttaacagtaaagcatctattcaataaacacttaactatattttatatttgagcttctaaatgtttgtgaagaatgtgtttctgggcaagtcacataaagaataatctcacagtaaaaataacttatatttatgtaggacattatagtttttatggtatttctaaattcagtaaaaggcgaaagatttataccatctgaagaaaaaccagggtgttgtatttttaaatttaaatactttggtctacacaaccctgggtagtataaaaggtaagtgctgttgctctcatttacaaacaaaaatattgagaatcaaaagtttcatgatttccctaggttcacacacatctagtaaatggttccaagtggacaaaaacttacacattttaatgtcgcagagctatttttttatatatgtaagttacctaactgcagcagtgattgccgagatcatccctatggtgatgttcaattgagtctccctatttcaatctttcaacctctcttttcttctctctctctctcatacacacacacacacacacacacacacacacacacacacgcacacataaaccacatacacacacattttgaaattggtagtcactcagtttctcaatcttcctttaaagactaatttattgggctagaatttatgggtgtagttgtcaaaaattcctgcatatacccactcaggaaatattttcccaaatcttctccatctcaactctgtgaggcattggaagaggtgcttttaggatagactgatgactcatatatgatgtctgccctcagggagcacacagtttagtgaggtaaatgtctcatgaatattccacaagatccaccttgataatgctctaaagttactatagagggctgaaggtgggaagatgctttcgtctggtggcaaaggatagtagtgtagggtgacatgggcctccaagaatagcttgggctcagatagtggagaggaaactcttaacggagacagaggtgtgagcaaagtcttggtgtccaggaagccagaggaagcattctggcagattaccgggtatgtggcttagcaaaagtcattattctgaaatataaaatgtccagtgctgctgtctgcagtattagtctcaaaggatacatactcaccagtacattccagagtttgttgacaaactttgacaacaaagcttatcaagtttctctccattgcctcataagaggcccatccagttagaggattcctccttttcagaatgagatcttgtcaaatcttgggaggctcagaacagacgtttaccaagcttccaataatactctcaaaccataattctctaaaacttcagcataattgccataaaatcaattgaccatatattagagagtttatttctgggctctgtattctattccatttgtctctatgtctgtccttatgctaggaccacactgttttgatcactgtagctttgtgataagctgtgaaatcaggaagtgagtgtcctccaacttggtccttttttcaagattgctttggctattcaaagagagccatgatatttttaatctagcaacagttgtatcaaatacattggaaaaacctgggtcaggaagaatgttgactatctgggctatttgtttagtctagatatgaggtaactatgcattaggtattttggtggcaaaggagatgcagagcagtaaatgaattagaaaaatttggtgtaatttaatatagcttgtttgtattcagagtgggtggttaagataaaaaggaaaagggttttccacctttgtgatagggagaattgtgataaggtaaatagaaaaatagagcacacaagaggaggttagcaggtctgtgggttatcctatctaaattcagatttgagcactgagctagaggttcatttgatgatgctcattcagcaatcagaaattcagaggtgaaatcaatgagtaccacaattattctgggtcttattttacttataaatggtgtatttatttagaattgcttttttaatgtaatgcatttatggttaccatggcacaagagccagatactgggaagcagttggggacagcagcaaaaatcaagatctggataaaggcagcttcatgaggcttctgtgccttacctcagctaagagtaaacagagtgctagatggctgttgacatgtgttttattttgaagtgactattattactaggatctgaaatccttagccttgatctcttggagcctaatgttcctgttctccagctgagagagactaattcaccatcttgtgttgtaaacactcactcattttaactgattacacctccaatgattctcaaatcactaaaattactaattgctattccttacacatcaaagagtgaatcctgaataattaaccccaaataaaattagatgaattggcccttttaattagagtccctgctgctgtttgttctgagcttccttttcttactgttaagagacttttagaatgattaaaactgtttaagacttaaacagccagtgaccttttaatacaatataaatccatgaaagcaatatttcagctagcaggtggtgaagtaaatttttagagcaagtacctgtcagctccagtattcctttggaaaaaaaaaatacatgccaaaaaacaaccaccttgaaatgaaatgagtgtctctatttgattatttttaaagcattcatgcatttgctaagcttcagacttgatgaaataaatgtcagggttgaaggagagtgagtaatggttggcatcattttatataaatagtaacaagaatttctcagtgagaagaatttgaagtcatttgtgcataaaagatgaatactggataaatcacagaaggcccctggcctcatgtagccatccttgtcttcggggattctcttgaagcaagagaatgagccccaacattggggaaaaggaagttttatggggtttaattgctgctgatcatcgaggcaggattaccagcctagccatgctgcattcagcctggattttgttggagatattttacatgttcctgctcgtctattccaagtctcctaaatagtaagaacctcttctcttcttcatagtcttctgaatttgtaggggtgtagcgggttttctcaccattcccaagaagtctcagtttctcacactaagtctgccatgtgctgtggtcagtgtgtccttagctagaagttaagatatttggggtcacagtgggctgcctggtgtggttctacattctttgactgtttctctattttttttccatggtggaaaatgtattcatctataaaaaaagttattggactagttcaatgacttactttttccttaaaatttaaaacataaattttaactttttattctgaaataatttgagaccctagagaacggttgaaaatagtataaaggattctcatttagtcatcacccagttttcccaagtattgacatcttacataaccacggtagagttaccaaagccaggtaaacactgacataatacttccttctaatacataaaccttatttagatttcattgattgtcctagtgatgtctcttttctggtctagaattatatccagaatcacatattgcattttattgccttgtcaccttagtcatctttaatttcagagagagagttgttcaatctttgtttttccagaaggtcaatgattcttaaccagcgctatacgccagaatcattgaaggagctttgcaaggtccttgtctgggtcccgaccccaaagattctgaattaaggattctaaagtcaagtctgggtgtatgtagtgtgagcaagtgccccaggagattccgatacacaccactggttaaaagtcagatgagtttcaatacctcaagctaagtattttcaaattctgtctatgacatgtatccttccccttccctcatttctctgctctttcttcatctccatctctcttttatgggattaaaaagcaaatttaaatgtctctttatactcttaagggatatacatatactgggtaaggcttatcaacagatcttttattggagaagatcaatacagtacagatggttgcaatatttctgaaggctagggtgcccccataaccaggtggtgacttgaggatgaagactctgttcctatactttgaagacataccctcagtaagataatgtgaaaacaaacaaacaaaaaacctagctagatggctacattaagacaggttattaactgtctagctgttggtatcatgaaggacctatgacccaccgtagtacattgttgaccttatgtcaatatttgaaaagtggcaaagttgaccatgggaaaagttcatgtgttcattgtctcaagagttctattcaatttaatataggtagttttgtaccaataataatttatagcaataatatcattactgtttactgagtatctcatatgtgttctatatgctttatgtagagattataaaacagagagtctgccctcaaggagctgttaatcaggtaggggaaaccaatagttatccaattaagctaacaaagagcagaatattggctgtaatagagcttcagcaggaaggaagcctgcattatcattgacatgtcattgacaatgcattgacatgcattgacatgcattgacatgagaatggttccctctatagccaaagacagcagtggtgaaataaattaaatgccctatttaaagtgtttttattatgaaaccacgctccctcaggcaccatcattgtctttggaggggttgtaagcttctggccttaatgaccaccacagggtaatgtcccaatcctaaggggaaaggatgtttttggactattctgtcagcactctgatatttgtttgcaagcttctttgtttttactggtaaattaagactttttgttgttgttttcctgggatgttgcctcattttctgtccatcacatgaatttttagatttttgtttcatttttaaaccgaggtaattttactttttcgcattggagctaaagatatctcactagctgatagaagactgatgcattaagctcaactcattgtcctatttattttgaatgctcatctttggaagtcaaaaatatatggtgtggtttgttgtctggatagcaattactatgtttttgtaaaacaaatgatacttggtggattcaaaagtgctatttggttctagtcgatgtgcagagctagactattgtcttaatttcatacgatttgaaatccatttaatgttttctactgagaaattgaatttgttatccaaccactgcatgacagagaattatagtatgcttgtatctcatgtaatacactgaggtgtctcacatttgtacagggtacttatttgtgattataaaagaggacttttaaagtctcagatatattctgtattagctaaatatggagtgaaactgtccaatttaaaatcagggagacgtcatctactttaaagataattcttcttgctttttaatttgagaatctcaaagagcatttcaagctaagttatttagaaagatgacagggacattaaattttggcttgagtacatatactgatgcattaaaattaaacgctgggtttgagtagattctgcgattcattttaaagtatcttatttttggttttttaaaaaaatgcatgcctataattcacttattgtataataattaagccaaaaggataaaaaattgaaaacaatgcttagcatctcatgagctgtagacaacccctgttaacatacaggcctatataaaattgggaccatattataagcactattcaataacctcccttgtttcttacctgataagatatgaaaagcaggccgggcgtggtggctcacgcctataatcccagcactttgggaggccgaggcgggcggatcacgaggtgaggagatggagaccatcctggctaaaacagtgaaaccccttctctgctaaaaatccaaaaaaattagccgggcgtggtggcgggcgcctgtagtcccagctactcgggaggctgaggcaggagaatggcctgaacccgggaggcggagcttgcagtgagccgagattgcgccactgcagtccagcctgggcgacagagcaaaactctgtctcaaaaacaaacaaacaaacaaaaaagatatgaaaaacaattttttatgttcttcccccggatatgccaatacttactcccttactagatttaagtctttccccaaatatcaccttggtgaggccattttcatttttttttctttaaaattgcaactcccaccaccaccctaacagtcccaacccccttacttgccctacatttcatcatagcccttctcaccatgtgatattccgtttgatttactttttaagcattattcttctttggagtataagttccatggggcttcgtggagaagcacactttgttagttctatttgtttgtttttccctggggtctagagtaatgtatgatatatagatggcactcgatgaataaatagttgtaagatgtagatcaacatcattattttggtgaccacacaatttcccactgtatgattgcaatttatttttcaaccagtaccctgttaatgaacattctgagtttttgcattacattgctttgtgatgaagtttccttaacatgctcctctgcatgttaagttacttctttggtaggataatttattaaaagtgatattgctgaattaaagtttataaatatctttaaggcttttgattcctcttgccaaattttcttgagaaaagtttagtagcagtagcatatgagaatgctggtttccctatactattatcaattctgtgttttatcaatatttttaatcttagtccttccttttaattaatttgttagcaacttgagtattatcaaaattaatagtaatgttttctagttaaatagcagaaaatacaaatggaagaaaaatagaaaggttaatttttctaatgtataaaaggaacctgaagtttaaggatatctagcatgataactaaaaaattaatgttcctcggtcaaggtcacatatcttatttacagaggaagatgtgtcactgaagggagatatattgtgctattttgatgacaatgaggacagagaacatggaatggccaagccttgccctgataattatccctctcccagagagttctcaaaggagtttcacgctgtagaaacgggagcaaaatgagaatccaggtgccgctttattaatagcttcataagtgcttgctctccctctgggacagaggtctgtgatcccactgacatagtgcagaggctttggctctaggaataagtagaatttgtatccggtatcttcctcacaccactgtatcttggaagtcaacatactcagtgagctgcagctcctgaagacctggcttgacattctgatcctttgctttagagtcaagaagtacaacattccagctggtctgtcctgggagccagatgctcagaggtctgaagcaggaagtttaagaaggagatttcctgggtattgctttctaaaactgagactttaacagtagtagctggatcagtcaaattaataaccccttccttgtcagagagaagggcagagtgggacaggaaaagagcttgaaaaggtttcgtctctaatagaaatagcatgttgagcaagtcagtgcaattgctttcatattgttagttccaaccagtgcactgtaaataggttgagaaggccgagaagtgatgcattaaatgggatgtatcctcaatttttctcttggcctttgctgtaatgcatttcctggtggtttttaaaaccttactcagctgaacaattggagatgacacattttcaggtactgaaaatttctgttttgtgcatatgtgttatttaaaaattataaatgggtaaaataatgacaggttaagaatttgtataatggagagtatttcccttctactttcattcctcagttgcaaaatttagcttcatagaggcaacttgctgttatcaatagtttgggactccatttaaaagatagtccgtgataatacatacatatatgtgtatacattattaaataaatgataacgttatacatgctgtcctaggccttgaatgctgcatttaaaaatatttcacccaaggtgctttctggtacagttttcttggtggcacacatattttgatgcagattgaggatggagttgaagttgaaattggaagtgaagtcttcctttatttagtttcataataaattgcctgtagtctgtggagtgtacattatagctgtggcataattcattgccttatggagatcatcattgctgttacctttgttttatcctctcactttttctctttaagggaccttgttcagggagcttggtctcctcctctgagtgatcaagtttagattcagttgccctcttgtgcataaggaaaaagaaagcattgtcatgtataatgtagacattgtactaatcacttgcacgtaatttagctcagttatgttcaaaatgtaaattgagacctatttctgggccacagtcaatttagtgggtcagaaccaattttttttcaaataacagagcatttcaatgtgtgttttatttatatagtaggtatggtttcatgaaaccctttttttctagtatacatgtacgtgtacatatctagatagcaatattaccacattatataaaatatatttttttaatctaggttgtggtcaaaaagtttcagacttactgtgttagctgctttgatccacagattgacactgtgaagtagctgtggttttcctcatttcataggtgaggaaaactgggtctgggactatagaattgccttgcctgaaataaagggtagagctggggtttgtgttttaagtttttggacttaaaatttcgtactattttcctttcaaacatatatttttttctgtattagttactatatagttttttgtttttttgttttcttcttgttttgagatggagtcttgctctgtcgcctaggctggagtacagtggctccatctcggctcactgcaacctccgcctcccggttcaagcaattctctgcctcagcatcctgagtagctgggattacaggctcctgctaccacgcctggctaatttttgtaattttagcagagactgggtttcactctgttgcccaggctggtcttgaactcctgacctcctgatccgcttgcctcgacctcccaaagtgctggggttacaggtgtgagccatgcacccagccactagttactattaatggaaatgaataaccgtctttacttgaaacttatgctttgctaaccatgattaaaaaagtgttcaccttgtgtgtgtgcgtgtgtgtgtaggtattccaatccagtctcttttgacttcataatttagaaagttaacttgtggagtatctacatgcttttatgcttaccttaatagttagattttcctccaacaaccaaaaattctcccctcaacaaagtgggagaagcaatagctgccagctagcagaagctagagacatgtcactgccagtgcagcccatgggtctatgtcagcaacacctgagagcatgttggaaatgcagaatctctggctccagtgtggacctgaatcagagtctgcgtttgatctaggttccccgatgattggaacattgacatctgagatgtacgagtcaaagacaccaggtcatttattaaaacatcagttaaggaattgaatgggtttttatttttcagtcatgcgacctacagttactgaggatgttctggcccaaacctgtgactagagatgggcatataaagataaatcatgagtggactctacttgtaagaagctgcagttctaaccaggagggagtgatcataacacacaaatacaatcaagtattacagatgctctgatagaactgtatatgagacgcaaaaagggctgctatctaaatccttggatgtgtgtgtaggttttatatggatatttagatgaagaagagcatgatgctttctttgttttctttttgtaccacagtaaatgaatccaaactttgttgatagtcagagttgaattgttcccatgtgtttttctaccacaattacccataactagtaatttacttactttgcaggtaaattcttgttatcttcaccctctgatgggggcctttgtttcataaagggctaagcaagctctgcgttaggtagatgcctttcgtatctgactgacgcaagtgttagggtaaccacagtggggaatagctcagctggtcccagctaaccatccctgcttctcaaggccgcatcctttttacccctagattaaaagggagagcttgagaaaatatgcatagctaggtcctccggagtctttcctcactccctttttgagttaacaatatgcctaacaggctgttttctgaagtaaattggcagtaagtagtgtttgggaatcagagatggaatacttgatttgtccaactcctcatttaactgtttcttgctgctacctcttgcacccagcaaaaaccttttgaatattagctgaatgatttgggttcacatggagcaaatcaagcaagatatgtctcagcatctctccaagagtgagaatccatttcctgctctgtatttcaccagctatgtaactttgaataaaccattttacatgaaaattgaggcataaatatattttgtatgtaggtaggatttggaggatgagtggaggagtatggagggaccaggtctgaaggcacgtgtctatgaccactctactgcttctaaaactggacatttccattttagatttgatacatcgctgccaattgccggatggcattttgttttgttttgtttaaaagcttgcctgtacgtctcagagtctgagaggtgagttgcaatttccctgtaggtcagagaatctgggaggtgagttgcaatttccctgtaggtcacagaatctgggaggcaaggcagagaggacagggcatgcactaatatgaaggtctacagcttagctgtgctggctggaaggtactgcatttcatttcatccaggggctttcctccagaaggatcaccacctaggaatgaaagccgcatgctctttcattctttcattgttttcagaaatctattagaatggagaagacctccttcccccttcttctaatcatatataaatacagttcttttcattttcccatttttcttaaacatgataattctgccttgtctctaaagctgaacttattttcactgcaacttagaggcattttcctttatttacttgtctatgaaaatgatgagctctgagttagaattctcttaaacttttagtctgatttaggatagttattagcagtttttcattgaaactctcccggttagtttatgcctctctccaagggaaccatttcctctccttttatcagatttgtatctgtttttgagacatttgcccgttcctctacatcttttgaaaacgtgagcacctctctaaggaatgcagtaaggaccctttgatggttaagcttaaagaactgaaaactttggtctgacttaataattgatctaaataaagcagataattatgtgtttatcacgagggcttttaaacatctgccttttcatgcttagaatatagaatccatcttttcaagttgtttcttaaaaaaaccaaaaacattccacttttcttttttgttcgttttgaccctcccaggattgtcagcagcctgtgcctcactgtgtctgagttctattagagaaacagagtaaagaaggatatatttggaagggacagacagttgtactttttaagacttacttgttgtgacattttggacttttcatgtagcttctttatgacatagtttattgaacctttccaattttgtgggtctaaagtaggaataacatgttgtggttctcaaagtgcgatctcagacccagtcacatcaatcacccagggcctctgtttgataatatgatctccaagattttgttcagttctgatactgtctgatgctctgaaaatttcccatgatgtaacagaatctgatgaagtataagaggggacccaggaatccttttataaaatgggtatgaagaagacatagtaatatggtttagctctgtgtccccacccaaatttcgtcttgaattgtaatccccatgtgtcaagggagggatctggtgggaggggattggatcatgggggtggttcctccatgctgttctcatgatagtgagtgtgttctcacaagatctgatggtttaaacttatatggcagttcccccttcatgctctctctttcctgccactatgtgagatgtgcttgcttccccttcaccttctgccgtgattgtaactttcctgaggccctctagctatgcttcctgtcaaggctgcagaactgtgagtcaattaaacctcttcttctttataaattgcccattctcaggcagttatttatagcagtgagagaacagactcatacaacatagattcagatagaacatttgaacttggaaattaggttgtgaacagcaacctaaaccttttttgcctcattgcctaagctctcattgtgagcactgttttcatacatatgacctttaaaggcagtaaaaaacttcttgacagttctttttaattaacagatatgaaatattttttcatgcagtctgtggccaaatgaaagtttctcaatcctggctgcaggttcgaatcccttaggttttataggtgtcctggtgcctgaccccctcactccctgtcttctatccccaagattctgattgaattgctgtgagatggaatttggacatcagcattttcgaatgtgtttctttggtgattctggtatttaaccaatgtttaaaactactgaatggaatgcatacagatttatgggatttataattgtcataaggatatgtacaaattatttccacagatttgtgcacccagagaataagaggagtagaaattttctttatgttgtaagttattgaacatttcttatcctgtgggtctaaagtagtaacaacatgcagtggttattaaagtgtgctgtcagacccaaaggcatcgatcacacagggatttattagaaatgaagatggttggagttctccccagacctactgaatcagaatctctggatccaggacccaaaaatctgtattttaaaaagacattccagagatattgatgaactctaaagtttgagaaccatcagctttaagggttgttgtatgattcggtggcagtgtatgaaaatcttagcaaactgcctggcatggtgcgagtctagtaagcggagtactcgagagatagtgcttttgattgcttagcagtctgaatttggcttggggctagacctgacagttcttggcttagctacactttgaattctaagactgttatttataaggcaaatagaggcaaactgaaccatttcaaaggtgtatcagaacaacaaaacctactcacagtcattctaatgtgctcactcttccattcttatacttctatttctcagggcctaaactgtgatgttttgataatatccaaaagcaactcacttaatgatggagactgctgccctaacccacaaagtgttgagcaactaaaatgcaaggaaaggctactcctccataaatagaaaagatctcttctccaacacatcaaaaacattatttttaataggaaaataacaaataaagaacaggttaaaaggtagaagtttctgtttccccaatacagttttttgcagactatttaaaaaggtttcattccaggaaccataaagctcttggatatatgtgtataacttagatcacagagatcaggttcactccctcaataactctgacagcagtgtgcttctcttgttggtaagagatgctaggtttttctcggtatcccaaagtctcattacttcttgcctggattatgtatagatttctaaattgggtgtttcttattcatttctcctaatctgtcctgcatggacttttacattagtctttagtaaatcgtattgtaaccaagtgtttctttctcagaaatccttggtggatctctgctgcatgcatgataaaattcaaaccctttttttgatgtgcaacatgtaaaaaccttaattttatcgcatatctaatctttataactcactggcattattttacattcctgtgtcccatgtttttcctatgtcatgacttgctttttattctctatgctctgaactttctgatcgccatgcctacattctcctgtctctctaccaaggatggacgtaccttctacatcatgtttcaggaaaattatatgatccactgagacttccatgatcctccactttatcttaatttccagaggttattcatgcatctttataaattacaccttgtgttatctttagttttgtacaatttttcttcctcctctatttgattgaaaatgtattgagggcaagcaccaaggtgtataaaattcagtaactctatctcccacccaagctcattcttcgctttgcttaatatattgacccctctagactagcttttataccatttctaaatatcaaatccgatactctttcttctgaaagttaagactactaattaaggctactaattaaactaagatggggaataattgctatacaacacaaaattatgtgtcaaagccaattataaaaaagtaaaatgccagcaaatatatcacgagtactataacgttgcatccttattaacttcatgttgtttacttcttttctgtaggtgattttcttccacccccacctccacctctagatgattccagtgcccttccatctatctctggaaactttcctcctccaccacctcttgatgaagaggctttcaaagtacaggtaagagctgaagttaaagtcatgttaggtaagagctgaagttaaagtcatgtttataagccatcctagggagctcatgaatttcatgagtgtttctgtgctggataaacatttatccagagcctattgagagctttacaacttatgaagatctaaggtactttaatgcaacatacccaactcaagcttcccagagttctgctggcttaccctctgaagccctcaaaatacttttgcctactaattttgtttcagatcccaaagccattttttttttaggaatactatttgagaaggcaacatttccttgttattttggaggacatacagccatgtctttttattgctatgttctctatcttcaaacattgcattcaagtgagtaaggctgacattttaaggctgtagttggttaatgtggatccttttggtcagcaacatttttctagcaaaagcaacatcaaatatccttaggattttctcttctgggtaagttcaagggtgcacatcatacttatcaattatatagaactcttgggttccagcgagtggtaattgcaaagtaactcggggctgggatcagatgtgacattagaagtggttctcagactgtgatcatcggtaactgccgaaagctgccaccatttaagctgaagaagtgctttatgtcaagaagaaaatctaataaagtgatagaattattgttatagttttaggtgtgactatgttcgcatagatacattgaagaaaaaaatgagtcttctttgtctttcagagaaacattggaaatgtttgtagataaaatggaatgggccgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcgcaccactgcactccagcctgggcgacagagcgagactccgtctcaaaaaaaaaaaaaaaaaatggaatggtgtctggtaattattttcaaaataataagggttggaaactactgagtgagaacatgggtgaaatagggttggttatgatttgataactgttgggtgcatggaagtttattctgttattccgtctaccttttaaaaaatacctaatatcatttgtggaacataaaatatattgaattattgctcattaattttatcatttgttttacagtattattttttcattttaatttttgtagctacaagtaggatatgtatttatggcatacatgagatattttgatataggcatacagtcttttaaacatatacctttgtatatgtttaaaatatcctataataagaagtgtaaaagagaaaaagtcttagggaacaactgcttaaatggtttgttctattatttgcctttctttctcctaaatttgaggttgaaggagacaaagaaagaaatgattcattcgctcaacaaatattctgtattcctatgtgggcattattcaagcactaggaatgttatagcaaaaaagacagacaccactctgtcctcagggaacgtaaaagttagtgggactagtggaaataaacaagatacgcacattacaaagtacattagagtggataagtggggaaacagggagggggtcaaggcttacctactaggatgggcattatcaatatggccccactgagaaggcgacgcttaaatgaggacttgaagaaggagaggagggaatgagctctagagatttcttggggagtgtattttcatatagtagatattaagaagtagaaaaggcttttgatattatctatcatttgaaatcagtaaattgcagttgtaaccagtaagtaccaattcagtttctggagtctagatcttttaaggctattgaaaaatatgtgtattgcaaatataggccatgaatttcttgcattttattttggtgtatactaataaaatcaactatcagatgccagtgatgaatgagagtcctataaagtttgtatttattttatgtaacagatagaacctttggcaaataaaaccaatatgagtgatttttcttaattttagtcattttttaataaaatgaggaaatccttagctttggctttaatatacctttggtcttactttgctgaagttggttttttgcatattgtttaatatgtacaatttttaaagtcactgactctgtttcctctcttagattgtcatagaaactattttgttgcattttaaatctttagttctcacaatgttatttgaagtagtgacagaagactcgtgattgaaaactagttacatagattattctagttgtgtgatcttgcgcaatgcatgctgagtcccggtttcctcttcattagaaacaaaacaaatatatatacctcttacaattaaatgaaatacagatggatttgaaagtattaaactgaaagggctatacaaatattttgatgttatattaataatcactattaatatgtaagaagactagtaaggattttccagtgggttccattaaaaaattcaaccatggggctttcaaaagataatgaagaatttttttcaggtggaccttgttctgttagatgtactcaagccgtggctttgtttttgaagaggaaggaaataaacaaaatgcctgttgtcatgttggcttaagttctctgtaaaacagaagggaggaggataaaaaataaaatacggtttgccaaatggaaaaggacaaatctggtagggagaggcctgttatttttgagacgcttcatatggaagattgttgatacattcaaaagaaaacgaacatgccctccccttgtgcagaagtgacttagatgtgatagcggcttggtcctgctctggcccaggtttgtaccagctatagaaatgagccatggtagagcctaaagtagcatgatcactggagaaaattctgcgcagtttcctctcggctatggttaaaacctcatgttcccaagtccaaattatagctggtaaatgtgtgtttttatgcagaagactgtttatgtttccagccagattttcaggtcagagccaaaagaacgtctactaagagtgattataagagttgtaagattttgagagcagaaagggaccttagagatcatttagtccaactctggcgccaggcatctagttacagtcctttcaagtatttgctaaattaatttccttttttttttttttttggaaatggggaaactgagacccaagaagggatggatcctctggtttctgacagaggtcttattgaatttgaaaaatcttgactcctggccttgaccttcttcctgctgtcccagatggcccatgaacttggttttgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagccttaaggattcttggtttaacagttctcattttcatgtgggaagatgcaacttggaaaacaggggaaggatttggtttgcttttctgtcaggatcaacgtgacctccatgcctgtgatgtttgtagtgacacttcagcaatcactttattaattcatttgttcttcattcattcagtgtaaattgaatgcttcttgtaagtagacatatatgctagtgattatagccttaaaacttggcatcataggtttaatgctctgagtctcagccttgggacggtcagttagttttatttatttatttatttatttatttattttgatacagagtctcactctgtcacccaggctggagtgcagtggcgggatcttggctcactgcaacctccacctcccaggttcaagcgattctcctgcctcagcctcctgagtagctgggactacaggcacccaccaccacgcctggctaatttttttgtattttcggtagagatggggtttcactatattggccaggttggtctcaaactcctgaccttgtgatccacccgccttggcctcccaaagtgctgggattacaggcatgatccaccgcgcccggccagttagttttattcttatctgaccccacagttggtaatttcttcctcttttcagccaggccataggcaagtattagtattatataacattgcttaaggtagttacaaagaagtcacgtgtctcagaattttggacttgcaagagaattagagttaatacattcaagttcctttctattgtttgaatcttgtaattttttcctacataacaaaatgtttatgggtaattatgataggtgaggcagtgctgcaggataaggagatggatcagtacagtactcagaatcacattcggaagatgcatatacacagtcatttaagtcattttatggtaaattatgctttggtcatcatacattgatcagaagcataatctaagtcctaggttagtggtggagagtgagggaagtaaattaactgtgactggagagaggcaagaaggattcatagaaacaatttaaattgaactgaactttgatggctgggtgggaccttaattttcagataggtgagtggatttttcagcaataaaataaaagaattaaaacacagaggaaggagagctcaaagtaagtgtggtaggccttgtgtttctaactgtggaacctactctttgttctgaaaccattgacaatttattgtaggggcttgttattattttaaatataagggtgatatccccagaactgttgttggatgccaagtgatactgttaacataaattaaggcaaaacatgttgcacttgcaggaaaccccatgcaaacaattctgagttgtctggtagacttccttcagatccatggggacttacctgctgacatctgatggctttgaattcaggggctcaatatttaacttcctctttttatgatatctttgttcgtcttttcttggtgacttccagttgacaacttctaactctgcttctctgtttgtttcccagtcctgtggcttgctttcatttgcctactattcagtatttgcatacctctggttttcatctttccttttctgtttggtcctgcaaaatggccaggcttgctaatgtaactccaggccctccacattagaaaacagaggggttttgtccattggtgattacttcaaatgttaaacatttctctttgttattgagtagaaatgtgtccctttatgatgtcctcatattggttttctttccccttttaaaaagtgatgcaaagtcagaggaatgaccaggccaggagagagataggtgctgtatgtctcaaggagttgatgagtaaagctactgaaagatgttacttttcaaaggagtgagtaagcacagagtaacatgagctatgcccagaattagtggaaaagtagagaaatgtctgaaattgtttattttaaagtcagcctccaaaagctcttgagcatctattcttgtgaaaacaattcaaagctcatatatgtgtatgatgaatagtggcttataatcttttttctttttttttgagacagagtcttgctctgttgaccagcctctgcctcctgggttcaagcgattctcctgtctcagcccaccgagtagctgggactttataagcacgccccaccaagaccggctaattttttgtatttttagtagagatggggtttcgccacacaggccagtctggtcttgaactcctgacttcgggtgatccgcccacctcggccccacgaagtgctaggattacaggtatgagccaccatgcccggcctcattttcctacttactaattttatgtgtttagtttaacaatgataatttgaaaatcaattcaagttttagcaaaactggcactggaatttttttttttttttttttttgggacagagtctcgctctgttgtccaggctggagtgcagtggtgtgatcttggctcactgcaagctctacctcctgggttcatgccattctcctgccttagcctcccaagtagctgggaccacaggcacccaccaccacacctggctaatttttttagttttttatttttagtagagacgaggtttcaccgtgttagccaggatggtctcgatctcctgacctcgtgatccgcctgcctcagcctcccaagtgctgggattacaggcgtgagccaccgcgcctggccggcactggaatttttgtcttgtgattccatgtaggactatcatggtctcaggtacagaacaacaggattttatttttagacataaggaactcaaacctacagtatggccacattcattcatgaactcacagaaataggcagctgaactggctttacgtgggttggaccaccttatcataaaagtctgtctttctgctgccggttagtgtgataaaggaggaggaggctgggtatgaaaagagatgtcggctgtggagattaagagtagaggtagtggacagtgttgccagggcaaaaacaacatggtcagcaagagctttaatgtattctaaaatgcttgttttcaaaagggtgagaatacaaggatatcttgatccatgaaaacataccaaagagatgattgagatgcttatttcttcctggccctttgcctagttccttttgggtcagcaaaccccagttgatttgtagcttgtttgtgaccctgacagcaacagtagcagcagcagcagcagaagcagcaatagcagcagcagcttgctttgcaattatctcctatttttatggtccacatatgtaggtcattgtgtgtttattaaggctgggtaggctcttagcatgtcactggctctggtcattgtgactttctagaagcgaatgtcacagttttcctggttgctttttgctcttaatcatcatctgattggttattcagataagaagatggacatttttgttgtctggacttgtaaaaacccttttgacagtagccgacctagagtccaggggagtattccaatatttcatttagcattaggaaacttttaatggaatatcatagtttctcttctttactttttaagaacttaaagaggtaaaactttcccctgggattgatagtggagtatgtgtacatatacacatacccacctactcacctatatcaacctgattaccactgccaccactaccttgaaataatttgtgacacatttatactctctgcagtgaaagattggttaactgctcgacaaaaaaaagtcttgtggggaattgatggtggttagttctgttgaatgtagggataaccaatgaggttagctttgccttagctcctgagtttctgtatagggagtaatatactatgcttgcatatttcagaacatttcctttgctcaaagttaagtgagactatagttggttctttttgagtcagtgaaagttttatcccaatttgtctctcccatcaagagtcttagtggtttcttcaaaggtgaaatgtacttattgttttttttattttaacttacaaaaaagtagtgggtctttttctacttataagaaagtaatgtcagccgggtgtggtggctcacacctgtaataccagtactttgggaggctgaggtaggtggattacctgaggtcaaggagttcgagaccagcctggccaacatgatgaaaccccattgttactaaaaatacaaaaatttgctctgtgtggtcgtgtgtgcctgtaatcccagctactccagaggctgatgcaggagaattgcttgaacccagtagacagaggctgcagtgagccgagattgcaccattgccctccagcctgggtgacaaaagcgaaactccgtctcaaagaaacaaacaaacaaaaacagtaacgtaaaaaaatcaaacgatgtagattagatattttcaaatttatttctctatgagggaaaaattatgatctgcttatatgtcctgctcccaataaacacgccaaatgatgcttgaacattcttttcttccctgctccatcccacattctattaaaataatttggagaatatgttgtaacatttttaactttatagcaaatctcttttgagaattgtttcttgcattaaattttataaccacatcagtaataaactgtaacttttacctgtttgctgtgctattttctatttactatctttttcttgtattcatcatcttgattcttctcttttttgttctttttttctgccatagtacttcattaagtaattttatgggaaggctacatgcttgatgtatttcctgagtctttgtatatctaaaatgagttgttattgccttcatatttgagtaaaagcttggctataagtagaattctcgggtcaaatttgctttacttcagtattgtaccaagatttgcacactatcatttagtatcatttagtattcagtgcagcagatgagaaatctgatgccagtctgattccttttccagtttagtaaatttttcttgtttggtctataggctttatttgtgggattcagcaattttactaaactgtgtctagacacagctcgctttttacctattctgctatttctactcaagtcaaggttttctttatgtaaatgggattttcttctttcttttcttcttttcttttcctttctttcttttctttctttcttgaactcctgagctcaggtgatcctcctgcctcaacctcctaagtagctgggactaaaggtgtgtaccaccatgcccagctaatttatttatttattattattttatttttgtagagacagggtcttgctattttggccaggctgatcttgaactcctggcctcaagcagttctcctgtcctgatgcctctcaaagtgctgggtttacaggtgtgagccactgctcccagtcaagattttcttataatatgttgaaaatatattttaatctttcattcacctttttcttctttatgaactcctactatatggaattggatttcttctctattcttcatattagttttctttttccaatagttctactacatggagggatttctgttgcttacttcccttttatattcttaatttttgtggtgatagtctgcttttgacttataaatgctctataaaactgaatttggggagagtatttggtaggagtggctctggatatctgttgttcagggtagctagcttgcacttaaacctttatcttttatctgaaatgggaatatatagttatttaaatgcagggtggccatagggtatatacgttcagtcttcaaccatatatgtaattaggggatgcaggccagcagaagaattgcccttagatgcacaggtcaagagcagaccagcaaggttaatctgggtcctcaaggctaatggtttggggattcataggcaggtagcaaagcccctcccttacatgccatacatgtatgccaggtgagggctgcaggagctgtggccagcgcttatgtatattgatctctagttgaattctcaagcccctttgatttcctccctcattgtgttttcatcggtgactttgcttctcaatgacacactgtcaccagcggtgctgggaattgtggcagagtcctttttgttagaaagcataaactcattaaatcacttcagtcaaatcacttttgactgactttcattaaatacccctaacgtccattctaaagagccttgccccacccctcaccctttttgttatgacagttcctggtgtcctgctcaggtcctggtgtcttttgctatgtatctcaaactcactttgctgcctgtgaggagttcatcacagaaaacgtgctctctgatagcattatctaagccaaagaaagcttcagagacagcataatgcgatggttaacactgcaagtgctcttccaggcttcctgggtacacatctggcttcctgcttactggctgcatgactgtaacgtgctgctcaacctttctgtggcccacttaaatcctctgtaaaatgggtgattgattgttgtgaggtttcaaagacataatgcacataaagaatattttatgtaattgacatgtcctaaaacttagtaaatattttcactgttgtgatattttgggctagcaggtctctgtgctgggttttgccatagttgtcactgacatttgatttgcaccatgcctcctcagagttaacccgtgatcccatcccttgctattataaggttcaggattttatatatatatatatatattttatttatattttattatatatttttatatatttatatttatattttattatatatttatattatatttatatttatttatatatatttataaatatataatatatatatttataaatatatatatatttttttttgcagaagaaatactcccacaaacttcctctataaaatgaatgattgaattaaataatcatgtagctctcttacagctctaaaattcagtgccttggtaataaaatatcacttctttgtaatttcatggtgatttataatttgcaaaatacattataacagcacaagtataatttaactaatgaaataaaaatgaggatccaagagttgaaggaacttgtttagatctcataattgtcatgaaagcagttacttatttttaaatagacaataacaaaatcatttcggtgactttttacaaatgagagaatgtggatactcttaaatcctcaaaaagcagccattgtcgtcaataatatatgttgatgtttagtaaccatgaacctccgaggtagttttctttgtaattttttagtggaagattagcacatcttccatcctggcctctagcatattttctgacaaaccccttgttgattgtatcacataccttttatccatggatttggtacgaaagccctattgggcccacaaatctttcggttcttttgtaatttacataatccaatcaacaggggcacagaaacaccttgttctgaaagaaggagtgaaagggagtagaggatgctgacaccaaaaacctagggcactaactcatattttatctctgaatatagtactttgaaaccctagtgtcttaggaaggttttctgttcatagctgatttcacttgatccattcaaaagtcaagcatttttgtactcttactatataacttaaaatatattatagcatggggtgtttataccaatccttgaggggttaagctattattatcattattttatcattaacttctgtgagtttgacttgtacagggcctcctagcctgcaaatttcaaaattgacgtcttttttttttgagacagggtcttcttgctctgttgcccagtctggagtgcagtggcatgatctccactcactgcagactccacctccagggttcaagccattctcccgcctcagcctcctgagtagctgggattacaggcacgtgccatcacacctggctaatttttgtattttttttagtagagacaaggtttcaccatgttggccaggctggtctcgaacacctgacctcgtgatctgcccacctcagcctcccaaagtgctgggattacaggcgtgagccactgcacccagcaaacattgctttttttaataaaagactttcatatactttatctcacttgaacctttagacaacttctgcaaagggaaaggtagggaggattctccatcttgtatcagtgaaggctctggggctctgaggttaagcagcattccaggtttccatggcattaactgtcccaggcagggatgaagctctctgagacgtgccagtccatttctctctccattgccatcgctgctgtattgttactctccctttatattcatttttagtgaaggaaacaaaacagcagttgtcactttcctttcccagtagtttcattatttgctgtcaccagttctgttgcaggatcctctattgtaatattgtcttcagattttaaaaaatgtatctctacatattggaagaaagcactgtggtggaaaatacaggaaaactgtgtacagacctgttaaatggaaatgttttcataatttttagttagttttatttgtattttactaatgaaatttagtaaagatgtcaatgtcaatctttcttactacggaaataagttaaattttgccaactagtggaaaaaaagtttctgtggcatttttttttttaaggaatacaggattgatacaagaatgagagcattcatattataagaaatataagttttgtggttttttttgaaataaaaatttggtttatgagaggcttaaaaaatgaataaattcccttctttcctgatagtttctgtcgttcccttggggattaaaggagtgtgaatctatcctacagccacttcctctctgaactgtagatgacacatcaggatgtgatttggggtagatcaagcctcagagtcgaatctcagtgtctagccgtagaggtggtatgatagtatgataattccacatgtcctgccttctgggctttttgacattcatagcatttctaaacaagtgaaggatttatcttaaaaaataaaattttagtattttcttcattattcgtgagctttaattctttccattagaaattatgtcatccccatatttagagcaatgaataattgcataacttttaaattgtgtatttgatggtatggtgtatattgaaaagagaatgagaaactatcccctgaatagagatttagtgattcaagccatcactttctaaaatatacgcacttcagagtgaaagttcagtgtcagaacttcatagagtgtctggccagctagagttaggtatttcatggagagatgatcaaacaattgaacagaaaatacagcaaccagaagagtttttcactgtgcatgttcagaagacttcatcatttttattatcattttatatcaagccattttataagtagagatgtgtctagaggattgttttcatttccttttagctcattgaaagtcatacagtgtcactttagtaattctcttcttgcccagtggggatagaaaccagttttgggccacggcaactatatagaagtattttcatagagttacagattcattaaatgagaccctctctcctccccttaacacccactgtgtttctgctataatgaggatttaagcaacagtcccaacatgaactagctcatttcagtactagggaaatggctgttgcatgggtttaccacctctgattctgcaacaattgttctttttctgacagcgtcttctacctcctccaggcaggcacaactcttgatgacttgaacctcctatgttcttttttttcccccccagcttgtaaaattatggtaaaatacacataatataaaatttactatcttcaccgtttaatgttctgttcagtagcaatatgatgaagtacattcatattgttgcaactgtcaccagtatccatcttcagaactcatttcatcttgcaaaactgaacctctataccgcttcaccaataaccccccattccactctcagccagcccctgaaaccaccattctactctctgtctctaagattttaacttcacgagcacatggtaaaattgtaatcagattgtatttgtcttcgcaactggcttattttacttaacataatgtcctcaaagtttatccatgttgtagcatatgtcatgctatatatatgtcatgttctgcttatccgttcttgttaatagacatttgggttctttccccattttacctactgtgggaataatgctgctataagtatgggtgtagaaatcactcttttggaccctgctttcagttattttgagtatatacccagaagtgaattgctagataacatggtagttctatttttaatattttgaggaacattcataccattttccacagcagctgtactgtttccattcctcacaacagcacacgagttctgatttctccacgtccttgccgacactgttttttgtctcgataatagccatcctaatgggtgcagagtgatagctcattgtagttttgatttgcatttctctaatgattactgattttgagcatctattcatgtatgtattagccatttgtatatatatatcttctttggagaaatgtctattcaagttctttattcatttttgaatttgacttttttttctttttgagttttgtaaggtctctatatattctgaatattaatcccttatcaggtatgatttgataatactttctcccattttgaagattgcctttttactccattgatactgtcttttgatttttaatttttatgaaattcaatttgtctcttgtgttatttgtgccttttgtgtcatattaagacattcgttgccaaattcaatgtcatgatgcttttgcatatgttttattctaatctacaattttagatgttacctttaggtcatggatccatttcgagttaacttttataattatgctaggaaagagtccacccttactcttttgtgtgtggatattaaattttcccagcaccatttgttgaaaagactgtccttcctgtattaaatgatcttggtgcccttgtaggcagtgacttgaacatatatctgagggtttatttctggactgtctcttatgtgttattatgccaatagcacactgttttgcttactttagctttgtattaatttttgaaatcaggaagtgtcggtcctccacctttgttcctttttactcaggattgttctgcctattttaggtcatttcatattccatatgaattttaggataggtttttctactttttaaaaaatgtcactgggattttgatcgggaccgcattaagtctggatatcatattggttgatattgacatcttagttatattaagtcttgcattctatgaacatgagatgtctaccatttatttatgtcttctttaattcctttctgaaatgtattcaagttttcattgttcaaggcttttaactatttattcacgttaatttctaagtattttgtcttttattttttgatgctattgtatatggaatgatttgcttaatttcctttttgaattgttcattgttgatacaaatgtaagtgatttttgtgtagtaactttatatgctctacttggctaaattcactatttagttctaatagtctttgtgtccaatctttagggttttctacatataagattatgtcatctacaagaagagatgatttaattctttctttttaattttgacacctttatttttttttcttccctgattactctgatgaggacttccagtattacactaaattgttatggcaaaagctggtattcctaatcttagaggaaaagctttcagtcttttatcattgagtatgattttctctgtgggtttccatctgtggcttttgctatgttgagatagttttcttctattcccagtttgttgaatatttttcttatgaaaggatattgaattttgtcaaatgcttttctgtgtcaattgagaagataactttttttccattctgttaatataatatataaccttgatttgtttgttgagtatccgttcgttacaataataaatttcacttggccatgatatatcaaacttgtaatatgctattaaatttgacttgggatatttgattgaggattttgcatcaatgtttattagggatattgttctgtacttttcatgtagtatctttgtcggactttgatgtcacagaatgagttaggaagtgtttccttctttttaattttttggaaagatttgaggataattgttgttagttcatgtatcaatgtttggtagaatttactagtgaagccatggttccagattttttcttactcagattttggatactgattcaatcttcttagtattcatagcatattcagattttttatttgtggtttagtcttggtgcattttgtgtttcttgaaaatttccctgtcatctgggttatcgaattttttgccacacacttgctcatagtactctcttaaatcttttttatttctgtagaattgttagtaatgcccctacttttatttttgtcttttgtagtttgagtcttctctctctgtctctctctcacttcatctagctaaaggtttgtcaattttgttgatcttttttaagaactgttggattttgttagtattctctattatttttctattctccattctacttatttctactcttatctttattatttcttcccttctggtagatttgggtatggttttttctttctttttttccaagtttcacaatctgtagatttaggttgttggtttgacgtctttcttatctttaaatttaatggtgtatagctataaattgcctcgtttgcactgttttcactgtttcccatacgtttggtatgttttctttcatgttcattcatttttaagtatttttctatttcccttgtgatttctcctttgatccattgtttgttaaagagcatattattggctggatgcagtggctcacacctgtaatctcagcactttgggaggccgaggtgggaggatcacgaggacaggagtttaagactagcctggccaacatagtgaaaccccatctctactaaaaattacaaaatattggccgggcgtggtggctcacgcctgtaatcccagcactttgagaggccgaggcgggtggatcacgaggtcaggagatcgagaccatcctggctaacgcggtgaaaccctgtctctactaaaattacaaaaaattagccgggcgtggtggcgggcacctgtagtcccagctaatcgggaggctgaggcaggagaatggcctgaaccctggaggcggaggttgcagtgagccgagatcactccagcctgggtgacagaggaagactccatctcaaaaaaaacaaaaaccaaaaaacaaaatattagccgggcgtggtggtgggcacctgtaatcccagctactcgggaggctgaggcaggagaatcgcttgaacccaggaagcagaggtttcagtgagctgaggtcgtgccattgcactccagcctgggcaacagtgtgagactccattaaaaaaaaaaacaaacaagtatattatttaattactgcaaatttgtgaattttgcagttttacttatgtctatttatttctatttttatcccattgtgctcagagaagatactttgtatgacatctactttttcaaatctattgacccttatttagtttatgggcttattcatgttctatcctggaacatgtcccatgtgcacatgagaagaaggtgtattcaattgttgttcaagtcctctatttcctgacttacctattgtttggctgttctatccactgttaaaagttggacgttgaaatctctattattatacaactgtctatttcttccttcaattctggtaatttttggtttatatattttgatgatcttttattaggtgtgtatacatttacaattgttacatattcttgatgtattgagcctcttattaatataatgttcttcatctcttttttgtcttttagccttttttgacttaaaatctattttctctgatattttgctagtctgctttttgtgggttactatttgcatgaaatggtgttttctgtcctttcattttaaactgtttgtgtctttggatataaagtctcttgtagacaacatatatttgggttatgtgttttaatttattctgccaacccgtcttttgaccagagaatttaattcatttacatttaaagtaattattgataagtagagaattacttcttattttcctacagatgctccttaagttgtgatggggttatgtcccactaaaactgtcttaagttgaaataattgtaaatttaaaatgcatttaatatacctaacataccaaacatcatggtttagcctaacctactctaaacatactcagaacacttgcattagcagacagttggaaaaaaatcacctaatataaagcttattttataataaagctttaattatcttatgtattttattgtatgttctactgaaagtgaaagacagaatagatgcttcaagtatcgtgtttaatgaatgtgtatcacttttacaccatcatatggtaaaaaaattgtaagtcaaacccttataaaatttataagattataaaaccatttatatttattttctatatgctttatagtttctttgtcctttatttcctatataattttttttgtgtattcaattgattttttgtagtaaaatatttaaattcctacctgatttcttttgtgtatattctgtagctattttctttatggttacaatgggggttacatttaacatcctaacgttataacactctaatttgaagtcataccagcttgacttagataacatacaaaattctgttcctttttcagttgttgatgtaacaaaattacatctttatacattgtgtacacaacaacataagctaataatttaatacactcatttcttaaattgtagaaaacaaaattgggcttaccaatcaaattacaataatatgagattttaaatttgtaatttaaaaaaatattagtttcttaaatcatgtagaaaacaaaaagtaaagtcacacatcatgattacaatgatgttagctcttataagcgtctgcctatttgccttttctgacatctgtatttctttgtatgatttttgagttactctgtagtatcatttcttctcaacctgcaggcttcctgttagcatttcttgcaggagaaatctaacagtaataaagaactctctcacctctttttttttttttcatgactggcattttgattttctttctcacttttaaaataaaattttgccagatgtaggattcgtggttgataattttttttccttttagcactttgaatatattggccctctgttttctggcatctaaggctgctgctaagaaaaccggataattttattgaggatcccttgtatgtgatgagtcacctctcttgcaactttcaaaattctccggttgtctttgtcttttgacagtttaattagaaggtgcctcactatttgtctgtttgagttcatcttacttgtacttttttgagcttcttggatgtttatactcttggctttgatcaaatttgggggagtttttggtgattatttcttcaagtattgtccctgccttttctctctgtctcatacttctgggaattccatgctgcatactttggtatagttgattgtgtcccacaggtctcttaggctcagttcacctgtcttcaatcttttttctttctgattcttagactaattaatttactttgacctctcttcaagttttctgattctttcttttgctgttaaatctgtctttgagttcctctagtgaattttttatttcagttattgtaattttcatttccacaattgcttttttttctttttctgtattgatattcccattttattcatgcattgttttcttaactttctccttgcttcctttagttctttcagcatgtttaagacagtagttttaaagtcttcgtcaggtagatcccccatcaggtcttttttagagacagtttctgttggtttatatttttgttttgaatagaccgtgctatcctgtttctttgtatgtcttttgattttttgttgttgttgaaaattgcatatttgaaactaataatgtagagccctggaaatcagaccttttctcttccccaaggtttactgttaccgtttgtattttgtggggttattgttgccagtctctgtgctaagtattagctttttttgttaacttgtggtcttaagtattttctgagcctgcatgtttccctggttatgtgccatgactttctcatttcctctgttgttttcaaatgccctggttatcaaggtctgtctcccaaaatgagaaaaagtaaaaaataaaggaagaaaaaaaaaaaaaggactggccttttgagtcccatggaagtcacttcagctggagtgagaggggcaacactaatgatagttgcccctttttctttatgtgtgtgattaaaagcagcaattaatgttcagtccacagatccttgatatatggaagacaggtcctttttgcccagcttggatcatgtaagctgtatgcaagctgcttcaagtacatgtgcacagatgcctgccaaggatctaagaggtggggtataggtagttgctattgtgctgagatgtaaactttacctaaattaaccacaacttaccatctaaagcttccctccagaaagtagactcctttaatagactctggacttccaaaataagttgttgatatagatggtggcagtgcaatcgttgtctaggtggaaagacagatttgtggtgcctcctgctttgccatattctcagaatccctttcacttccttcgatttttactaagcagaactaacttccttaattcctctgccatgcctgcaactattccttttctcccttctttaccaccccctcctcctttctccctgtctctaaatttaggttcccactcagagttctcactttgaccttccgttttctctcagtagatgtcactactctaataagatcaactttgatctttctttatctaattatttgaactgcttgtgacttggtactgtgttttcctttgacaagttttgtttcatttatccatgagatcttttcatagataacacctgccttttcactttcaatgtatccctaattctactcatcatcttactcaaaggcttacattctgttagacataccattatattttctagtcttgccaactaaatcgtgttcattgatgatatatcttgctttctttgtatatctatcaccaaggcttacaggattatttcaatctctttattttcttgcccatcatcctagttcatatcttctgggttacaacctactcattgccttcattctatctttttcacattccaactgcatatctgtaaccacttagtggtttaaaaaatattattttcttcctttggcttttccacattaaatttctcctcttggtttatttttcagagtactctatgacctacctcatcctatgtagcacactgtatctcccactgtcctttttatacagtccttgctcttttgaagctcatatcgtcattgtcagcttcatatgccaagccaatttttcttgtgtctttctcaatacctgatgaaccctcatatcctcatttttagaagcctaactctactattttactcatacgtgtctgacaactggatcatcttgatctctctcttctctgcatcctcagtcttttgattgagtcatgtgatgtggtggcatgagcccagggtttagggctaagaaaccctgctctgttgcttatcactgcatttcccatctttacatgcaaaaatgaggatattaataacaatttttagaaggttattttgaggactaattaagataatgtagagtatccaacaactgctggttcagagtaaaggctactatgagtcagttaataaatagatttattaatgctgtttgattttttctgccacttaatatatacccttttgtggggtaatgtaatcattgcatgtacattaatcttgccaccaaactttattttataagccagaatcataaaataacatgggagacttgtagaaattatttaaaatcacaaatcgtagagcaccagatttgacatggtcctaacccctctgccctttcttgtgatgaggaaactggagcctaaatttcttaagtgaactgttcatggtgacacagttactaggagagctggtcctaaccacaactagagatttctggactcccaggcctctgctctttccattaccttcttgttcatttattttagcaattgcctgaaggcaggatcacaacccatatttctgtatcacccataacctttattttcatttcattttattttttttgagatggagtcttgctctgttgcccaggctggagtgcagtggcgcaatctcggctcactgcaagctccgcctcccgggttcacgccattctcctgcctcagcctcccaagtagctgggactacaggcgcccaccaccacacctggctaattttttgtatttttagtagagacggggtttcactgtgttagtcaggatggtcttgatctcctggcctcgtggtccacctacctcggcctcccaaagtgctgggattacaggcatgagccaccacgcccggcccataacctttattttattgcgagaagatagaatagctacttgattgatatttgtggcttgattgatctattctttcttcgactgtgcaataggaattctctgggaaaggactatgaagtctgtatacttatcacccttttgatgcttttggggttgttgtaagcatgcaaagggttcattgtgcactgcttctgtatactgactcagggtggtggggagaggaaatgggagaggaagttatatacatcttgagcaaatcaagcttttctatttttagtccttgctactgtttggaaagtacagcctctgttcatggcagtctggcatgtgtttccttagtgccatttcgaaagggggaaaaaataaatatgggaattttttttttttgtagtgaaaatagttactcagtgaaatcacataagtttcccgtttttctcttgatgaaacctcaaacccactaggcacagattcctcaacctcaactatgcatgtgaaaggctcatgcagaacaggagaccagagtcagcaaaaccttgtatagcaagataagctgtggtgccccagagaagcgcggatgggtggcggaggtggggaaggcagggaagggaatggtgatgttctttcatatttagtggggaacttggccaactaccagatcgttgccccctggaaaaggctgaaacctgaactaagataaagagacacatagctttgcagctttttgcttaagctgttccttttgcttcagtttctgtccttggtaaaagtttccctgactgctttatagctactcccccaattcaaataaataatttttctttaatagttgtgatggcatttgggagatttttccaatctaaggctatatcattaggacacgataaagagccttttatgctagtaaataaaatgatttgatctgtatttagatggattgctataacatagtggtactcaagtgatcagaaatggtgatgacagagtgtcttggagtcaccttcaggggtccattgaggcagacaaggaccttaaccaaggtggtggccatgaccatggagaaggggaacaagaatcaaaagcaatttggaaagagggggcttatgggaaagagaagagtccaggatgcttggcaggattgtgactttcttcagggagaatacatatccttcctgtcctagtatgtggcaaatggaagaatcctttggaaaaaaatgaggactttgaagcaggtgtgatgtgaatgttactagaggaaatgttgataccaatgagcaaatattgccctttgttaatgaaagggactatacagtctccagacataaacagctctgcctagacaaaattgtagcagtagggtgagaataatgcattgctataattaatgctaatttgtggatattgctgtattgttgtcattgttttttaattgaatatgtattaagctccaacagggtgctatgaataatgccaacttatagttgatttatgagaacactcagaagactttattaacaccagtaaatggaaactcgcactccttcgaggtggtaaacgtctttgccatttcgacagatgaggagaagtgaagtagattgtgttttctctgttggcactgcgggtgagaacacagaaactgtcgaatgagagaaaagtattttccttgtcccctggaattgggttagaatacattagtaaagaattctttaatgtgttcagagttgtgggattttaattaaattgttccagttattgttagcacttggattagcaactggcaaccaaattctaggccagcagatttcaaatttagcatggacaagaattggggtgaggccgatgggtttgttaaatgccaattattaggccctgccttcaaaggtttagatttggtaaatctaggagggggcttaggaaaatcttatgttcatggatatcgaaggtgcttctgtcctcaaaggttgctagcttcctttcaaaactccagtattttcttattttaggacgtatctttggccaccaaaatctagcttcacctgagaccaagggctttttatttaatagctgcaaattctcttataacacaccaagtataatcctgtaatcctcttttatacacaacataccaccagaaaacatgtgcagaagacttaccgtatgcttagcattctagtggacacatgatttctactaccttatttcacctggtctccaaaatatccctgtggggttggtattattgctcccttatttcataagaagacactaaaactaagagtatacgacttggtcaaacatcacatccagtttaatcctttctatcttaacctggttaggcatatattttactttaagtttgaacaacaggtgggattctttttggcactgacagagtttgcagttgacagtagagactgtaaactcggcttaagtggacccgtcccataaagaaaaacattcacattggaacaagggagaggtgaaaaggaaagttggaagtgagtaattcaacttttcatttttttttgtccccttccttccttccttccttccttccttccttccttccttccttccttccttccttccttcctctctctctctcttttctttttttttttttgagtctcactctgtcgcccaggctggagtgcaatggcatgatctcggctcactgcaaactccgcctcctgggttcaagcgattctcctgtttcagcttcccaagtagctgggattacagttgtgtgccaccatgcctggctaattttttttttgttgtttttttttttttttttgcatctttagtagagatggggtttcaccatgttggccaggctggtctcaaacttctgaccttgtgatccgcctgccttggcctcccaaagtgctgggattagaggcgtgagccactgcaccgggcctgtctcatttctttaatacgaggtactaaactgtcactgagtaaatagtagacatttgattattatttgactctgaatattttttgaaaaaaggaacatttcataagaaagcctgaaatgagacatgagcagaattctggggtatagaaatgatttttaagttgagacaagaatagtgaagcttgagacgacattattccttgcctcctttagactttcttcagcctccacctagcaaagtaaaagtcttgtcatagcagtctgttgcattgtattccctgggtctaaggcagaaatgtgtacgtgctccaataacccttgtttgttgtgctgtggaatcacgttcatttctgattaaggtgaaatcagtagctttctgatacggtctctcactcactttttatcaatggcaacctttttcctaaaaataggaatttctgctgggagtgttttaatataaattgtctgtgctcagcctgaaatatgtgtgattcataccatgtgtttgttcccacatcaacactaagtcccaagatacaattacccctgcccactctctccttcgtcatggggaatgtgtttatcctttagatatcagcaccttgggtaagagccaatctccttatatgccttggtttgcacacctgcattgtctgaccacagctgaccctttgagtctgctcttactctatttttaccttaaagaacactcgtgtttgccaagtacacttgcacattgcagagttccttctatatctttatgctcatgttgtaaatatgttaaatacttgttctccatttaaggccttctcaattctgtcgccatatagctctctctgatttctctattcagctactttctctctttcctctctctcattttgcttttttctcgaacatcttgtgtgtcttacctacatgtagtctgccttctaatatggacatttgtggataaactagtttcttcaatgcaactgtaagctcttggcagagaacccctgatccattctctttccctccctccccttccttctccctctccctcctttcctttctttcttccctccctgcccccctccctccctccctccttcctccttccttcctacctgcttccctcctttcttcctacctgcctccctccctccctccttcctttctacctgactctctccctccctccttccctcccttcctcccttccttcctcccttcctccctccctcactcccttccctcccttccctccttcctttccctcccttccctcccttccttccctccctgccttcctccctcccctctctccctccctccctcccttgtccctcttgcctgaacttcatatcagtgtgtcttgaatatttgaaaaatatttataggaaagtgaatgaaacctatcctaaatggagaagtagatggcaaaaaagggtattagagcttggcttttcaattgtaattgtagccatgacctaatttttggtaatctaataggcccatataatctctgcttggtgttagaagggaagacctttcaccttttgtgttttcttcctaatgtcatgcaaagtgctagagctttggagcaaaatgtttgatttccaaattccaattcttccatttactgcccgagtaaccctagaaagttctctttttctctctgatccttgggctatcctcttttgaaaacaggaataataacatctactaatctctaggattgctggaatagctcgatgagatcgtatatatgaaaatgcttttctaaacctgagcacttctctgtgataatggccgtacagagggagctatgatattttccctcttgttttcccagtagtgactatgtcccaggctgtgtgcagtggactgggtagctgcctagtaatattgctggcttgtaggatatttcctgttttatatgttcttaagaagatcagttgaaatgtacgagatgtcgttttggaaaagatgtttcacagtgggaggtgttaaagttttagtcctacttcagccccttcactatacaaactaccttacctttttgggggaattgtattatctttaaatgaaaatgatggaatagcgacgtaaattccccttctagttctaatattttatgagccttatttccattttctatgcttatcaactataaatgattctcttgcagttgttcaaacatcttttatctgcacatcctcatcaatggtatttaacatatagaatcagaaccacaaatgtttgaagaaaattctcggccagacatggtggctcacacctgtaatcccagcactttgggaggcctaggcgggtggatcgcctgaggtcaggagttcgagaccggcctggctaacatgatgaaaccccatctaaaaatacaaaattagccaggcgtgttggcacgcacttgtaatcctagctactcgggaggcttaggcaggagaattgcttgaacctgggagacggaggtttcaatgagccaaggttgcagtgagtgccattgcgctctagtctgggcaacaagagcaaaacccggtctataaataaataaataaataaataaataaataaataaagttcccaccctctgtacgtttccatggcatgacgctttgctttatatctctgagtacatgatatggaatatgggacatgggaattgaatacttttttatggtttccaattttggtaacatttaaggggtcaaacaagagttcaagaaaaaaaatacttgaaaatgatgagctaatgtataaagttaacatcacatttctaactatttgaattttggggaatgtgagaaagtggcttttgaaatgtatcatgcctgagcttattaagcctgtgttaccaaaatgaaaaataagaaacatgtcttccttgaggttttaaaaaacaaaatcaatagcaaaattacctgacaagttctgtttgattcataaatccacacaattgttgcacatctccagccccctcaccacatatgaaagttttcttaatgtaaaagtaaaccttttctcccctacctctaaaaacttctgtctaccaattttattatttcatgttattttgttatgcaaaggattcctggaaaaatatccatgatcctagatgatcttatggatatctttataggtatttcaatgtagaaatttcaaataaatgtatttcccttttatgcacaaacacagagttcagaaaagacagttcatttagagtttgctaaactgtgtgtgtggactaactggtaaggtgacgctctaggatggcacagcttgcctagataatctgtagcagtggtttttaaactattaatttcttagaattgcttcaggaaatattactaaaggagatgggggataaagcagctctgtctgtatatgtttcatacaatgggtttccgtgtctgatttcattttaccaggggatctgctgcttaaaaagggggtgccaaatatctattttactgtcaaatagttcatcttattgtgattattcttagagttcctgttttattgatgaatagataatatatgtattgttccttattattatctatgcaaattgacctttattttaattgtaaggggttactttaaaaatatattatttatattatttttattttataaggattggaattcagtagaaatcattcaacgagtaggtaaatattgtgaaaagtgaggggtttttgttgcatatttagttttgctttcttatttgaatagaacagtgaacagtgaggctacttgtgtatacccaagttcagatcactttaaccatgaccctgcccttacttataaaagagttggcttaaactcggagttggcctaactcttacgggtttagtctgatggcttttgaacagcaaagatagtgacaggcaagttgtgaaatgtcattatagatctatgcagtattagaggttaaaaaaatagaaaacgacctggaaggtgcataccctcatttttgtagaggtaaaagttgagttccagaaagtcaaagaaactgcttgataatatcagcgggacttggtcttgtttaggctgcttcagtagggctgattgtgtgaaacagaggccccctggagtagcgctgaatcatggagtttatcttaaggatggatctgaatgagatctgatatcaggaagctcagggtcagggcagatctgtggctgaactcttccatctatttttcttctcattgttttttttccctctctcccttcctcttttcctctcctctccattcctctgcttctctagtgttcgcttgttcattgttttcctccacccaatgatagacttcctacctcctgttgtatgtttggattgttaataattaaccatgtacatcatctttttggttgatcacagccatagctcatccctgtggcaattttttattttttattttatttttttttttattttttgagtttcactcttgttgcccaggctggagtgcagtggtaagatcttggctcactgcaacctctacctcccgggtgggttcaagtaatttttctgcctccagcctcccaagtagctgggattacggttacccaccaccacgcccagctaaattttgtatttttagtagagatggcgtttcgccatgttggccaggctggtcttgaactcctgacctcaggtgatcctcccgcctcagcctcccaaggtgttgggattacatgcatgagccaccgtgcctggcggcagttttgttacatgtttttcagtccaaacgcataagagaaggagatttatttgcccatctaatctccttgtcactgtccaaaagttaggttcaccagcctatttatggacccttggttctgtgggcctcagtgttctgaaatggagtcgcatggttgaaaacatggctgttttggcaacaaagaatgggggcaggaccatttcctttaaaggagatttgggttggccaaacattgctaacactgggtgagtgtgttagggctgaaaaggatgaaataatgtaaattgtgaggaaaaaaaattcaagcatttatcaagcgtagcatttatgttctatgttgacgtttgatacggcttggatgctttttccctccaaatcatgtcagaatgtgatctccagtgtttgaagtggggcctaatgggagatactcgatcacagaggtgaatctcttatgggggtttagtgccatccccttggtaatgagtgagttcttcctctgggttcacacgagatctggttgtttagagagtgtggtacctctccccaagccttgttcctcctctcgccatatgacatggtagctccctgttgccttcattcatgattataagcttcctgaggctctcatcagaaactgtctggatattgacaccatgcttcttatatagcctgcatagtcatgagccaatttaacctcttttctttataaattacccagcctcagctattgttctatagtgatgcaaaaatggcctaatgtaacgtttttgtgctttatcatgaaaaactcttgtcttctgttgttaccttatttcttgtttatttaatgctgtgttctcagttgtcaagccagtattgcacttcagattatggaaatgtattcccccttatgaatgctctagtgtttgctcccaagacagcttttgcgacaacttttcccactgcctttaacatgtggagaagatgtccttctcggatattaataagacttgagtttaggcctggttttgcatattagaaaagttgaattgtatttctgttggccattagataagaaggattttagggaaggggactgtttttgtttttaaatttgtgtctcttccacatagttttacaaagagtatcaaataacatagtgaatttgatatctctaggcaaaagtgcaagtgatatttttcagtagaatacatatatataaactcctcaaggttgggtatcatggcttttttacactgcatactacttagcataaactattttctagagcagcatgggagaaaagccatccactcaaatccatcatgagagttaccctatgaacattggtgtcatggaaaattagacaaagaggagtcagttatcaagttagtgggttatttgtaagtcctcctcccctggagaagggtacatttggggagatagataggtaaggtttttggaaagctaaacacttcaactgaatgactgggaaagaggatacacatcccaataggaatgcattcattttttccctaacttacaacagtttgtatctctttccataaaatgatatttctattagataaaatagatcatattttctgcaattctcactactgaatacggcctgtgtccactgaacattaccaggatccgtttggtgaggctgctcatattactatacagcatgagagattatattaaatagaaatgttactgtcttcatttttatttttatccaaatacctcttagctattatttggtgtgtcaattggtattttcatggcatcattaaccatatatatgacataatataggttgtttttaagggaaataaactataaattcactcagtacccacccttactccccctgccccacacacttaaatgttcattgtgttagaaatccacttagaaaagtcattctcaaagtgagaacacctcactttgagaatgactcagaccagcaccatcactggggatgttgagaacatccccataccagcgccatcactagcacctacgaacttggtagaaatgtaagttcttgggcctcacccaagatgtacagataagaaactgtggcaggtacagcctggtaatctaaggtttaataagtcctcctggtggttctgtataggctaatgtttgaaaaacactgatctaggattgtgttctttatggttaattcctggcacccttacacatgttcagatgcatagaagccccatctactgaagcctctcagtaacttagttttacttttgatcaaagtactttataaagtcacatactcaattgcctgactattaacagaagcatttattttgagactattgtcaaagtaacaattaaatagctagcatttattgaatgcttattatgtgaatattacttgacatgcataaacctatttaatttttacaactgcatgagggacccgagagctcaggtgaattgttgaaggtcacaaagccagcaattgggagatacaggtattacagcctgactccaaagctttcaccagtattcttttttattagggatactttgaggaaattacttaatacaaatgattatagacaaataaatattgattgtttccccaatttcatcaaagacagatgatggaaaaaagattgatctaacttacaacaaaatgattacactttcaagagaaactagatagaaatagtttggatatctgtcccctccaaatctcatgttgaaatttaatccccaatatttagatgtggcctagtgggaggtatttaggtccctcatgaatggcttggtgcctgtatgagtctgttttcacactactaataaagacatccccgaatctgggaagaaaaagaggtttaattggacttatagttccacatggctggggaggcctcagaatcatggtaggaggtgaagggcacttcttacatggcggtggtaagagaaaatgagggtgatgcaaagcagaaacccctgataaaaccatcagatctcgtgaaactttttcactaccatgagaacagtatggaggaaactgcccccaagattcaaattatctcccccttgttccttcccataacatggggagttatgggagtacaatttaagatgagatttggatagggacacagagcaaaactgtatcagtgacctccccatggtactggtcatacagagtgaattctctgttagttcataggacagctgattgtttaaaagagtatagcacctctcctcgctctctcttccgctctctctcaccatatgacatgctgcctcccattaccttcctccatgagtaaacgctttctgaggccctcaccagaagcagaaggcagctccatgcttcctgtacagcctgcggaaccatgagccaaataaacctcttctctttataaattacccagcttcaagttttgcattatagcaatgcaaaacagactaacaaacatagtgtgttttgttacttaaaaagcacacactttcaaaattcctttagttatcaccattttcccccactgatattagaaagaagagagtaataaacattactgaccataatagaaaaaaaatacagtgaaattcctgttgtattattaaatttaaatgaaactaccattgaaaagaaaagttgtatgtaaacacaatgtaatttttgtattattagcctcttaggttttactaaattaagacagttttatattcctaagttatcagggaaagcttttctaattaatcacaaaaggaagctcaagcttgggtagggtctgggaacctctttgttttccatatgggatcagtggtaagacattccttgagctctgtgaagcacagttgaaaaaaataggattatgtggttactttctcaggtctgtaattgagcagtcacattcaaattccggctttttgaactcacaatctataatgtgtcagtatggttgtctacctcagagattctgaaggttgttgaagattagttcatggtcatgtatgttttgagtatgacgctgggcattggatctaattctagtatataaacatccaagggtggagactgtttcttaattaaatagaccattccccttggccttttgtttcctttaatatcctggataagattttcctatgtaacagtttttacttgatgattaagtttctgatttttttttcatagcacaggacttttcagttagtcctgctcccctaccttgaaaccgaaatgaatactgaacaaataaatcgttaacgtattaggcaagatatgtttattttcatcccgtttcacaatcattaaggccatagttagttcaggcaaagatcatctatggacactaaaaccactgggtgggtgaaaggtttttgactagtagaatactcacagtgccccaaaatatcacctcacagattatttttaatttaaaaatcatgcagtcatgcttaaaatggtgaaatctggtacacactaccttaatcgagtcatcaaactcagcatcaccaagcatgggccaaactgacccttgagcttcctgatgggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcagctaggagcctgttctaaattaaaagagaataaaaagacatatcattttatgatgtgatccttggatttggggtgaaaattaacagtagataaaagaacactactggcaccactagtgaaatgtgagtatgggtgatattagataatactgtttctatgttaaatttctccagtgtgagaatggttttgaaaaaattagaaattcttaggagatgcaaactgaggtgcatatgggggatgtcggggggtggttttgcaacatcttacagatggttcaattgcaacagcaaatctaatttatgtagacagaaagctagtgtgatgaaatggtggccactgatgaatctgggtgaaggatgggtgagtggagtttattttaatagttgttcaacttctctgtgaatttaaattttttggatataaagaatgaaaaagtaaataaatacaaatgaatgctctttcataaccaattgctggtactcctcgtctatcacctgtagttagtgggttagtgatagttggcctgaaatatgacccattcaaaatcagactcttgataatggcctaagttcatttcattcacacgctgtacattttggttctgggctatttattggactgtctttatgtacttacagtgggggagtcatcatcctataattctgctggcagcacttattatgatttgtcaagtcataataagtcccaactgtggtttggtgagctttttatcacatatgtattcagataatgcataaaaataaatataaaaataacatgttcgaatggtttattcataggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtataggggaaaatgcccccgtgattcaattatctcccacacggtcctgcccacaacacatggggattatgagaactacaattcaagatgaaatttgggtggagactcagccaaaccatatctccttccttctctgcttaactccttctagtccctcagtactgtttctcagaattgattcccaaaataaatggccaacatgcgagcttttctcacaggcattgtttttcttggcagaacacagactaagacgatgtaatctttgaaatctctctagtgatggttaaagagtgtggggattgttataattacattaactactttataaaagtttgtggtggtaactagaaaaagcattagtcaggagaatcttccttgttgctggcattgggaaggtcatttaccagtcaggtaactagcacagctacaaagatagggagttaggagaaagacatgttggtaagtctataggattctgttgcttggttataggactttggatcctggtatctactataagggattgagagtagcaagatcccctaaatcgaaaggtaaatgaatatctacagattcgtggcaggacttgggcaggacaacagttatttgaactgagatataaaattgagactcaagagtgaaaaaaaggcctattctaattcataatggaattgaaatgtaggagtaaagctactatagtatttgcacaatcttctcccctctcaccccacgctcccctgttatccagtttttgtgcaaaatcacacagcattagactggaacttgtgataaattgcatcaacctaatttgagaaactgaaaatagggagcagtctgaacttagagggtagggagaataaggaccctggaaactaattgatgtcttacaagcacagactggttgcatatcataattacttgttttattgtgtagttcagggtaattctgtgacttgttgagtctcagtggttagatattgcagtgacttcaggcatagtcagttgatgtactttctgcttcagtaaagtacagatgtagaagacctgattaaatcctgtctctttactaataccccaagggaacacttaatgaatgatgcttccctcaagaagaagaataattaacaatagctatattattcatattaatttatagttactggttgctataattaatgctatttaggaaaatcatcataattatagcactttacaacttacagagtattttcccatccattttcttatctaaatcttataacatcaccctggcttagatagaacatgtgatattctcttcattttatagatgagaaaactatggcccagggaaagatttaagcagacaacactctaccacccttgccaatatattggactatctaagagtatgtggaaatacacttaccaaatttatgtctactataatattttatatctgcgcacaagaggatcaactttactcagtttttagttgcattccaaaacaataatgtcctgtctttccttgtaccaggacccccattacccagaatgttcacatgaattttaaatgttaaatggaatttttcttaataataccacagtgtttcatagttattactgccctttgatataaacatgaaatctcctctgatagagggattagcaccttgaaaacatctgtttccagtatacagacctgctggccttaaacagtttaatcagactggaaattcagactcagaaaagtctaaatttcaaccaacctgtcatgtcactctttttctatttttggctatgacaagagagttgaagaaaatctatcaatttcacaaggctagccttcaaatctgggccgtccagcttgatgatacacacatagttaccagtgtgagcgtgtgtgtgcacacacagatggacactgaacctctttggttccgtttttatatcaaattctagagtatccactgcttattgttgtacttctaactgtgtttacccaaaagatagtgctatgagaaaggttactgcctgtgtcacagtctgtcattattcactgatttatttattcaaaaatacttactgaacacttatttgggctaggtcttgaaagagagtccaaggaaacaggaacaaaacagacaaagcttctcatgaagcttatatgttctaggggagagactgaaaataaacagaaaaatacacatggtggcagatattatttaaaaatggatttaaaagggtaggggaataacatgacgtgatgtagaggggtcataataatacatccagaaggagaaaatcataaggtggctgttttagataatgtgataatatgaaatatatatatatatatatatatatatatatatgtgtatgtgtgtgtgtatgtgtgtgtacgtgtgtgtatgtgtgtatatatatatgtttgagacatatatgtgtgtgtgtgtgtgtatatacatatatgtatgtatgtttgagacagagtctcgctctgtcatgtaggctggagtgcagtggtacgatcttggctcactgcaacctccgcctctagggctcaagctattctcctgcctcagcctcccaagtatctgggattacaggggcctgccaccacacccagctaatttttgtatttttagtggagacgggtttcaccatgttggccaggctggtcttgaactcctggcctcagataatccacccgccttggcctcgaaacctgctgagattacaggcatgagccaccgcgcccgtcctgaaatccatgtttaaagagggctcacaaacaaggaagccaactgcctcttgaagtaggtttggctccaaggacctgggccacaacttcatagacagttgatgttactgtgcttgagagaaatcaggcccaggaaggattaactcaagctgactaagttcccaaaagaatgaccaaaacaccagatccctttatgtttcttttacacagatagttaaataagctccaagactcaggtaaggtggtttggtgagtaagctactagggcatacggaactagtggtcttcacaggccattaccctttacgcttgcttcaacatattcactaaaacgacagattgacttcaagggttataagatttagtgctagcctgtcatggcacgctacttgttgttgttactgaagatattctagtttcttggttggttaatgctttttctaaactcttttgcagacactagatactctcttgatattttacgtccttagacaagtccagtagaattgattagattattgtaactttccactattgtattgccattgagtcttgctgaagatacactttggtctcttaatgaagttttaagagcttcttccatattcatatatgatcattattaaattgtcactttaaaaggttatttttttacttcaccctgcctccaaatactagggtcatctcactttataatccagacagattctttgcttctttttcccaaacctgatcataattcctggaaacaccctgtgtcgatgttgttgtcctctactctcctgttgattctgactgcaggtaatacgaggttctgacataggaaatccggagatcctgacttcattgtccatgctcactgccacatgcttcccctgcagccccttggcagaaccctaagaggtctctttccagttcatgttctaggtgcatctcttgggtcttgccatctctcgcacacatgcatacctaataccccctggacctgagacttccaagcactggcatgctccaatgtcttcaagtgctgattcctctttctggaatgtccgtgttccttccctgctccttgctactccaataaatattattctaggcagtggtgtctaaacaccaagtgcttgtgagctctcttcagctggttctgttctttaggtgcaggaatggagacatttattttcctttacttgtatacttattttaaacaacaacaacgacaaaactgctaaataagtgtgtgacctgagaaaaatcatcttttatttttcagttttcatatctgtcataaagtgataattctatctcagcctacctcactgagattttatgaaagcttaattaaaaaaaaaagaggtgcagaaaaacttggacaaagccacattataacttgagaaatttgaacttataatgatatcaagggaaatttcctttgttaacatgtctgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccgtccgtccttccttccttccttccttccttccttccttccttccttccttccttcctctctctctcttctttctttctctttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctgagccaccatgcccggcccttttattctttcttgatcttcttagagtcaatgatttaagttgcctttttatttaatatcaacatgtattagtcaactggcagaaatttcttaaattgactctttgagtactttctttaaaaataacacaacatcatacaaaaatgttatataaaaaagtaaatctcttattccattgccttgctcttcttacagctttgtctatatggatattttgttacatgttgttatagttttcacaaatatgacttagcttggctatgtaaggttaaggtgaagggctgtgtcttttgcaaggaaattagttttgttggatattaaggtgattttcattatttttgtcatggttttaaataatgctacaggggacatatttgtgtatattttctttggggttatttcctggcctcagatttctaggagtggggttgctacattgatgaatgagaccactttatttacttttctttcctaaggttgtgaatagttgatactggtaccaccagttagtttgaatatatcagtttctcctcaagttcactagaatgtgatggttgcaattaatctgtgttttgtaagtgcaaatggtgccttgttagtttttctttgctttttaatttttttatttttgcctactttggagcttggctatttttcagcatcttcacttaatatctgcattccagaagctgatcttccactgctagtgatcattccctgcctctctaaagtcttgaaagggttgtggcaaatctgtttcagggcttccaattcctcagaagacagccatcagaattgtagttgcaaacgctagagaagcagtattgtcactgtgctgtttgactcttgcgtgacatttgtttgactaagtgagagtgcatagagcctctgagcctcactccagttcttgagtggcagcttctgtatttacagtggttcctttcttaaattaagaaccagtcttgtttctctgctgtcagttatttcaatacttaactgctcataaggtggcagcactttcttcttcttcttttttttttcttttatgagatggagtctctctctgttgccaaggctggaatgcagtggcgcaatctcagctcactgaaacctccacctcctgagttcaagcaattctgcctcagcctcccgagtagctgggattccaggtgcctgccaccacgcccagctaatttttgtattttagtagagatggagtttcaccatgttggccaggcttctctggaactcctgacctcaagcgatctgcccgccttggcctcccaaagtactgggattacaggtgtgagccactgtgcgtagctgctgtcttctttagatacattccctgtaccttttcttaacatataatggaattgttagccatgtgggattcatggcaaaatatactaccacttagctcttcctcactgaccctgctcttggctctatccatcctgtgagcagtaaaaatatactttgtccctgtaaatgtgtactgaactcatctgtagaaggcactgtggtcttttgggggaaccgatgaggcaaaaaaggtggatagttgagaggaagagaaataggactccgttgtaatcttctaatagcctgtaatgttatatgtgaggatatggcctatactgcaggagcacaaagaagatagtgatatattcttctgaaggtgacacagtctgataattcttatcaaaagacttgcattttcatctggaggggtgagtggaattgtatcgttcgagacagcagcagggagtagcctgagccacagggctgcaagcaagcaccaaggctgcatttagagatctgtaagcaaccagatggctgcagatgaagcctttgaaggcttggagtagaatataggtctgggaccagcctggccaacatggtgaaaccccatctctactaaaaatacaaaaaatagctgtgcgtggtggcgcccgcctgtaatcccagctattcgggaggctgaggcaggagaatcgtttgaacccgggaggcggaggtttcagtgagccaggatcacgccactgcgctccagcctggggacagagggagactccatctgaaaaaaaaaaaaaaaaaaaaaagagagaatataagtctggtagtttcctacagacagcgtgtagacacgtttaaatgccagattatgattttaatctgtcttttgtagataatgggattatttgaaggttctcaatcagggaaatctaaaattcattctgaaaaaggaacataggaaataagaccaactctagaatgatgcaggaaatgagcccaggtcagaaaaatgttctccagcaagccactcttcatactttctgaccattgcttgatgttcagcaattttttttgattccacccaagcaaatgccccaaatctcatctcatatctgaagacaggaaggccactgactttgccactggactcagcagtatcatgcccaaatgcttttttgtgctccctttccttttttttttttgtaatgggttttcactctgtcacccaggctggagtgcagtggtgggatctcggctcactgcaacctccgcctcctgggttcaagccattctcctgcctcagcctcccaaatttagggaggatagcaacagtgtttctggctgcagtaaatttggggtaatgactttagcttacatctactttataaaaaatcctccatgacactgcatggatttatgcaattgaactaccttaatatttgaaactaaaatttctaaacattttaaaagtgtttgtcagggagtagttttagaataacagatgagaaaagttcagacatattcctgtagtgaattgcagataaaatgtgagcatagagtatcagagctttagtgggccttccaggtcatttagccaaacttacaggtgtgtgccaccatgcccagctaattttttgtatttttagtagagatggggtttcactatgttggcaaggatggtctcaatctcctgacctcgtgactgacccacttcggccttccaaagtgctggggttacaggcatgagccaccgtgccctgcccctccccgccccccagctttttttttaaacggagctttcatttaaatcttttttttcctcccctaaatccttataacctaatagacactgaggagatcatgctttgaggtctattgtttaatacaacctttattcttgaaggttgtgtctatacatgcctctcataaaccattgcattttaataggtttattctgcagctacgttttgtttgaggaatctttctgagcacacaaattcatcatcactgatatttggacagtactgattgtgaagcactttcacatatattctcacttgagtgagatatagatatctcagttctgagatgtgcgtgatgtgctcctttcagggatgatgaaactaagactcaccaagaagattaatggtttctccttggccatatgtttgagcactgcgtgagcacaactggactttgaattttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccataaaaagaaaaacattcagaaggtcaaaaaaaattaattgtaatagccattaagtagaataagttcataattatggtaaaatacactttcgatgtgcctgttccattcagaaattaaaggatgatccattctaatttttttctattactatgatttaacaaagcaagagttaattgggagatatatctcatccttttgaattatcttccctctggtggaactgaattagatgtgttaatatttattggttaacataattataggctgtgagaacaataatcacacacttaaaatattaaaagtatgtgccaagagaagatgatgtctatagtagacggtgttgtgttataattgaaaggtacttgaaaagtcctagaaatgtagaccgttaatgcccaacattgatgtttctatttttgttcaaagcaaatttcaaaacctatagaatcacctgactacttaaaataggctagtaggtctgtgatttctcattagtcaaacatgtgttgtaagcttttttgaatccatgtctctatcatctttggaaggctgctttgactcatggtctaggaaaaatgatatatatgtggaatgtttatatggtaagaggttccaaggagctccattctcaaaacaagtctgaaaaatgtgagctcttgaaaataggttttgctaaagcattttcttccttttattctagggagtattttccgctcccaaattttctgactttagttatgttcacttactaatccctatattgattttggaaatttggcttaattccacatattcattgattcattgattcattcacctaacatttgatgagatcctcctctggatcagtcattggagatttaaaggttagtatcaacaggtctttcctttagagtgatatttaatcttacagaagagataagcccgtaagtaacccaaagggacacaggagaagggcttcaatgtgctacttaaattgtcacgtaaatcaccacgtgtcaaaattattgggagataaaatacaggaataccaacattgtaccttatacctttcagtgtcagagaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattctacagatggaaagcttttgcccagagagggaaagaacacactcaaggaggctcatttagagacagtttcagtgattctttgtattttccccgaactatgacacaaaggcccagcttgatgataaccacgaccaggggagagtttggtttcctttagtatcacaattggtttattccaaaaagtctttcttttatggcgtcttctttaaaataagtctcaaacacataacaaagaattaggcatatcaaagacgtacttcaatggtaaacagaaaacttatgacgttgtaacatctttaagctagtatatatctaaacccaacccattaggtaggcatgatttgttagtataagtacagcttagcctctagaagctatgcaggggttggaacgaaattctgtctatttcttagaagacaagagatcaatcatgaactaatgacttttgtgttccttcttttatcagagttagggtacagtattcatcttctagtttctagtacagggctgtctttttttccccaagtaagtttggtaggattggagctgatgactgagtgacttggaacacttttcaaataaactgtcttacgttaatatttcatggtagctggagatttagtaatttgtgaatcaagttgcttttgaattgattaaatgggctttcactatcctcatttagactagtgtgatactgtgaaataataagaaataatatataaatatatttttctactccagtttctgaatcagtgtttgtaaatccttataatttcctaggtgataggggtgctggtagcatcttttgttctaacattattttgttattgaccttggttcctgactcagagctactgaattctgtggaatttcctgagtgatggaaatatctattgttttgatgaggcaactcttggtgggctcctggattttggctggttaccagaatgaccaagcaatgatttgaagcttggaagtttaatcttcacctctcatcctctggggatgagaaaggggctagagattgaatgaataacaaatcatgcctatgttttgaatgttttgaagtctgtataaaaatccctgaagtgcagagaggtttcaggttgttaagcacatctttatgccaggagggtggcataccccaactctatggtaacagaagctcctatacccaggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccctactctgccccaccaccgcagcttgtgattgacatatgaagtggaaacagtcttgtgggacttgaacccttaacctgtgggatctgtaatagtaactccaggtagattgtgtcagaactgaattgagtcataaaacacccatctgataccatagaatcagttgatgtatgaaaaaaaccctcacatttagtgccagaagtaaagtgttctgtccaggcatggtatctcacacctggaatcccagcactttgggaggctgaggcaggttgattgcttgaggtcaggagtttgagaccagcctggtaaacatggcgaaaccccagctctactaaaaacaaacaaacaaacaaacaaacaaaacttagctgggggtggtggcatgcacctgtagtcccagcaactcgagaggctgaggcaggagaattgcttgaacctaggagacagaggttgcagtgagccgagattgtgccactgcactccagcctgggcaacagagcaaaactctgtctcaatcaatcaatcaatcaatcaatcaatagaagtgaagtgttctgtgagtagcatagaggaaagaggtgagtttttcttcttcaactaatatgaaaaatttggagatattttgaaaataagaatagggtggggcatagtttgatagcctcgtctccaagtttgccaacgggaagagcattggcttcttgattccctgaggtcccctctctgaaaggagctccatttgtgtgaacctgtccatgttaccagtttgtgcttccttttggttatttcaaaaatgggcagggtaactacactccattcccccttttcaaaagatagaatagtattctcaagctacaagaaataagatgatggctcaaagcaacagctcacacagtcattcccatttcattttgggattgttagcttgtgtctggagtttgttttaaaacttcaggcctttgaaggttgggggctggtcctttctgaatgctgttcatcctataaacgatatatttaattcctcactttaaaaactattctaacttcttagtctatttggaaactgagtactgaaatgctgtgtggtcatatggacacatcgttagctgcagtcccagcactcccacactgggttcctttcatagagcaataatgtatgaggcaacctgagaaattatttcaggtatatgtgtgttgtatttagagctttttataagaattcatgtggtctgagggcttgggtgcagtgtaatcagggtggagtcttgtggtgccctggatcttcccttctcatgtgttctgtgttctagcttgcaaacgccatgaggagctgcaggggagattaattagtaattaaaatgtttaatgcttcatattattcaatgcaagtcaaacatgtaggctactgggagatgaaaactacaacatgctgatactgtgtgatgagacatagactgtccctacagactagaaactttgctgtttctggcaaggctgcttgggacttgagataggaactgggtaataaatactctgttgaaaaagaaaataggtgtggatagtggcatcttcctcctcctatattctcttaggaaaaatttaggagcttttcatgatttgctgagaaatagatttgtctatgtattggcattgtctgcttaataataactttctttgagagctatggtaaaagttgaaaccttgtagaaacctctggtatgtgatgttaagtggaatacagtaaaataaaatttgcaaaacaccattttaaaagagaaagggatcttattcttcacaatgcccatgttttacttagaggatctgtgttgttttgaattagcctgtacccgccagaaaacttcaacagttaaataacaatgatttgggggtggaggagtggttagctgactcagagttgcatgccatgacttttatgacaggcaattaatttttagatggtatataattgcatttcaataacatttatacctcatcatttttttagaagatgatgtgtttgtgtcatgcgtaataagcataatcaacgttagctttaaataaattttgttttgagtgccatgaaaatgtaacattttcagagtggaaatttagcctaaaaatctaccttgcattgcacctctacaaagcttttgcccaaaaatattcatttcatttgtcccagtgtaagagctggctctgaatgtatcttagctcctagtggggataggggagggcagctgagcagatagctgctgagtgccatggggtgttcattcagctaaagcatgggagggggttgtcttctgtggttctctagccatggtccttgtggtagcctttaactgtgatttgtttgtttgaccttgatgagtccttggctccaagatgattatgttacattacactgaatcactcaatccaacattggtttgaaaagaaacgaacaaagctgcctgttgagtttctctattttacaacagtatctcagtggaaataattagtcctatgtctatgcagaagcacacatcacatttgcaaaattaaagagtgttcttgttaggactggtttctctgtttctttcttcctctcccactgtttaaatatctattttggtggtagtgttagtatgaaaccccatagttcctttcttttcttttctgatttaaaaagcaaataaacaagaaaacacaagtctagctatgttttttaactcaagatgactagatataaccacagcaaatatgtaggattgttgtgttttaagagaaaaagccgtgtctcagataatttgtagtcattgttttgtccattttgacatctacttctttatatactttatagccaaactagagtatagtgataataaggatgatctctagacagaaggttggaggtggttaataactcatcctacatatcacaatttttcatggtgagtaactggtttgccctccacacaaaatatcacattggaatgtaactgctaaggttcttcacactatggaaaaattaccagtaaagttaaacactgcctttcagtgggtatattaattataaagacaaaactatagtttatgttgcataatttgaacatacatatttccttatgaatctgtaagctggaactattgaaatgaaatatacaaagtgagcacgtgttgctgttgagccagcagttacagttttcatttacaaatgcggacagaaccatttgcgcattttggtctctctgctttgggtcctgcactcacactccaatatgcacctaagttatggggtcatgttgaggttccagactgcagaaggggatcgaattatgtttcattgtattgagtcacaaatatttcaatgtaaagtaaaaattttggaagttttacgtaacagaatataccttacaggaacagtagataggtataaaatgacttcggtttgcataacaaagaaataattgtgatgagtaccagactgtgaagtccctgaggcaaggttatcatttgttttctggcacatgagaggcatacaaatttatttttgctgaataaataaatattgtcttcaaatctttacatttccattctagaaatatgctaaaaaagctaatctgtaatagatatagagttagcacatgacaaagttatagctgctttgtgatttttttaaaataaagaacatgtatttgcattaagaaaaataagtgtggccgaagtgaatatttttttataagagcaacctaatggtaaccaatgtttcatccaaaattttcagctatactcttatattgccttatatcacttgatgacaatgtattttgttaagaagatgatgttatcatgaggtataattcaatattatatcaattctgttactgttgagataacataagaaagaaatatcaactctttttctatattctccacagaactgaagaaaacagaggactattatgttactatttcctaaataaagaccaatatgataaattccttatattcagtgagaggaaagaagttgcttaccgaatgtactgatatatgcttccttttttcagaaaacaacaacatcaaccaaaacacctgtataattattacatgaatttttttttttttttttttttttgatatggagtttcagtcttgttgcccaggctggagtgcaatggcatgatctcatctcaccgcaaccactgcctcccgggttcaagcaattctcccacctcagcctcctgagtaactgggattacagggatgtgccaccacgcctggctaatttttgtgtttttagtagagacaggttttctccatgttggtcagggtggcctcgaactcccgacctcaggtgatctgcccgcctcggcctcccaaagtgctgggattacaggcgtgagccactgcacccggccatattacaagatttttttttttgcgtttactgccaggaagctctgcttcattaaaagaagcctctaagattcacctcttccttcctttaccaatttatttctgatacttcttgacccagtatttcaaatgtgataaatatatgccaattataaagcatgtcaaaaccaattaattgtctaaatctaagtcatgctttttaagtggaaataaactttgtgtccatacacatatatttgcctataaacatcttaaaaatatatctaaacttcggacaattttaaaaagagagtattgaattttaaatggattctttgcttatattgatggtaaacagtggatccattaaagtagcatattctgctggtgtaaataaaatataagatttaagtgggttaaaaagatataatatttacttgttccttttaagaaacaagttgaagaaacaataaagcttgaagcctgtatagtcagatatatgaacccataaagtaaatcatttgtgaagtgtcttgaactctttctaatttcatcttgatgttgtactgcttatatgaaaatgctgaaaaatgttacttcttagatactgctagaggtgctaagcttcttaccattcaggaatcttcttcttggctctctccgtcacccagccaacacagagttatgttttatttcccaaatggccaacttatgttaacttgatgcttaccaaggcagtccaagccaggaaacaatttttataaacagcatcctggatgacttaatattctatgtaatattaattttagagctttttctcccatcatctagtctagcatagctaaaattatgatgtttaactttgttgatctacagtcacttgtgaatgagatctcccaaccaggaaggaaggaaagataggaaaatcagagtggtctgtttgcagctgtgctagcacatgtttccttgagtgccttctgaaggaagagtggatagagatgtatctttcagggccattgcctttctagcattattgatcgtatcacatgggcaaaagaaaaagaaacaatagattttatgacaaaagttatgtaaaaaggggctgaaatcagtattttgaaagttgtgactaattaacagtggctttctgagaagtgagatgggattcaagacagtggccattgtgtatgtatttctaagagccatctggatgctcctttttatttgtgtttttggcttattcactcatttattcctttattcactgattactaattgaatacaaagtctctgtcgatttgttcaaagatattaaagaagccctaaatctatggaaagacatcttctgttgattagttgcaagatgtaatattgttaagtgggatactccccaatttgatatatagatgcaaagcaatccctatcagaatctaagctggcttctttgtaagaattgacaaacatccttaaattcacggatgttcaagagacccagaattgccaaaatcatcttgaaaaagatgaggaagtttccgacacacacttcctagtttcaaaactttctttcaaatgacagcaatcaagcagtgtgatattggcctaagatatacataaagatcaatggagtagaattgagagtccagaaataaaccattatgtttatggacaattgattttcaacagggtgttgtgacgttcaaacagggaaaaaatagttttctcaacaaatgatgctggaaccaccagatatctacaaagagtaaagctggactccctacctcatagtgtaagacacaaatgtaaaggataaaactatacaacttgtagaagaaaatatagaagtgaggttcatgaaattgggttagtcagtggtttcttaaacatgacatcaaagcacaaacaactgaagaaaaaatagatgagttggacttcctcagaattaaccaaatttgtgcttcaaatgacaccatcaagaaagtgaacaaacaatccgtggaatttgcaaatcatgtatctgttaaggggcttatatctggaatatattaagattcttacaactcattaagaaaaagacagcccaattaagtaagaaacaaagtatctgaatagacatttccctaaggatatacaagtggataatatgcctaggaaaagatgctggacatatttattgatcaaggaaatgcaagtcaaaccacaacgagatatcacttcacgctcactaaggtggctataataaaaaaagacaacatgtgttggcaatgtggtagagaaattgaaaacatcatacgttgctggtggattgtaaaatggcatagcccttttggaagcaatctgtcaattcttcaaaattggtcatagttaccacatgaccaagcaattatatttctatttatgtatccaagggaattaaaatatatgaccacacaaagacctgtatagagatgttcatagcaacatgattcataacagcctaaaagtgggaacaacctaaatatctatcagttggtgaatggataaacaaaatgtggtgtatccatacaattgaatattactcagccataaaaaggaacgaagctctgcaacatgctacgatatggatgaacctgggaaacattatgctatacgaaagaaaccagacaaaagcgaccacagtttatgattccatttatatgaatgggcaaatccagagacccagaaagatgagtggttgccagtggccagggggaggggacaatacagagtggctactaatgggtacaggatttcttttggaaaggtgattaaagtattctggaatttgctgcacaattctttgaatatactaagaatcactaaattgtgcatttttaaagggcatattttatggtatgtgaatcatgtcttaactaaaaaatttgttttaaaaggctctgtattgaataatttgcctagaatacacacatggcattgggagtggcctccactctgaataagcttacaatctcttggggaaaaatgcaatctaacagttatagtacttaagcgtacatggtaagaaagaagcacatggagggtgcttattgaatgggaaaaggaagaaatctacctggatgatcacagaaggtgtttggtggatagggagtatttgcaagaagaatccgactctcgtgtagcttgagaaagcagaatgaaaacccgtatctaggaactgaggaaggcagtcagcaatgtaaggtcaatatttttctaaaagtaatggcagctgaagtacaacttaggctgcctgagaagagagcaagttttccttcattggagcatttgaaatgacactctggtatttacaaggtgaattattcacactctttaaatctcagtgttctgagttgataacacatttcagagttgacatgaggaccacaaggaataataagtgtgtgtttaatgtgaaaatacaatatcttgtacataataaacagttattactgttggtctcaccaccaacatcattatcaaatgaatcttggcagtaattctgggaaaggaatttaggcaacagatgggagctcatttgaatgatgctaggatttcatggtactcccattgttggttacagaactccaagaactctcattcttggagttttctgtttcctcatataaaacttggaaggaagaacagaagaccttcattctgttccaggcccttaaattgattatttctgtgcctaaagcaaactgctcagcctcaatcatgactttgcacaatttgctgtgatacctggtatagatgtttcatttgttaaagttgttactgacaagaacctccaatgaccttggaacatgacctggcccctgtgggtatcagtagaattttggtgaacactgagaagtctctgagtttctttcaatctgggcttctttcagttggtttgcaaactggacttgtggaattagatgatctctcatgcccattctatctttgagttggtattatttttgccccgtattaaagaaaaactatattgatatttctttctttgcttttgttatttcactatagaaaattttgttttaacattcggttggagttgatgatatacaacccaattatatggatttgttatatgcaaacataaggaagtattcacaaatttaaagaccaagttcatgttgttcaagataatgtgaacccaaattcattgtgctcaggataatttggaactaatttcatagagtttaagatatattatagtaattaaaatcatggattttgggagcacactcccctgactctaaatatgtggcctgggatgtcacttaaacattttgtgcctcagttcttttatctctataatgaagaccattatagtatctatctcccaggattgtaatgaggactaaatgagtttccatgtataaagcacttgaaacagtgtttgacatatttagcaccatatgcattagaagatcttattgttagctgcgtgcttattcttaaattgtctgagttactgcttttatataagaagattgacttataaatttggcccatgatgtcccatccaactctctgaaatagattatctacctcttttcagctgggcatcttacttatgatatctgaggacatctctctgttcttgtgctttgcccagccccctttggtttctaatgcatggagccaaaagctacagctagagccataatggtcttgtcctaccatctgaaagacatgttgattgctagaatgtttctgtggttaacaagataattcctctgataagtgaacaaccttcacttaaatgcaaaaattatgactcatagattattaatttgtcacaatttactaaccctatcattggcctattgatgtaagttattcttgtcacgcttcacctacccagacgctaaagcatgtaaagcaatagttaagtttattgttcatctgattgacctggagggcttgttaaatgccattactgggctctaccttatgttttcaattcagtagggctggagtgaggctcaataatttgtatttcaagtgttgctctggtgtggaccacactttgtgaaccctttaaagcttcttgtcagtcacatgtttgtaagcagcactgtcttcctctgttctcttatttctatagctgcacacccttaaggcttgccctagtgtcaaaagtggatgctagttttatgtcttttttctagaggaggaaaaaccataacctagagaagtatctttccctgcatacatagtacattgacagaatctggaagatgccctttaaaaaaaaaaaaagtaaagatttgtacctgccattctgtctttcagaattgtaaatttatgtttattgatattaaatatgcctgtaatcccagcactttgggaagctgggaagggcggatcacctgaggtcaggagtccaagaccagactggccaacatgttgaaattctctttctaataaaaatacaaaaattagctgtgcatggtggcgggcacctgtaatcccagctacttaggaggctgaggcaggagaattgcttgaactcaggaggtggatgttgcagtgggccgagattgcacccctgcactctagcctaggtgacaagagcgaaactccatcacacacacaaaaaaacaaaaacaaaacaaataaaaattgtatagatttatggtgtagaacatgatgtttgatatatgtatacattgtgaaatggctaaatcaaactaataaaaatttgcattacctcccatatttattttttgtggtgagaaaacttaaaatctcccaacaaatttataatacacttgcatctgcaattcttgaaagaactattaggtttggaaaactagaattccgaattcagttctgccatacctagaaacgtgaatgtcaactgtttgatctctctgaacctcattttctttgtccatgatattaatacctcctctgcttatcatatatgatattgtgagaagtaaatgacacattgtacattaaagtgctttgtgaactataaagcgctatacaaagattattttgcattctcatcccagttgtcacacacaatatcttgttaaacatcatctgttttatgataggcacatccttctctctctcagctagggtaaatattgacttttctaactgttttcaggaaggaaatagtgcactgtgaactacttgccttgtgcacagaatccttttatttccctcctgtgattattttttcttttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgagttgagccaagagcaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagtgttaaaaggaagtttcagaagatgaccttcaccttgatgaagaagtccgaacagagtatccccatttatctatctctattctgctaagatacttttcttttcatgcctcaggtctgactgctctttgcaattcagcctgttgcagtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattgggggattgaggggtggagaggcttttatatttttagtgagtctttccctttagtgattttcagagcatctccctattagtgcacagtaagaagtatttgttctttttgccatgcaacaaattgcttaaaaaccaagcagctgaaaacgcgtattttctctttgttcttggtgagacaggaatctgtatatagcttagctggaccaccaacttcttggtctttcacaaggctgcaatcaaggttttgactcagtctgcacttgtatctgaaggttcaacgggagaacgatcagcttccttgcttaggtggtttttaatttttttatatggttcgatttcttccaggcagttgcataaagtgctttagtttatatctggttgttggctggagtctatcctcagttatttgtcatgggagcctctccatgtggcatctcactacatcaaagcatggaagctgagcaagcaataggtagagtttgattacaagatggaagccataatcatttgaaacctaaatgtggaggggacagcccatcacacttaccatagtctgtttgtttgaagtaagtgactaggattagcccacactaagaaagatggcattgtaaaagaatgtgaagcccaggaattaagaatactagggggaatcttataaacctgccgatcacaaaagagagtgaggttagacttactgtccacagggatttagtgcaaatgtaagtttatttgtagaatctgtcaagtcagaaagcagaggaggcatgtggggtatcatgagaagaatagaatctggaaggagtaacaggtaatgaaaggtactaacagatgtaggaagaactccagaatttaagaaagttatacctgaatgtggtttaggaggtcttttgatctaaccacctccatttctcaaggagtccaaagcatatagagggccttactcaggccagaagttgtggctgaacaatgagttggaacaaagtccacaaactcctgacttagtacagattttcagcttgatgtaatgaatatagctctggatttggagtgaaaagatacacatgttcaacttttgatttgcctctgagtggctgtgtcaccctgagcaagtgataagtaaaggaagcttgatatatggttacccagtttataacatgaagctatcattatcatgtatattcatttatgtctgatgaacatattaacttttctttatgaaaattctttgtaagctgacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctatatagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgtaccagcatggcacatgtatacatatgtaactaacctgcacaatgtgcacatgtaccctaaaacttaaagtataattaaaaaaaaaaacattaaaaaaaaaaaagaaaattctttgtaagctataaaagcctttagaaaaaaaagtaagctttgtttaaattattaatgtgtaggttgaggcaaaacaagcactcccttttgacagaagggataagtactggttcatataaatacaattttatctccatctgtatctgtatcagccatttatttctgcttgataaattatcccaaagcttagtaatgtctaccttactcacatatctgcaattttgatagtactccatgaaaatagcttaactctgttctgtgaaatgagcccatgtgcctcgatttgggtgcagaggattcactttcaagatgctttactcatggctggcagtttggtgttagaagtgcgactagagttgtgtgtcaggaccttagtttctcttaatgtgagttcctctacaggctcctagggctttcttacagcatggtggatgagttccaaggccaagtatcacaagagagaaaggtagaaatgccagcattgttatgacttagttttagaacttacacagagtgtcctttctactatacactgttgattgaggtccacctgggctcaaagacagggggttagtctccacctttgttgttggggttgtagtaaggctccagacaagtttgtgggcaagagacactgtcgtgaccatctgtgtacagtacagcctgccattatattgtattttattgcattgtatcacattttactacatcatattttaatgttttatgttgtatttgtttccatttgtggaggacttaatatctgccagacatgtatattctgtattaaagttgacttaattctcacaacaaccctgtgatgacgtggtccttctcattttcaccaacgagaaaaccaagttataaagatggtaagtaacttgcctaaggtcaaaccagctcataagtggcagagttcaggttcaaaaccaggcaatctagttctggatcccatacttttcaccactctgccagattatttctatgttgttatctgtttttatgtcttaaataatatttatgccatgctgttactaatcaccatttccatccctgtctctgtatctcagttagagaaagtgggtagataaggactggatatcagactggatagggaggaaacacatgcaggagtatcattacctttgagagaggtgggtctgagcttgtccctaagtgctcctggaccagttctaggagatctcaagaaaagaagcaacgtaacatttcactagttccatacagagtttatattggccttaatgattttgcctttaatttaataagacatatgggagtctacggaatctagggaaggcagctgagtaagtaacgatatttttaaaaaaattggaaataggggccaatatttgaagactaatgaaattcaggggcatctattctcgttccacaaaagtttagctatctggtattccatctggtgatctattcaatcaattaactcttccatattgggatgtttgtcagagtccagcttacaaattgaggaaatccacagtcacttgtgagctagtttgtatcagttattaaaatttacttatttattgtaaacttcatcaaaccaacaattgttaagcccctactgaatgcaggacactgcagattacaatcaaggggaacacagtttataccctttctcacaccacaagggacttctactgtaagaaaaagatgtgtaaagccataacgacaagaatatgtgataaatatgataatgaatctatgaacaaggctgtatggatgcctagcggaaggtgctccaatattctcctggagaggtcagagggggcttttcagagcatttaagcatatatattacaggaactggaaatgttcagcccagttggagcttagaaaatgtagggcaagtgataagcctggaaaggaaggcacgtagatatgtttctgcaaatgcattccctccttctgtcttcctgtctgccttatatacacaatgatgactcagtaccaggaatctcaggaaacaaacaacacacatgcacaatataaattcctctacaatccctctatttatcctcagtgcaaaacctcaattaactaatagctcatctgaaaactgtcagggctagaaagtcccataacccctcaggataaaatcacaccaaccgtaagttacttaggctctccaaggtcagcctccttttatctagcttccctctttttataaagctgcgggcctgtctctaacaggatcatgtggtaacattcatgatttgcaagagctttactgctacaaagcacatttgcaatacactgtctcttttttttacttggcatttgcgatttaattgttaacccacctgatatatagtgaaattgtggcccagaaatgtgaaatgactgctcttaatttttacaaaaataaaacaaaataatctaatccttaaagtcgtgtcttcttttgcaaaatcctagtacatttttagtacatcagttgtgttccgtagctggggactctgttcaagtgaaccttaataagaagtgtgatgtataaaatggcagagtttgaggtgttctgactgaaataaggagtctgggctctggagcgtggctgagcatcttcttgctcactccagaaacggccctgaggcttcttcatgtctagtgttgtgaaaaccactcaactgcagtgtgcttattacctatgtctaaccttggagcactcagaaaagacctaatgcttattttactgtctgaagtgggaagacagccattgttaacgtgggatctcccctagcattctccttctgatcctagcgtaaattcctgtggatcaaagcccagcccctgagactgtaacagagagaataaaagaacaagaagatggtgaaggcgatatggtgtggtagatggagcatgtgaattctcctagttctgcttctaactcactttttgatttttagcaggcaagctatttcacttctcttgtgccacggtttccattcataaactagggaactggacttcttgtctcctcaccgtctgattaaaaacattccgtggtgattccttttcttggtaagacacatagcttagtccacctcaggtcccaaaaggaggatcaaccttagtgttttacgctctctaatatgacctcttgcggtcgatgttttagaggtatctatcatattgcatggattgagggagtttgacctgttgagctgggcgagttatcaccatgcagcacttcaggtgcttactctctttttatccatgcattggttcattggattcaaacatttcattagacttcctgccttcttttggggggatattttgaatttggggataataagtttagaaatctttgggatgaagaagaggaaagagaaggcagaaaaggagggccatgactataacatttatcagcaactgtgcctcttccagaagaatcaggatggactggatttgaatataaaaagtaggaagagaggcaaggcagaaactgggagaggccgcagatggtagtgattgcagatcctttataaaatgctgcatgtttcaactttcctctgcccaacactatcaagtgagatggatccttggaggtctttgggtccagtcctcaaggaatcaaaattacatctaggtagtaggaataggttctagtgttctataccacgtgggataactatagttagcaataatgtgtgatgtagtttcaaataactagaaggcagatagttaatgttttcaacacaaaggaaatgataaatatttgagatgatgaatgtgctaattaccctgatttgatcaatatacattatatgtatggaatttcactgtgtaccacatgaataggtataattatttttaatttaaaaaaagcagtttctcatgtaagctggatgttgctggatagtttaacagaagtctgtatagccttgttgtattttaatcattttatctttttttttggcctggaaaatattaagttagaatggctgtgctggaatacatcatccccacctgtatattaaagctctgtgttatttaaaaatttgtctaagaaacctataaattgatggagcctcactgtggtggttctacttctctattttgtgtgtttgtttgtttgtttgttttttggtctggtgccattgagccactgtctataggaataaaaggatgttagcatgactgatagttcagtgacctgtaagtagcgattttaaagaaaaattttataggtctttgttagttccaaatctgactacctgttaattctgctttatagtcatgctctgactttaccatgaaggctgtagcattgtgctttatctccttgtctccagagtacaagatcttggtaagagaaaagagtgataaacccaaaaaatacaaactcagtttacctgagactgagtagcacagaggtctccactaccactcatttccctcttcacatggcaatggaacttttcattaaaaataaattgtatttactcatgtatattcttatgctaaactgataccctttttcacaatggataaaacaacaataaatgtttgcagcctcgcacatcaattctcgaaccctgttctgcaatttctggcaataaaaggccttgcttagtgtgcattaaaatcttggttctaaagtcagtgtctactttcatagaaagtatagtttgtgacctctgttactatattttcaccagcaatttgcacacttgtcatgaggctttctctttgtatgggtcttagataatgcagtatcttgacatggtacttctatggtaagacaaagaggatgctgtttttgtattaatgcgaccaaaatatttcaaagccaatcttacagaatccccctattggacatcccccataaattttttaatggaacaaaacccctctgtgagaaataacaatttgtatacgatttcaaaggcataattcaaactatagctgaataagaaaaataatacaggatctaacaaggcaacacttaatgaaaaatcaagggccaggtgcagtggctcgtgcctgtaatcccagcactttgggaggccgaggcgggtggatcacaaggtcaggagatcgagaccatcctggctaacatggtgaaaccccgtctctactaaaaatacaaaaatttagttgggtgtggtggcatgtacctgtagtcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctgtgctgcctaacccatagggttatgttttaaacgatatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaattctggtctttttaaaattaagctctattagtccattttcacaccgctgataaggacataccagagactgggaagaaaaggatattttattggacttacagttccacatggctggggaggactcagagtcatggcgggaggcgaaaggcacttcttacatggcagtggtgagagaaaatgaggacgatgcaaaagcagaaacccctgataaaaccatcagatctcataagacttattgactaccacgagaacagtatgggggaaactgcccccatgattcaaattatctcccactgggtctctccctcaacatgtgggaattatggggtaaaagtcaagatgagatttgggtggggacagagccaagccatatcacaagcttagtgagaaacctaattgcttatatactatctattattttcaaattcattttaatattttggattcttatccaactaagagatatagggaacaaatgctgtaataatcacccatctgtaaaatatggaccttctcatagggaacttacgttttagtagggaaaatataacatatacactaatagagattacagagtaggaggtcctttacagagtaaaaggagaatggagatgtacagtttggtgtgtactgtgggttgaggaagattgtgtgttgcggaagatggtgacagctactgacgagtcactttctgccatagagatcaattttccattggtcaattgtggacattcactaatgtaggttggagtgatgcttcaggagcagacatggcataaactatttcaggaaaccataaacagcttagctttatcttcagagtagggtatgaaaagggagagaccaatggtaaaaatccaaattagaatgatgtgatgccatcttggaggcccttgtaagtcaagcaaaggagtttgtgcaaaaagtttgaacattaacaacaacaaacaaacaaacaaacagaaaacagaaaaaaatattgcattgtatctgtgggaccttcccatccttaggttttaattttcccctctgtcaaatgagagattttacttgataatctccaaaattgtgaccagctctaatgttttacaattcccagaattattacatcttaacttctccctgagaattatttactgatcacatagtagaactgaagtgatttctacagtagctctatagctagcaacccagcattggataaactcaaggaatgaaaaatctagtgtgtgctggggttgggagggtagtcatatattactgatttaactgtcatctggaaaactttatgggaactaagtagaggatgccataaggaccattaactgctcctaagatatgatgagcaaagactggagaataggagtgggcctagtctacagattagttttctattattgctgtaacaagataccacgaaattggtgtcttaaaacatcacaaatttcttatcttacagtgctgtaggtcagaattctagtccaggactcactgggttaagatgaaggtgtcagcagagcttcgttcctttctggaggctctagtcatagtcattacctttcccagcttctagaggctgcccatatttcttggctctcggactctgtctttctagtgacattgcatttctctgaccactctttcatagtcatgtctctctgaccacagctgggaaagattctttgcttttaagaactcatgtgattagatgaggctcacctggataattcaggctaatctccctgtctcaaaatctttaaccttaatcacatctgcaaagtctttgtaatcaacatgttcacaagttcgaggaattagagtgtgtacattcttggcggggtggggagggctgttcttatgcttatcacagtctgtttttaggaaagtagataagttcacaacgttaatgcatggaggctgagattgtgagaagaaatgaagcagccagtcataaagtgtgtttcgtgctaatgtaaagagttctgaagttattctgatggccatagagagctattcaattctacctagtagaggaatatttaatctataatgatgtcaaacaattgaagtgggtagcttgtggtacccaaccatccttcgcattttaaacatgggaaaatgaagactattttttgactcagtatacttgggacacatattagtgccatgtacctatcattattttcccatatcatgtgtttttctaccctttcctcctacttgtttttcctctagcctgtgagaatgccattcatgatttataatgttctgggtaaaaagttcaggtagacctacattaagcaaaggtaactcagatttggaagactgaagcttggtagcagggagggggttacttaggacagagagatgccttggaatggccgcacattgagctcgtgcatgttggagctggcattacccatgtgaggaggtggatgacctgtctatatattcaacactagcttttctttgagatccccacaaaacagatctaggaaatctaatgaaagaattatccctgctacaccgtgtttttaacataggaacggacagttaacttgtgtgtttgttcaagaatgattcataatgcagaagatgaactggtgaatagaagaagcctagtaaattggaagattctcttgatgaaacagagaaattgagatttattattcagtcacttccaattacactgttgtgttgcagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttctcacgtgtgaatttgatgcttttttttaaaaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatatgtcctgtaaacaaaccccaaaagaatatttttgaacaagttgtagttcaatttataccagattatggaacactagagatttacagtgatgcgttcttttatttagatggaataggagaacccatagagttgaagctgtttgtctgaaggtttgcagcagatcagtggctctgccaagcctgcaactatcatcacctgactccaagttactctctttctagtccagcacagctgcctcccaagtttaatagtctatgactcacaatccaaatctatggtgacatataatattttactttgattccaaatcaacaagccagttttagaagtgcttacactgctgcattactttttatactattgggttcttcaagttgagtcttatttctagaactccaataagaataaccagaggagtcatttattttgttattatgacatatttattgaagacttattgggtggcaagctgtcttatagagggtgagggtacagctatgcataaaacaatgtgtattttcttaaaagagtttatattactgtgggagaggcatagtaaacatgttaggttctatagagaaaaataaagcaagataaaagtgaaagagtgctttgggttgagtggagccatagttgctattctgcacaaagtggttaagaaaagccttaagaggaagagatatttgaggagagatctcaaggaggtgaggaagtgagctctgcagatatttgggataagcatgttatagacagagggaagcacaagcgtgaaaagtctgagaagatcatggctggcatctggcatttttaagaaagagtgaagtagccaagggtgcctgaagccaagtgatcccaaggaagtgaggaaaaataaggttagggaggtagcaggggccctcatgatcacatagaacctcataggacctcttattcttagtttaagtgagatggagagcatttggagtcacattatcaggcttatgttaaggatcactcaggcagctttctgtaggctatgtggtaatccaaaccagaagtgacaacacaaactagaaattacaatcaaactcaaaatgatagttggttggacttggtaggtatagttggtgttggggaggggataagaagtagtgggattctggatatatttccattgcagcctcaacaactattgtgagcagatcagatgtggaatataagagtaatagaagagtcaagaatggctcctaggtttttaccctgagcaaggagaagaatggaattgctatttagtgagatttctggagacaggaagattaattttgcttctgtttttgttgtttagaagagaaaggagaaaggatgatcagccatttggctttgaatatgttatatttgagctatcttttagagattcgagtattggttgagtagacagctgtatatttgagtctggggtacaagggcaggctcttgacttgatataggtgtaggtgtcagcagatatacatttagagctttgagcctggatcatatcacctaaggtaatggaggaagccatgaatattttgatgtcatggagaaaatagaggaactattaaagaatgcttgggacaagaaacactgaggtaggaggaaatgcaaaggacagtggtgtccagaaatgaagtgaaaaatgtgcttcaagagtgagtgtgtgatcaaggtatccacaccattggatcaaatgccatgaggattaaaagttggaccaatggatctagatcttagttgaggattgccttgataagaacagttatcgttactcttctgagctatttgctcacacttgccttactttttgtcaaagtcgaggcccctctaaatattggttaaatacaagggctctggagttgccctgtctgaggtcaaatcctagtttcatatttactagttgtttgagcttggaaagtttaattaacccttctgtgtgcttcagttttttttgtttgtttgttttacttttgaaaggaaagaaatgatatgttttgtctcataggtttattgggaagattgcaaaaattaaacatataccatagtgtctgtcatatagtaaattaccaataattgttagctctagtgattaagaataaaatgatcactaacatctataaaattacacctgacttatatttccttcttaccctgaaaatcatacaaactctttctagagttgtgcttgagtcggttgcactattttctgcctttttgtttttttggtttgattttttttcagtttttttaatcattacatgaattaacctcattatgatctaattacttccacatagttctccagattgtgaatgctctgcgaaaccatagcttgttcatatcttagaaccttatgcaagggttggcacttttggcacttcaggcttgaaatccaggtttctgaatgccctggtgattgattgacatttcaccttcaaggtcattccaatacttaatgtagaagtgatagggtaaactcttaattactggaattacctataaataaataaatgacttaaatttcctaaaataatagttaatgtcttgttaatctgagttccttttctctgtaaattatttcacaggcatgaccctctgtaattttctcaccttttaaagtgatcctgaggtatatcatgcaggatagttgacctttgggattggtgttcttgccctacggtagatagctttgtgaagtcttccctccctttctatttctgggacctagaacttaaaatggcctcttatgttgaattcttctcattcatatttctataaactcaaataatggtgcctttaacatcttcagacgtgccttcatgcgttacaaaaaaaaagatggtttgatatttgtttcctttatcttctttgaaatgcacgaataaaggtaactatttacaaacctgaaataaagcaaaactgtgtttattagattcttgaaaagcggttttgcaaatctaaatcaagcaccgggctaggaggactacattaagcaacaacaccagcaatgagtggtatattttaggaactgtgtccatggacagaatgagatatcatgagcaaatatctgttgcaattcctgtgccaattcataaatggcaacagctgattcttgccttgctcacatagttgtagtctggatggtaaaaggtaatattttcaactccttggtttactttgtcaggagtaataagtttctaataaagaagctatatttatacttctcacctagcctctctctctctgtgtagtccatgccacaaacactgtacattggctaacatatttgtctgagtaagggtgagagacaagaagaacatgagggaaactagaggttgtacaagtaaattctattgttgctaatgccataatttattccagatattatctagtcccagaatgtgcatatgaatgttctggcgctctcttttctgtacttgtaataaacaagacatcagaagacacaagagttgagagggcccagtttcagtacctcttgttataaatcatcaagcaggtaaagagaagatccctgatgttatcagtacttttgagcagaaagcatggatgttatcagtatttttgaccagaaagagaatggatgttatcagtatttttgagcagaaagcatgcgtgtttgtacaccttcttgtttactccacataggcactccgacaaaatagtatctctacctcaaccagtaagttccttatctgtctctgagttcttttgtccttctacagaaacaagagtgtttctcttaaactaactccctcattctggataaactgatataataaaaacaccagaacgaaaacgcatgtattcataccatactttcccacctcactgtgctgtactctgtagagttcatatcctctcttcttttacacctcttcagtgagctctataattttctagctcttggttgtttctctgttcgtatcatctacctgcaatgccattcatcacttcctacctgccactctcacccttcattttttacctgaggagctgcctcctaccccgtatgagttgctgtacacgtttcttttgacacttgtcacatatataccctgttatggttgtggtcagctgtgtagattcaacttccttgacaaggctggaaaattgtgaattgtaggaagtgtgtttgagtgtgcttccgtttctgggattcccactgtgtctaaccctgtggtatctggcatgggttaggcaatcaacaaatgtttgctgaacaaatgaaaacaaatgggtaaaaaactcaaacctttaatattcattttttaagaaaaatagtaaatagcattaccatgactgacagaccacagttaatttgccatttctacctcccacttgctgttctcaaaaaaagtggaataaaaccacagatttgccaatggtcaaaagatgaatctaaagggcaatgatgttacaacttattattaacttatttcatttctgcctaccaagaaatgtgtatgactcagcttttgtccaagcagcactgcttttgttctattttgaattcgtggtggaaaggatgagtttttgataaagatcttgacttttttgtatcaaatagaggataggacggtattatagagattaggtaatgaaatgcatgggttctaatgcctgcactgcctctacccctgtctagctatatgaccttgaacatttccttgcctctgtctaggccttagtctccccagatgtaacatgagggagctgatgtagttaattgtcagtggctcttgcagccaagcatcctagactggaattctaggtgggattcagagtaattccttgtgatgacatatgactcaaccttcagctgttaactggctcaccatcgtgacaacaggcaccagattattcacacatttttgaatatttgaattgcataaggctgctcaatgatggtgaaaattgggtcctaaatgttctatcagatatatatgtagtgtaacctgttcaggatctcgtgtgagtgtaaaatgatgtgtgaaatatgcaccaagcaagaaacactttgcacattatgataaggcagtaatacaatttgatttttatgagttaaagatgatggtactataagagctctagttatatgaagcctggaactatagtatgtcttagtctttatagaaaggaaaacaattaaaaatgttgtttctcactcttgtatttccgtgttcgtagagtcaatagtttcactcaaggcaggaagacaagacctgatgttagcccctctgtccgagtcattcaacacctcaccccctccagttatatttatatttatacatattttattattcttttactatgccagtaccacaatgggaaatatgtttacttttaaaaagctacccagaatcctccaatttctcgtccgagaatataaaaacacttacctcacataaactcacttaagaaaatgtgaatgtaacactgttcccccaaaccgctttcttctttgaatgccagcttttcacatagcagctttcctgacctcctacttccaggacctcagacccctctgtctgtgggctggcacttggaatgtggctgtccacttggcaaagtggaaagagcttctgttctcactgtggcatctggggcctcaattctggttccaccactcagcagctctttgaatgctaggaggatatttcacttctccagatcctaatctcttcactggtaagagaggaataattatatttactttttgacatggctagaataattacagagaatgcatagagagcatctaacacagagactgacaggtagtaggtgcaggtttacttccccttctgtagatggtccagggtctctgacgcatctctgcttcttcactggtttatctctgtgctatgctaccaccaaggagtcgtctatgcacagataaagagggaaaatggtctgcagtcatcacttgggattctatgcaattcagtgaggtctcaaatcactactcaacaaccattcagcagcaatgcgatgtcaatgtccttatctgtttctcatgctactactgtttcatatctcctacgtaatgtagtttaggagaaagagtcatgaagtgggttccagtagtcctggcttccagttccgattctcagataaacctactctttgacccatgccaagtcatatccttccacatatttaaatgacaatcctataccttagttctctccagagatacatagattgttcaggctgatgcacttatgctttgatttactggatattcaagtaatgaagcctatctttttctatgttttcttctttttatggaattcaaagtctatgtgttcttgccattgcccctgaagtagtaacatttctgagcctggctgatctagaacctctacaaaggctgtccttccttcttgataataagtcagtgcatttacctaatatctgggagtttacaaagtatcttcatttattcattagtattgaagtctcagtagtaactcctgaagatggggattcttacccacattttagagatgaggaaacaggatgggagatgaaaggatgttctcaggagtcccacagtaggtgttagttacatagcttggatttcaagcagcatccttctcccaatcccaggtcctggcctgaatgtaaatgtgatttccaatccaagtttgaatgtctgtgcactcattagtccctagacaaatctggtttttcttgcatgagaatgaaattgaactttcaaacattttcttaagcctgtaggatctacattctcttcattttctaatatacttgtaactttaaattccttattaagcccgaaggatatttcacttcattgtagaaatttaccattgccattggcttctgcaaaacttggcagtgaactttttttaaaaaacgtggccattgagagtggtccccttgatacttgagtgtgtattgtcccaaacattgcctcaataggtagttactgtagaagaaaatgccgtagttttaatggcagccttgaattttctcctctctcctttaatggaaatccattctatacttattaatccactgagcttgtcagtacacatccctgtcatttctcaaaaatgtaaggaaacagcatgtatagaacaagcactggactaaaagtcggaggagcagattttagaccttccttttctaccaattatttggaatgtggcaaatcgctttacttctgtgaacatctagttcatgttttataaagcattgaagtagatcatttctaaggttcttttccaccctatttggtaaattgtctagcatgttctacttcccacttgattaaattactctgcttcattttttttaattttgcaaggaaatactcattacatataaggataggagacttcacttatttccacagatatttattgagcactgactatgtgaaacataattaaagtgtaatgggcatttggaggagggagacattccagaagaggaaactgttatgagtaaagataaagcagtttgaaagtgcactttctaatgagaacctggagattcatggagaatttgcagcgcatggacttgtgagcagttggcgttaaggttgagaagagggcagtgtggactgaatgtggaggcttctacagtgtgtactatttataatcacgcacacacagacacacacagacacacacagacacacacacacatacaaacacacacactcatcccttttcagggtctcctgacgacctatactgcctgttgctctttttacctcagccagcaaagagataaattgtcaagattaagtagatctgaacatttgagaaggagttccataaaaaagacaatgaaaatcaagtgtaccagcatctttaattcatacaaggatcattttcagtttaacagtttatctccgttgttggttgtgacttcctgcaggacgtgacttttgatatattcattcttgaacttccaccaagcacagtttcaccatagttgatgctcagtaatagatccttatttgttggactgaattgctgcctactgaagtcaatcctagaaaggagagaagatagcttttttacatagaataactaggaggggttttcttcttttgaatgagctaccaataacaaaataaaactgcaatgaaagaattgacagcctggatctgtaatctgcctgacctgataattgtaaaaactgattactgtgtcagcctgccagatggatcttctccttgaaatgtaacgtgcggcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaatcctacggcctcgtttgatgtttagtttcagaccttagtgaaaggaaataggataaaacaatgttgttcaaagggagaagttgaaaacaaatgatttgttattacacacttagccatatctctccagggaaatttgggaagtcaaataatataaacggtaataatagtagtacttgagatttgtggagtgcctagcagtttgtcgagtggctttatgttcattatcacatcaagtctaggaggttgcctggccagaaatcatcatcccactattacacacacggttgagtgagttacgctaaatactacttctaaaatggtagaactgagcctcactcttggtcctgttgattttgaatggaatagttcctctaattctctgtgctggctcaccaaccaaacatgtgtgcagtacattggaccacgttgtggaaccagcctgttccttaactttactgaagcatatatatgctggcaatatacaaataaattatcacaacggatttcagcagtgagaagtatatgaagttgaacataacagccctccctcagtacccattcattttctcccctgccaaccccaactctttttccaaagagtaatcaccattgtctttttgttgtgcatctttccaagcatgtatctatacatttatgtatacatttacatatatatgtgtgtgtgtgtgtgtgtgtgtgtggtatattatctatttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgtgtttttttttgttttttttttgtttttttgagattatcaaaattcagtgtgggccatcatcgcaaatgttagaatcctcatcttagctcatgttatcgacctgggtttccacttagttgcttggggatgtgttgttcagaccaagccagacacttctctaaacagacacttgtggccaagagagtaaatgttggggaagttattttccatggcactgtggtttgaatacaggcactcaccatggaagaagagtagggtattcttgtaacagtcttgtttacttaaaacagccacgactcttcgctgagatagaataaggtacttaacgcaataaaaataactaccataatttaaaaatgcaaatgtagcaatgcactaaaaaatacctttagcttattttttgttaagaaacaagtgttttgcataatcagactttaaaaaatataattgaattctctatactgattctatgataggaaggtccagagtcaggtccaccttccatgccatactccttctttccaccattcgcagctggtcctactgagggtaattagtaggggataatatctgaaaatgtaggtatgtaagagaatagagctaatctgcctagcttttatgatattacagatcgcagaggagcatcctcacggataattcccaaatcacagataatgtgttgttgtgctttataagcagagagacacaaaataaactctctcccctatccttctcttttatttatttattttccttctgttaatagatttagtcattttttaaaaccataatataccaggatgagccagaattatgtgtgtctaagttcttttaaaataaagaaatcgtttcttgggtctgttttagttaggtcctttcaggttgcaggaaccaagatgtgcttaaagttacctcagatgactttagatgatgggaatttatggtaatatacagggagaaggaaggaagtccaaaaacccatgtcagcaactagacaaccaagcctcatggagacttggaatatcattgaggacacaacagcagctgattttgtcattcctcagaaataaacatccagtgtttccttgtccggtgggtctttgttggacaaggacttagctttcttcaattttccttctgttttctgtggcagctcctgttagtgattctgtttagtcttcttctgaacactaggatgttcgttatatgatgtcctcctgcctcatggcctcctcatcctacgccgtgtgtctctggcttttgctccattccatctctgctcccagcttttctttttctgtatccttacactgaaaagcctgaaccaacaggaccattattttagctggttcttctccagtacacatggaggaggaattcttcctccaacacagctcctgggtatctagtctggtttgggttcaatgtctgatccaactagctgtggccagagtgcagaattacctgttacaaaactgtggcaatgtagttattaaaacaagcaactttttgagggttttgcttaaacagagtggttggtgtggtagagacaacattgtatgtacttctctatcacagagagaaatttataaagtcaaggcaaaccaaatatctgaggctgggacttcaccccagatgtttgcaagtaaacaagttgtggaccttagagatccgctcctctcactttctgactgcctcttgctttggtctgtagaccaatgttccactagtatttagttttcattctggttttaaaacggtttatctgtaaacctgtaatttaaacttctgataagcaaaactaacatagtaatgagcccattagaaagcaatcgtgagatactattagactttgataactttcaagaagctttattctatttttgcccattcaaagctaacatttttggcagttttaaaactgaacggggtttttgttttttcctaaatatgtttgtctgatgtatattatatcttattatggcaaagaaacttaaagtaccaaatagaatgaagacatatttgatattaaaataatgaaaaacattcaatatttgataacttcagagagactttgactaagcttcaaggttatttttataaacatgtactactggacaatgtatagaagtttcttagctcacagattttcactttggtagatgaggactaatgtgtttgccagaatgtgcacctcttctctatttaccgtaaagagaggtgtgggtaggagattgcacagtgtcacttagggcttagaggtgagggattttggaatagcttttagtttaacctgcgtgtgagaaaagaaggtttcatcgtgtggttaataggaattttcatatgataggaaaaggattaacaagatttaactttatattctcaataacttcccaattaaccagtgtctttgatgaggaaaaatttgaaaattatacagttgtgtttcttttcaatcttcccttgcacgattacaagacgatggaaaagtgcttacactttgattgctgttcctaataaccatgttagaatttcacaggtgatctggaatatcatatcttgactttcatatgtgggagcaagagtcagcaaacaacctttctgtgcttagagatgattttatacataaaataatattgttttgaaaatgaacattgatgggaactgtgtcatattttctgtatcatatttcatgttagctttattagttagctctcattacctcaccaaataactcagatttaaaaatatgtatcttaactgtgatcagcctaaggactctattcgatgatcaagtcatagtcaaatcacagtctcatctcttaatgtgttcctttgatcctcctcccaactctccctccaacattcataccaaatccttggatgtttctgcttagttcaaaaagccatgttctctcactatgtaaattataccaagaataccactaatcatatacgagaagctaacaatctatgcttgagttgtgtgttttttaatatcatgctttgggatatgatgccaaattggatctccaatttgcctttaattagtcagcaacacttatttaatgcccactaagctcagagcaaggcttggagggtggagaaggggagtaaggagatcgaaaaacaaatacactatcatttccagaatagttacagtatctttatgcatacagaaaacagataaatgaaaggatttagaaaacttaaaagcaaaatccaaatgagtgcaaattggtctgatacaaactgagctatataaatgcaaagaggatgcaaattataaaaacttgaagagtttaaaattgctatctttctacttttattttcataatactttgccatgagaattcttagatctcaggacaccatacccttcagtgaggaaagtttactggttcaattgtatgatttagagaaacaaacctaattcttagcattttatgggcttctgagagatgacgctgtaaaactttttgagtctctgttaaacttttctcgtcattaaagcttttatgtaaccttgaacaagttccttaacctctctgcgcctcaacttccacatcattaaaatggggatgataataggacccatctcataggattgttaggactattaaatgtattatactctattacttgtatcctataaaatatctttctcacagtttaatttcttgaaaattgaaacacatcctatgattgatgtggtaagaaaccattgtaacacatattaagtgacacctgttggttctttgttagtaggttagtagggaaaaaaaaagatgcagtttatagtcaaagccgtgtgtaaagtgtgtctaaagtgcttaaaacaaagcctgtcatacagttggtcttatagaatgatgctgttatcatcattgcctgaataccatatttgtggtatgtaaaatatttgtctccaatttcactggcttctgtcctatgaagcagatatacttatagttcctggtctttgagtaaatagagcctagaaggattatcagatattacacaactgccaaataatgacttacatcaaaccaagagtttattcctcttctcatgcatatcaacacctgtttaatctgatcatgttttcaaaaacccactagtgatctatttatttctagctatagctttcatcacctgtatttggtgatttgttgctggcagagtccatactcataacactaaatctgactactgtgattacaacagtctttctaagttagataccactaatgatattgattagggagaaggcattctttgtgatcctatttgcacgatctcgggtaattcacttactggacccaattgttagttgtgaaatgtgaatgttgaaagcagtgaatcttccagctgcttgatttgtgatatcactatcaatttacctactgaggagcttcatataaattggtcatttgtagaaagtagttcagtggctgagaatctggcataatattttatttttatgaaatttcagtaaacattattgagcaacttgtaggtttcaggctccacgatagggatgcaagcatgtaagacctctgtccagcaactgagaggtaaaactacaatgagaaagatagactggtaattcagatttatttttaaataatagctttttgagatataatatacttacccttcaatccactgactctggttttaaaggagatgattaatacattcactcaaccgatattgagcatctgatatgtgccagagacttcctatgtgctagggttatggagattgacaatagttatacaaaactgagcctgtcacaaaatgtgtatcgacagacagtcttccatttggtgctatagaccagtactcagggtcagcagagggtactctggaagcatattcagggacaaagcaaacctagtcttggaagatctgaggaagtttcctatgatcatgtctgtctcctgccataacaccctgaatgcatccgatctgaactaaactgaggtctgacaaacttgtaggagtttgcgaggtgagtggcttggggaaagtagagaggaagaagtttttctggaagagaaaagaaaatatgctgtggctctgaggtgaatcacatataatgcacaatagcttagtattgtgataacatttgggactgtgtgggcagacagtggctgcagggcctgaagggtggagagggggaacttacgcttcagtaggggtgtatatgtcttattatgaggtcacaatgaagattgaggtcagctagaggatgtgacattcgagttgggtcacaaaggatgtacaggagtttttcaaggctgaccacagtctaggcagaagaaattgcaattgtgaaaggaagatttgcgtgaaagaatggtgtttttggctgagtgaggaatttgaagtatctggaaaatggagtaagtggcacagagaaagaaaacagccaaataataataataataataataaattggtgagggttcggagagccgcttacaattggattcggtgcaatgcaatgactttatatgttctgtaccttgtccttgtaggcagttgcaggcactagggacaggagtctggggggaagacaggagcattgaaagtttgaggaaaaaatgagaagcatgctttagaaagataatctgaatatacttgaattggaggggccctggattgtgaatgaaaattagaagtatgtcatctgtattgtgtaggatagtgcttatctacaaagaattttatgtagaattccccatcagattaaccctttgcagcaatagccaattatttctgatattaaaaattataattaaataaaagatatggattggtaactaaacatttattgagaagttactgtatcacttccacaaatcaattcacttatttttcttagtaatccaatgatgtagcctgtcatttctcccatttttcagcagaggaaattgtggcccagaaggttgtatgtaactcatcgaggcactaagtggcagaggtcatgtttcagcctcggccatctggctccaaagcctaaatgtatgaattggccactaaaggcacaactgaaaatactaacagtccctgtgttagtgaagagggatatttggcaaaaagtttttattttgcttttttacaattcagtgatttgtaatttatttacagagtcatgcaatcattacctcaatttaattttagaacatttaaaaagtccatgctcatttgcttcccattctcactctaaccctagataacctcaaatctactttagtggtagtcagtttgtatgaatggcaacttcagtttaatggctttttttttttttgagtagtcacaatctgatagccttaatcactaattcaggagaataacattgtttgaccatatcatttctaacttctgcatgcaattagtgtactctattcataatttgatgcagagaagggtaaaagtgacaggccttgtggcagtcattggtcaaaggcatatgagtaagactgcctgagaccctaccctggagttctgtcttgcaggtaaggcacatagacaaactattaagcaatattggagaaagaaattattgtagaaatcctgatgtttttggtgaatggcttatgttaaacttctctctcctggaagtcattgaattgtttttaaaaacttagtatgtatgaagcatttggaatgcttggcattttgagaataaaatccacatcaatttaaaataaaataaaactccccatccagaatagagtagtaattgcaaggcataaaatagcccagctgtggagtggcttaaaggacaattggtctcaggcagagagtaccagataggacacgctacacaaaggactgtaatgtctcaattagtgtacctattgggtagcacatatatctgaaatggcttaaaataaaaattgcaaatgcaccagatttaatcaatcttagtatttccttctcttatgctctcagtccttagttaaaaataaaatttgcctgcctcattctcctgtgtgctagctagtaggattaactggagttctcaacaggaaagcaatagatctagtagacgacattgtatggtgggtgaaagcccgctagagataattatacagtcactcccactatattacccttcaaagaaactgagcctaatattctcctcctaagcaatttaaccaacttctaaaaaaaagtataagatattatttagagaatgaaatagctactgtatataatcaggaggaagaattatagcaaattatactcatttgataagtgtataaagagctacgctcaaagctttgtattgtacctcccaagtaattgttcagttgtgctaactgtccttaaaaaaggagaagagataaagaactgctaaagaaaaaaaaatcaatcattatacttgttcaggaagattttccttctgggcaaagattaagtcttatttcatgctccatgaggatcaagcacacatttggccctcccatgtttagtagtggtgatttctttgcctttctcacattcatgttcatgtataaacatagacaccaatataaaactaaatgcaataaaagtgtgttttaagatctaccacatgtatgtcctagtaggtatagatagatgttatatatctgtgttcactgcacttacatcccaatattttcagaagataggactgtatgcaaatgtttccaatatctctttctaggatcacaaaaaaaaaagaacccctgaggtctttctacttgtttcaaaaatgagctggtagtaatattagagccaatttccttttggtttgctttaaacaaaataaacagcccattatgtaaactgtataagacttaagtgtttgagcacttcccttagagtttgtaagtcttatgcccccaccatcaaaaagtaaacaaataaataataaaaagccaatctaattgttattatgagaagtcatacagcgtatttgctaagagcagctcctctaaagatgtcagactgccttagatggaacactctgtatcctccgcttgccagctgggtaacattcaacaggaagcttaatctctccatgcctcaattcctgacttcaaaattattgtagtaatacaatgcctacttcatacagttgcggagacatcagttaggcgctgttcctctcacatatgtcatcaattctgagaccgattcacatgcttaacatttctgactaattactgttacgtggtaatcatgacatagcggccattgtctgtacttgtacatcaaaatctgctgtctatggagattagtgacttggaagaaaatcctggagtcaatagtggaccccttttttattaagactcttgatggcccagaggtcagtataatgaggaaaacatagaacttccatgattttgacttgaaaagtaattcaaagggttgaaatttaaacgtaaagaaatttttggaatgctttcatttgttgcacttatattttgctttttatgtatgtagaggggtgacatatgataaaaaaactatggataattttaagccatttatttcaacaaacatgtaatatatattctaacgacaaagccctatgttataatttaaatggtagtaatttttgtttccggttttgtaatagctaatggtgtattttataatcagtagcatctttgatttgatggggtagtgtagtaagaactcaataaatgttagactcctcattaggatttgggtagaggttaatgtcggtagacacattattagagttaagggtcctaaggctttttaatgtgagcagagtgcaatgaaagaatattttggattgaccaaaagtctagagaacctgatttgtaactgtatcattatgacttactgaatttcattcagtaaatattgcatgaaattgagctgaaattcatgtctgctaaatatgtgtactctgcccttttctcttcattatgaggattaaattgaatgataggggtgtaagcactttgtaaatccaagtaagaattattagttaggatagttcaggtagtgctgtagtaacaaatacttaccaaatctcggtactgaaaacaagggtttatttcttacttatgctacttgttcatcataggacagaaggagttctttgcagactaatagttgtcatttccaacacttttgacctccatgccagagtaaaagagctctgagggtctcaaactggcaattccacactttgacctggatgtaatacatgtcacttcttatatagctccttagccaaaactattcacatggccctacctagccatagggttgccacagagcagagagctggaaatatgtggagaacagtgtcaataagtttgtaatagtaataatggttgacaatcattgtgtgcttcttagtaccaggcactgttgtaagtgctttagatgggtagagtcctttagtactcatcaagtgggtatgatcatgattcccattgtacagatgacaacccaaggcacaaaagggtagaccaacctgcacagaagagacagagcagggattttgcttgtgtgacattgatgtgtgtctcaaactataatggatttgaatgcattttttaaaatgtaaaaggaagatacaaatatagttgagaatcttctgttctgaaaaataagagatgaggtttggtgatccccaagcctccctaaaatttcacctggatcagccccaaatgacctacacttacaatgactgctgtgttcttttggcgcctcatcttcagaaaccaggggccctctcctggccactgacttacgtcgtagcttagcagaggggcattgtcccagcgtttcggtagatacttcctcctttgacttatttaacctttctattttgggagttttctaacgtgtagaagaacagtagagtggccacagtctactccattatcaatgatcaatacacaattaccaatacattctcaatcttgcttaatttcactttgcaagttaatctggctgcttgtcaagctgagctgtgaacacaaactgtgttcttggggttgcggggtatagagctcctaaaacaggaagccagtgaccaggggagggccagagaggacatgtggaggacagaattgaagggcttcaactggaaaagagggcgtctctaatcaatagtttagacaagtttgcaagtggaagataaatgatatgacaatatttaatcattcataggacattcttgtaatgtaagggggaaaaggagaaatatgttgttaatagggagccagaattattacctttctccgtagctccaactgtaatcttgcctgctattgaggtagttaataaaccaaagcctgtgagctctgttcaatgggacagcaaccagagaggcttctttccaagccctcccaccaggccaagaagcagctgagctggatagaaagcatgccttcagcaccctgggtttcctcttcagtggcatccagaggaccctgggtcacttcacctctctgtctctttctgaaaaacgtatataataaccgtctgggtgactcacaaatctattatagcatttaattaacaaatgttcctcaagtgctttgagctccctgtttggatagatgtgactgaaatgtaaaatacctttcactgccttatttattgctccagcgaacacgctatatgctggcaccatttatcttcattttaattttatctcccacaaatataggcattaatttaaatcacatacagaacataacagtttttatagaggcaaacttattccagtgtgctgcattttaatatcgcactttaccatcttttctcacttgattcaagaatagtatctcttcctgcctcagcatttaatcttaggacaacagaaacttttttgtgtgtgcatgttcttgctctcaaactttgtttctcactgctttgctgcttgttgcctgaaagttgttctgtcagtgtgagcacaggtgtaagtaattccatttctcttttgccagcgtaatttcctgtgtgtgtgtgtgttgtgggggctaaggggggtgtgtaacatgatggattttacagctgaagcttatactcattcatcttcagatatcttttctaatagaaataaagacaataaaagtgataccctcctcctgaaatttacacattaaagaccccttcaaactgctcactttttttctgtcttttttttcattcagaggcaaaatttccccctttttttcatcactgttacgtttgcggcagatgagtctcttccttgaggggaatcgtggtaaatgggcctgctgtatttacagctatgaaacattccagttggctgtcacaccctaagcaaggaaggtttccccatccttaatttgcggcctgaaaagctgtggctctcctcaattaagactttccaaattgcctctgacatggcagcatattcccaggagtcaggtcctgggaggcagtaataacatgagcactgctgtataacaacgtagttttacaagccattttgtgctcttttcagaagctttcaggatgctttttctctgaagttgtaaattaaaaagaaaacaaaacttattttgattttttgtttttagttttcctagtctctgaatgtctaggtttagggacatctgtcatagtcttatttatttattttacgtttagtctggatttaaaatgtacaaattaatgtttaagttctctgttttattcctgtaacaatcctacaagaacaggttccattattgtgttcatcttgcagatgaggaaacaaggcctagagaagttaaatatttttttctgaaatggtacagctagtacgtggcagggctcagattttggatccggtccaccttaactaaatatgcttttgatgtagctctcttcaggctgaattcttgacctctcatttgatgctgactcttctcaaacccttagtctttgtgctactaggtagattttatctgtggcaagaacacggttaccctggaaacccactagctagaatggcaagccaattatagcaccaccgctttttttaaattaaattagcgctgctgatgacgtggacttcttgattgaagcatgctgagaaatgggttctcaccagttgttcctgcctcttaggatcatgtgggatcattctcatctattctatcaagccaaacaagaaaatgcctctatgtgattgactggatttgaggaataaaatgtgatgatcttttaggaccctgagctttcagtagtgagtagacatgcatggaaatgtttggaaagaagccctattggagaagaagcctgtcatctggatactttccacccccaagcacacaaggtccactgatttaaagccctgctcttaactactgaggctaatgttctctattttagtatttcttattttatttaaggccattggtttaaatccagacttgattcaggaaaggtcgtagccctttgatattctttggtctttgcacacttctaatagggcaggaatttgctttagttcaaaccaattggtgcatttcctttaagtacacagaatttaaacaattgaattgatatggccactgttgaactgagtggtaccaggttggaggaaaggacattcattatatgttagtgggttgtgggctcactctctgagatggtaaacggtaggctggtagaatgttgagtggttcattctgcataacacacatggcgccaggcacattacctagtacctctatgattttcatccgctttattttctgttttgtagagtaggtaaaggtaaggagacgggcttgctcatttgcaaggctattctgtgatgcagggttctgagtacaggattccttatttgcagtccagtgctcttcactttataccaccaagtcaccagagtctcagggcctgtcttctgtatcgcagaaaacaaatcaaggattagcaacactgaatcttaattcttgaagttctaacaggaaaattatgttagtcttgctacatatcgtaggcatattttgtccaaaatgagagtaatcagggaggagaagaggctgcatcttactgtgtcctgatgggtgatacttccgtgactatctccatcaccagtgagcagatttccagaagtcacagttcaaaacgatgaagagaattacacattttcagaaaacattgtacattctttgttaacttttccacttgtaaaataatttgttttcagacatccaggtcctttctccatgatttactgcgttggtgacattaatcagcgtggttatcttggagcctcatttccccttgggtaaaatggaaggataacattggcaatcatacagacgtgttgtgtagaaaggagtaagaagcattttggaagtggcaaagtggcaataatcccctgtaagacagtagctgtttttaagatcactgagctctcaaacactggctttttctgcctcacactttctagatttgtaagacttaatctgaaaatatctttgctattcattatgtataattgtagggctttggatttaaaaaatcctaattctgttatttccctgacaataacaaattattctcatctaattttctcttatgtgaaataagacatacaccctagttacttccatgcctaatatgattgacaaatctatatgttatctgaattgtgaatatattttcatacatatagaagtacatgtgtgtatttcttgaaatctaatggtcaatatacactaaccagttatttctgggattttgggaacaggcttctttctatacttctctacttatctttaaattttctctaatgagcctactttgcttttgttttacatacagtaattaatatatttataaatgtatgtatactatatattttaataaatttatataagtatatgtatgtatatacatatgttttgcaagtaaaaaaactttagtaataaatatctacaaaggcaaattaaaaactattacattttttctccctcccttcctttctactgtttccctcctctcctctctttggtttccttccttcctttgttccttcgttccttcgttccttccttccttccttctgtccttcccttccctccctccctccttcctcccctcccctccccttccttcttctttcttgccctttctctctctctcttttcctctcccccttctgtcttcctctccccacctccatctccctctctctctcctccctccctgccgccttccttctttccagaaagtcactaaccagaatctttcacagaataaactgtgaaacctagatcttaaatgtactacagtagaaaaagagatgagatttttgaaagatgatggcttgtccttgtctctgtacttgaatctatctcaaaacaaagatataactattgtttttaataataatttcaatatagagtgaccatccttgcctactaccctgaagagagagagcatttacacataagactggtggttgcagtaaacccctttcaagtggagtggccactatggtccttcctcttcccttccttcctttcattcccttgccctttccccactttccttctcttcctttccttttttcttttaaggttcataaaatcttgattggcctccttcctagcagccaggagtttgggtccctaatagctaaagcttatatactttattttcttctttctccagatggctgtggctatgaattttactccccatcccaggactacccctgctatactgacactaattttcattttataatactgtcttcatcagtccatgctatgctactagttttagttattataatattaacttaatccacaatgaaggcgacaggtttttttgtgtgtcttactttttaaaggggaaatattatctctcactttaaggaaactaactttagcaactcattccctcacttttttttttctttcaacttgatttgttcaactaaggagaccacatttagtacttgctagctgagacttctgttctacaattctgagttagttcctcatccgtccgaccctctctccccgtggtgcactgagtcacaatgtgatcaccagctgcatgtgctgctattacacacaacacattggctagcagaggagccaggattcagccttggaagtactttcaggcaaaggtgaagaccctttccccactctaagcatctttcagtagtttagtgtagctgatattaatgttataaatggtcattcctaatcctgtctcagttccagcccagatggagttttgattttagaaaatcattcagtgaaatgtatttcctgtgcctggtagtcattgatcacttaccaaaaaaaaagggggtagtgggagactaaaaataaacttatgataattcacatacacttaacctttactgactaataccaaaaagggaatgaagcaggctctgctgaccagcacttgcagatggattccaggaacgtggctagagctgccaaagccatcgctgaatcctgccaaaagcatcccaggggattttactaagggtggggagagcagggaacatggaggtgtgtgtgtgaatttgttttaaaactctcttactcaacactgagcagtgggaagaacactgggaaaaaaggtcggaaagtgacattctagactgggttccacccaatctctatgacactggaaaagtaatgtgtcctctttggaacttcaggtatcatgtgaacaataagggtgtcatattaaggtcttaacatgttgaaatgttaaaaacattctgtaattacttaaattatttcaaaacagaaagatcatacatgttcatcatgtttctgtgttaactggacaaaactacactaaaattaaagagcaataaaagcaatcgtgttaaaattttatttttaaatatagtacttctagtaactgaatatctaactttattaacaattctaaatctcgcttttttttttttttaaaccccagtgaggctgggcaccgtggctcacacctgtaatctgagctctttgggatgctgaggcggtatgatcccatgagcacaggagtttgagaccagcctgggcaacatagtcagatcctgtctctacaaaaagttttttaaatagccaggattagccaggcatgatggcatgcacttgttgtgtcagccactctcattgggggttgggggggttgggggtgggctgaggtaggaggcttgcttgagcccaggaggtaggaggtcaaggctacagtgagccatgactgtatcactgcactccagcctgagcgacagagcaagaccctgcctctaattaaataagcaaatacacacacacaacacacatatataaaataaaataaaaaccccaatgtgttaagatctcaggtttaaacctcggcttatacaaaccatagtactaccgtgcaataactgaattgacaaggtaccaacacctattttaaccagaaaaataacataattgtgttatattttccatgagagtcatactcttgaaattaagtattttctcaatagaattgtttctcaattaaaaaaaaaaacttactcaaaacatttagtatttaattataattataggcagataaaatttataaaagattatcagtaagatcaagaacctctgcctctttaatcatgtttttctctaccttttgctggtctcttcctgattttgatgacctcattgtctatacgagtattaagacatttggggtagctttttatgttgtgtactttctttccttctccttatgagatggctgacaccttctaaaggattcagagagtttccatcttattgaaaggtccttatgaaaattcactggtagtgttctcagcttatactaggaaggcatgtttcttcagaagcagtatttgttgtatttagggtgggaatcattatgtagcaagagtggtctacatattggtcttgcagcaacatcagcaccccttatgaatggtttgtttcccaccaaaagtcaaagattagcctatatgatggatgatggctacagaaaatagtgccagaaaaacagaatcagtagaagatatatattaagacattaattgggaaggagtagcttgcatgattttgtgggctggctaggcaatctaacatctacagattaggcaattaggaagggcaggctgtaactccgtggcatgagatgaagctacttgccacaatgagaattccttcttctttaaggaatcctcagctctacttccaagacctttcaactgattgaatcaggctcaaccaggttatctagtgtactcttcattacttaaaaatcaactgattagaggctttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaagtccaggaagagcataaaggttcaagcagaaccatgagaatgccagcattgtcgttggagatggtgactggaagtgatgataggtctagggaacagtaaatgtggacagactggcattttacctcgggcacacttggacctggataggctccaccagtctgccctggaaacagaaccacagtgggtcagacagtcttttgtattagttttaaatacagagttgattgtctctcttgcattcttaacttgcaatttagtactgtttatattctgcttgaaggttagagacattcgactaaatggtcttttctccacattgctgtcattcattaatgtcctggtcctggactttactcattgaccacaggacaagtggctcaactctctcctgccactacccaggctgttagtcctgttgggaggctcagggcccaactcactcatctgtaactctcatctccattcagctgcagcctctacagcccctggttataccctggatcttatcattgcttcgctctattttacctcctaaatcgtaaaaattaaaaccagcctcggaacacaacccctcattcttccagcactctctctcattcaggtaactcctattctacttttcttcagcatatttaccttctattacctttctttttcctcaccagtctcttatatttcctttattatccaacttacagtctgtggttcaatacttcagccgactcttccaacacatgaccttctttcggtaggcttttttcagagtttcccttttgtacttgcccttatgtaaatctgtggcacagtcaggccatcttgccaacttttcacagttattgcacaccacactctgttggttttcttcctaccattctgaacaatttcacttcagggctctccttagtggctcttcgtctccctctccttgaatgtcgttttacctttttctttttcttttttttttttttttttttttttgagacagactctcattctgtcacccaggctggagtgcagtggcgcaatttcagctcactgcaacctctgcctaccaggttcaaacgattctcttgcctcagcctcccgagtagctgtgtctacaggtgtgcaccatgcctggctaatttttttttcttttttcttttttctgttttctttttattagagatggggtttcaccacgttggccagtcttgtctcgaactcctgacctcaactgatccacccacctcggcctcccaaagtgctgggattacaggcatgagccaccgtgcctgggcttgaatgttgttttcctttggtggggcttggggaggggtgtctttcctagggcctgctcttgtttcacttcccacatttggttaagagagcctttaactactatggcctcaactatcagctctacaatatgatataaatttgtttcagtaaacttgctcttcagattcaattgtttctaactgcttatcgctcaggtgcatttggatgtattgcagaaatctcagcctcaatgttttcaaaataaactcatccacttctctcaggaattttttccactccaatgttgttcggtatgtggcatcaccatctaaccagtttcctaagccagaagtttaggtattatttctaagccctctctttcccttattatcaattttacctcctaaatatttcacaatctttctacttctcctcatttctgctgcggtacgtgatttcagatcagcatcatctttcatggaccattggtgatatccccctaacgggtttccttgtatccatttccccaccatcgccccaatctatccaccaaggctttcctaaaatgcaagtctgactgtattactttcctgtctaatatgttatctccttattcctgtagtataagacagtgattaggaaaacaggctctgaagtcaaatagaaatgagtttgaatctcatataactatgtgatcttggacaaaataaccttttttggtttgttttccacgtgcgaaataggaacagtaattgaacttttctttttagatgttgcatacctctctggtatacatgaagaagatgtgtagtatctcattcccaccccgcttatgcaccatgctatagtcacacactgcctttgctctgatccccagagacattgagccaccactggagagtcacatgatattgtttttagcctggaacattgttcactacctcagtcttttattgccttgtctcaacatagacgccatttcccttaagacattttcagcacactcctctggtataatttagtttaaatgtccttgctgtgttctcctgtgtttttctccttgaacttcctaatccttacaccttccaccctgcaaatgatcattatctcactgcctctcccaaatgataacctctttccacccattttaagttccatgaggacgatgaccattgacccggaccgcgttgttaaacttcttagtctcagctgccaagagcttagcacagtgtctagcagagatcggacactcagtaaatatttgatgaatgtttatagtgtgactgtctcgccagtgcacatacaacaaagtgatcccatctttccttctgtatcataaaatagaattttcttacctctgtaatttctccctaggaaccagactgcttctagagagcttcttcacaaaatcaaattaattggtattttacaaggagggaaagccccaggacaagtcccttctcttgaccacaaagttctgtgtttctcatctttcctcttgatgtcttggtttcagcaaagcaacatttctatccctgccccctgctcccccataatcctacaaatgtactatagatatgtgtaagtactacatccccaatcaagtacagcgtttggcctcgggtgggagtcaaacagcaagctgatttttaacattacttggaagaaattttctaggtatataactgacaaacattcatggagagctacttcatttttctgtcaagcttttgggggattttttttaatagttctgcactttgaaagaaagttcacaatttttaaaaggaaatgtggcccttttcattagctccttttacctcatgctgagtcatggatgagagagaatttgtaggcgggtgagctgcaggaaaagtaatactgtcatttacacttgcaggctgttatgctttccagaaaactttttccgtaggttgcgaaagtgattaatctgctgttaaaactgacaaagaaggttctctgataagagaaagaattaaatgaggaatttttctttaaaaagtaagcgcttctttcccattttagattagaaaaataagtttaaatgtttcttttaattttagtcgtgtgtgtgtgtgtgtgtgtgtgtgtgtgtgtgtgaagttggccatgacttaatacaatctcaagccattttctatttaaattatgtttttttacttattggcatggcttattcctcatgctgtatatctaaattattcatttctacatcctgttcccttgcttgtctctctttcttcttctttttttttcctttcattttctttatttgggtcttttcaatactttcaacatcatcttacttcggagccccagatctcttcttttctaccaaccttttttgaaacattaaaactggtgaagatggcctgagttctctctgtgatataaatttatccctccctgaaaaattccattcatgtaacatttttataacactttttaaaactaggatgaaagttttttcatgtagttgaaatgaagcatcactgcctaaagcgtttagaaatttttttactgttggttttaagaaattactctaggatttccactgaggactggcaagtattggtgaagtttgatctctcagagctcatgtttcagatggcaacttaaagggacaaataaataagtcaatcacacggcataatctaactttaatatgattctgcagagaaccagtgactcatttagagaaatcagagtcctcagaaaggtggaaaacatgttagaacttattaagcttgttgcctttagcatgtcaatgccttgtttttataagaagattcaatgggttgttaaaatgcactgtcttaaccctctcccctttgtatttttctactcttaagatgcatcattttatgttgggatctatcagtttattttacttgtttttccttcttcctctccttattttgaaggctgacttctgagcttgagccatatccttggcaactgaatgaattcatggggagtatagtagaaaagattttctcacaactctgacagcactgccccctagtaaaaaagggaagagacaaagagaaatggtcccttctgcaactgaagggaccagcacaggggacttggcattcttcttttagtcctaaagcttagacatacatactgctttcgcccctgggctacaaatacatgttttaaaattctgaagttgaaaacgtcaaaaccatttacaattaaaaacctgctattactgtatatttatacaggtatttcataagggaaaaagtagaaaacatgtaaatgtatttgttttatgtctgaagttccaagattatttctgtttctttactgaatgtgtttgaaatatatgcaaacacacatgtaaacatacctgtatatttatgtacagatataagtctacatggagaccagcatttttagataacactgttttacaggctgtgcatccatctttaaggtgctatagcataaggtctatgactgcattttgtaataaaagatggcaggctttctggaaagggtctctttggggcaggaagaggtgtgaagatcttttgcattctacttttaaagtacaacaagttaaattgctaccagatacattagctttatggaggtttgtttccatttttatagcaaaatcaaataacttttaaatcagaggaaaaaaatattcttttgttgtttttatttttgttgttgagattgcctgttttacgttgagtgcagtgtttttcaggtggaaacatattggtttgacattttaagaggaaaatgttctatatgtaatatgaaagagtctttttcttaactaaatgccagcaacaaaatttaaaccaaaaaatgtagtaatgaaacaatggtaatgagatatgattatggtttagtgagagaaaaaagccctgcagggaacagtacaagcacagtaaattatgaattgctactaaataggcctcattagtccactgtggaccatgtttaattgatattagaaaggagtctggaaaactttggaaagtacatgtaagacaacttgctgttaaactaataaaagtcgttagagtgtctgtttcaaaaattagtaattattaattgtgtgtgagggtcctcaggcagcacccattttactaaaacatgcttagagaaaagatatttctatgagaaatgaaactgcagaatgctgagcagtgtaatatgtgacagttccctgggagtttctcccctcctcgtaggtatttttagcaaaatagtccttaaacattgttttttttttttttaagttggagtctcgctctgtcgccaggctggagtgcagtggcccgatcttggctcactgcaacctccacctcctgggttccagcaattctcctgcctcagcctcccgagtagctgggactacaggcacgcaccatcaggcccagctaatttttgtattttttagtagagacgggggtttccaccatattggccaggctggtcttgaacacctgacctcgtgatcctcccacctctgcctcccaaagtgttgggattacagacgtgagccaccgcgcttgccccttaagtgttgttttaaagaaagttggcgctctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaagaaagttggcgctctactgaagactggagcccaagaagacatttatagggattgtttattttcatgttgttactacactccatggtctgcaaaaccagagtgccagatgttaaattctatcagcataatgcatctttaattaaatattatatacgccatacaattaataatgtggtctgtttccaaaactttattaagaaattaccataattttgtataataggctaataaaaaggcactgtactttgaaacagcctttcgtaaagtggttatatgatttgtatctgttgaatttggaatttagattaagagattgtgggccagaattatctgatgcaatgtactcaggactttaaataagttgcgaatcttgtagggtctactattatttggcttcctttaaaataaaataggtttcttatttgtcgatgagctcactctttaagaggtttagggaataatttacctactcgctttgtgtcccccaaccctactttgtaaaaacctcaaacaatacaaaacatgataattccaaatatacagtacattgggctatgatatttcttaatgaatggaaagtcatgcatctggttctgtggtcatcattgatgttttaattttcacaatgtgttaacctgatacttaaattcccctagttgtcctgtgaagaaagaattttaaattcacatttcacatgcagacaaactctgatatttaaaaataatagttatcttttaaactgagatcctatgtggatatggaatagcgtatacagctctgacaatagggcttcagtaaaataacattttgcaagctgtgtttttcaagacaaaatgtcaccctcagctaaacagaagtaatttgcatcagaggtgtgtgtgtccttactcttaatgaaaaaacggtcccctctcttcagaaagtatttgctatctctacaatgtattattttcatcactgtgtccctcccctgcccttcttatgccctaatatttgtcccttaattctattaaattagttgtcaactaaaattaaaggtagatgttatccttcacaatctgtcctggtctaatttttcagtcttgattcgtcttctttactttatggagtgtagaggtggctaacagaacaactctggagccacaatgtgtagattcagataccaacagtagcttatgctgaaacctgggtcaaattacttaagctcacatacctcagtttcctcatctacaaaatgaggataataataggttcttcctcacttatatgtaaagcatttaaataaggactagtagattgtatgtactagctgttattaaattctgccacatttgtttgttctccatacacaccttagccttttgtctatgtctctgttcacattgtttgctggaaacaggatccacccttctcctccaaggccagtgtatgtgtgtccacaaacacacagccatccatgtgttgtgattccacgcacctccgaagatacggctcagagagccaccctctgcttgccagattgagcatagttcatctggaactttcatacacttctctgtcttacttagcatttgcaactatactttatagttattttcaagtttattttgcctcttttgctggtgtgtggacttcttgagtccatggacttcctgtgataaatttctccctactacaaaaagctcagtgccttgtgctgagctgctgtgcttagtaatagataggggagagggtgtttttttatatctatatacatatatatgtacatatatatgtacacataatttgatatacttttgagtgtacatgatgtggttccttatttttgcattaagcctatcacttccgggcattggcaaagatctgaaaattaaaaggaacacaaataagaaatgcatttagtccatttaagcaacatgtgagttcctcttattgagtttcttccctaatttagatctcaagttttgcaaaagaatgacaaattcctttatttaaagaaaaatgaaagcagatctgttaccttctgtcctatgaatgccaattctctatcctggataattagataaataagatatgtataagcgtatggtttatgcacatagacatgaagctctcaatgcctgcatgattttcctgtcatgctcatgtgggttaaagcccaatagatgtattttgaaaactcgaatgccagtatgtctttaaaaagattatatcctgaaataaagttttaacatcctgtatcctatgataaaagttattttgcatttttttctttaccactgaaaacttgcgaggctcaaagtagtttaatttttatatattgaagctactcatttgccatattttaaaaacaaatcataaaacatggtaattggtaatttcacaaattttatcagggaatattttattattacatttttaaaataaaacctgtagatttatttaaaaagcatattttgaactaaagacctgaaatgtgtagcttgtgtagctccatttgaaaagatgaaggttttgctattgtttacaacagttttgcctgatttttgttttccccttttgctctgtttttgtagttcagtttgttgcagcattgttgtcatgtctaatttttgtttacgttgcactgcacagcactctttcgtatacttaagtaacctttcttgttctgcactgctgaatgacagctcatttattctagggtggtaattgcagtgtagcagacccaggtgagcaatgtaaaaagttgaagcagataaaatgtatgatttcttttataatggtattgtgtgctgtgttctcctcatatagatgctttttgtttacatagagaatatctaggaacaatctacatgttcttcaagatcttttaaaataaatactctttcatttttaaaaaagatgtattcttggccaggcgctgtggctcatgcctgtaatcccagtactttgggaggccgaggcgggtggatcacttgaggtcaggagtttgcgaccagcctggccaacatggtgaaaccctgcctctactaaaaaatacaaaaattagccgggcatagtggcacatgtttgtaatcccaggtactcaggaggttgaggcaggagaatcgcttgaacctggcaagcagaggttgcagcgagctgagatcgcgtcactgcaatccatcctagacaacacagcaaggctgtgtttaaaaaaataaaaagacataattgcaaaagaagtatttcacttcaccctttattataggacagaccacagtgcaagcaagaagataaatggttaacttacaactgacctctgattggagaatactagagagtggtgaagactgtggcaagcaggagggctcaccaacctcccagatttaacccaggctgcatgtaggaatgcagacccagtgttgctaggtctctggaattaagttatatttaactagcctgtgatctctaaggccttcaattatgaggttcagcaccactggaaaactgagtcagtttagtgctttatttcacaaaggcaaattgatggtcctttctgaccctaaattcccagttttacttaaactatttagacaaatctaagaagtgtgtgaaataaatacagtggagcttgaggatttttgttgttgattttctgtccttttatatttcctccttccctctgagggttcacataggagcctccacagccagaggattactttcagaattggaggcaagattatttcttggaattttggtctgaggaaaaattatttaggtcacttggacacttatgttgtgctttcccacaaaattgtctagcattttctttaagacatatgcatgaccactgcccaaacgaaataaatcaccctttctcttaaaggatccagactattaaatatgaagaacatcaactaatttgactagcagaatgtaggccttcagtgttaacatagcctttttctgttattgcatttatctgcctttgttctgaagccccagtctagtacctttcttaatgcagatctctttgagcataatgtttccattaaaccagccagtggatctcatttgctccatacatattcatattaggaaatattattgtacaaagtaaaagatgctagtaaaagatatgctggaacaacatttctgacagtatttgttctgtagttaatgctctgggagcctttttccttcaaactctctattcctagttagggcctcatcatttcttgcctggattattgcagtagcttccaggctggcttcctttatgcccttcataagcatatggctgccagattaatatttttttcaacacagccctgatcctgtcattctacaattgagttcctcacagtctacctgatacagagacagaaggaatgtgataatacaaataataatggtactcacaacaacaataaatgactggtctttgatatttaatctctaatatcaattgtcttgagacaacaaggctttttgaattcaatatcagagggtttaactgtgaggtacttggcatgggtctgaattgcatgtatattgtatgactgattgaaagaagattatctgatacacatgagaagtgtggaggtgggagctgacattttgttagaagtgcatgcctggcattttgatatactattgcacctcctcaaatctttttaacagaaacaaactactttgtgatgatagaatagcataatacaggacagcggaaaaatcttagtgctttttgttctggttttgattttgcaactaaatatgtatgataaataggaaattagtgcattggagcatatgcatctgttaaagcagattgactgcttggttatcacactataaacaacatttttgaagaattttaaaatttataatctctgatataatgttaaatgaaaaataagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaacgagtgttttttatttctttattaaccttgttattacttctcatattttctacaatgagtatcactgtttttagttttgtttttgttttttaaatggagtctcactctttctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtcttacacgagggcttgcctagctctctcaaaagtctaagaaacaatgaataatattattttatttaaacattatttaaaaacatgaaaacagtgaatacaaagttgaactctcctcttacaataataaaaattcttcttgaataattctgtatcctaccattccatgaattgtatccatggaaaagtgtatgtttttctgattcatttatttatttgcttctaggttattggatgaagaaatctaggaatagaatgaataactgtatagattacacctctgatgcctggtgtgtgtgtgtgtgtgtgtgtgtgtgtgtttcttcccttgtgattttctctccttttcctgcctaataatgatgtagctgatctgcttatcatgttcctttatttctataattccaattgttgtagatcccatagaggtgttcactcttgctctctctctctcttctctctccctctcacacacacacagattaaatagagaaaattaagtaaagagaggaaaatgaggaataatttcatactttaatatattcattcattcattgctctttgataatttttttcttttttaattttatttttccctaagttattggggtataggtggtatttggttacattagtaagttctttaacggacatttgtgagatcctggtgcacccatcacctgagcagtatacactgcaccatatttgttgtcttttttcccatgctcccctcccactctttccctcaagtccccaaactccattgtatcattcttatgcctttgcgtcctcatagcttagctcccacatatcagtgagaacatacgatgttcggtttcccattcctgagttacttcacttagaataatagtctctaatctcatccaggtcattgcaaatgctgttaattcattcatttttatggctgagcagtattccactgtatatgtatacaccgtagtttctttatccactcattgattgatgggcatttgggttggttccacgatttgctactgtgaattgtgctgctataaacacacgtgtgcaagtatcattttcgaataatgacttcttttcctctgggtagatacccagtagtgggattgctggatcaaatggtaagtagagctctatgatgttttgatactcttctatggcatagacttagtgctcccatgttctaagtgttatgaaaggctgaagataggaatattagaacatggcccccttcctgagttatatagcttagaacaatggtactcaaacttaagaatgtgtaagaattacctaggccatagcacttacacatggaatatcaagagggagaacagactaggagaagacgtttgaattcagctgcccatgtaaagtataaagaattatttttacccagaatcttgaaggggaaggaactgagtcacacagacaagaatgtgcctaaagcaattcagcagttcagagtggaatgaaaaggaccctggttccctgctcttaagccagtgttctttagctggctagaactcagctctctgtttaaaaaatgaatgggttgcagtggagcgctgtgttccaagtaggatttgtaagacttctggaattctgaaaaaattctactggttttctgcctgtttctctgtctatacttgaattcactgaggccaaaaatggtaactttttacccagtagctggcaacattcctggtaattagaaagtgatcagtaaatgctcaatgactatctgaatgattgcatttttcaaaaagaaatctgaagtctaaattttgagccaactaaacatcatatttctttggttttgggtggtttgggaaaaatccaatgtgttctctgaaaggaaaacatatttggagatatgattatttttttctgtaaataaagttactttgttgtaaatataaatatacatgctcattttataaaagaaaatgaaaggagaaaaaagagcaaaatatctgtattgacaccactcataattaccactcataatttttgttttgtttttcttattcacatataggacttttatcatgatatatgtatgaatttatatcctgttatttttctgaaacattatagcataacaggattaagtatcctattacctctacagttcctgatatttataaagataaattatgaaaataatgtttgaatgagaaggtttttctgtttatatgctgttccaaagaaccttaggtatcagaatttatctgagcccaaaaacgtcccttaggtaccttaagctacccaaattctttgaattctttcaatcaaatcccctaattttataaagaggaaattgaaacccaagaaacaatataagtgaatttgtttgaacccaggaatttcagtacttgttgtcctaatttaaaattgtgtcccaaagaatatttatctttgaatttgttgatgtttgctcttttaaaaaggaaagaagaataataaactaattcctcattttacctttaaaaggaagtttcactggaggaataagacccaaatgaatgaacccccatcagtcattcgtatcccccagctgatgaggatttcagcagttgtgctgacaccttgatcttgggctagccaccctccccttgctctgccatggagcttggtcaccttgtaccatggtcaaaataatggtgctctctttcaaaagccatccttagatttccagctaatagtgtgtagaaaagagaaaacataattttttagtaccccaaattctaggttatctactgcactgaatgatctaaaatatcaagtaggcgctttcagcaaagctgttagaaatataaatagaaaaaataggaaagattatttgtgggaccattcaaactaagactgttgttgttctcattattattgttgtttttaaaggacactgtccatatattgcaagacatgttgcccactgcccttcacctatgggattatataaacgcaatcctattttttaaatagttgtgcagaaaatcgagaagggagctaccttaactgtgtattcagttcttgagtgacaaagacaggcgtgagagagagagtcccttgcttccaaatcacccctcctttgcctcacccttttcaggacaaaccgactaccagaaatgaatctaacccatgtggtcactacaggatttatctgggcatttgctgaacctgctcgcaatttatttttatttcttccgatagacatggatttggcacaggggagtgaattctttttgaagcagcagatgtgcctggtacacccgtttgctgtaaccatttgtgctgtggttgaaaaaaatttttttaagagtgcagaattgttgaagggggagggttaaaaaaccagagccattttagtgattatgcaaagttagaatgtgagtaattttgctgcagttagtcattatgtgctttcatagcttgttttacagggataaagggatgtgtacaggtttggtgaatagagctcttatttgttcctaatagtcactcttcatgaaaacattttctacccttcctcctactctgtggcaaaagtgctctctccttggaaattatacctttctgggatccattccttttatccatctacaatcagtggacagacaactccattttgaagaacaaatacgttagaagaagaatttttttctcctatacaatctacagtgtaactgatacacattcaaatcatcgtaatacagtgatcattataaaatgagagtgttttctgcaaagaggaaaaaaaaaactgagcaaacatctagtgactttgttaggagcttaatgtgctctaaatatgatgtccttcaaatattttatttgaaatatttgataggtcttagaaaattttgctcatggaattctctgagaactgtaacacaccacctattcctttttcgctttgctttcggtcacccaaatttttttagaaatatgtgaacgagggtctgtttgtttccactgaagcaaatatagccacttgctcacactggtggcttcttttactgaagtccgtgaatatgttagaaactcttgtatgaaaatacagcaacccaatttgtccctattgagcctactttgtgatttccatgccctgctgcctggtgtgtatacactgagatccactttgttaaagaacaaaactgggtttgttacttttttgtaggcttattattaagtctgagcattctggtgtgaggttaggaacgctggtttcagactctggaaaacagagttctaatcctgaccctctgaagaccttctcactttgggcaaatctttcctgagccttgtttccttgaggaaaatgtagagatgtgtgatattcacatttcttacgccctacagttatgtgaggaatactgtatgtttcagttatgcacagataaattagttatttcttctcaaagaatcctctgttaaaaattattccccaaatagctctttttcgacacttgtctcaaggtggtcacattttaatttctgccactgatacacaaatttcagtgataagaaacccctgaatgacttgagagtttcctgagagatgggatcccacctattttattatcttttgtctttttatggcttccgagtagcagtaaaagataggaatggttggttctattacagtagttgattataaccaaaaactagtgaaccacactctccaaatgtcctgctacctacagctaagaaacccaatgtttataaactaactcagaacttttaaaattagattgaactacagaaccctctatcatacttaaatcttcttagatgaatggtgcacaaaactgatgggggatgggaagtgtgggcaattctgttaccgaactatttcccttattgtttcatttgattaaacacttctctcttgtatggaatttgccaataatacattattgaaaaaactgatttcaataatatgttattgaaaaaactaatttattgaataaaaacatatggaaaaatctctttgctagaccctaaggatggaaagcccaaatttctacccacatggagtttagagaggaaaggaacactaaataagtaattgcaaaacaagacgtaagggttatcataaggataatgcaaactattaaagagacattaatggtgggcaccttgtctaattttggaggttccagattggcttcctaaaggaggcatcatttcgtttgaaatctgaaggatgaataaccagttagaagttgcgagatggaagcaggttggaaagtgttcaaatcagggcaaccacaggatagctggagtgttgactcctgtgtagaggaaagtaagagaggaggctaagaagataaacagtagttctatcaggaaagaatttggacttcatggtaagagcaatgagaactcttgagagattttaatacaggaaggcaatgatcatatttgagttcttaaaatttgattttagaatagagtacgtactagaggacaataagcagtcagtttctttaaaaatacacatatacgtgtgtatgtgtttgttgcagtaagctaggtcactaatcatagtggactggactagggcaccaataagttaatagaagtagaaacattgacggtaactagtagagagaattaacaagctttactgcatcaagaggagaaaaaaaattgtgatcacgtttataacatataatcacattgctaaaatctttaaaatatctgttaaccttgaaacataactgatttatatagtttttgtcaatatacatatgaaccattatcttacttttcttttaaactggtatttcgaattaatgttttctggctttccagctgcataccattccattagctcaatgttctaggattttctcaaccatcctctgatttttcctttaatataaacaagtaaaatcacttatgtgcgttttaatagctcttcattgcaagtttgtccaccaaaagaatcatttcaattttcagtgctaccagtcatataaaaacgcacctgtaatattcccactgggattgagttttattatttcttgcctaattggttgaactcacagtatttttcactaaacccctggcctgattggagaaaagtgtctggtcccttgaggagatgcttcagcaaacgaggtcgcttgttatggaaataggctcttctctcactacatttctagatgatagaacacactcagattgatttcaccttcatcacaatggcattttatccagtgctggacacatgcatgctaagaactgagtgtactgtatgggtatttataatacccatattcattctaggaaataattatacatggctgggtatttacataaacaggagccttggagacctctcaagttcaaaaccgatggcattctatctcatttgaaagtcactggggtgggagaggacactccttaaaatattggatttcttagttttaatctgatgatatgctagctttatgaagatgtgagtgcaggccctcacctggatcgttgcttctctttttaataggaactagaaaatgaagattttcaaggtagcatctgggtgctcctaattgacttgattttatgtttgagaaaactaccttgacataccaacattggggtctctagaagtccagggagatgtttttcttcacagtgtcatataccctatcataagtgttgtgaggattaaatggaaaagcttctgggacaaaaactgctctgaagtgccacaccagactatactgttttaactatttctggctctgaagctattaagaataacccgtcactagcagagcacaaggctgtgaaatgaataagtgctgatacatttcaaagaagtaagatatttatgtgtgcatctctctggcaaaaactatcggggactcgttaggggtgtgtgtgtgtgtgtgtgtgtgtgtgtgtgtgtgtgtggtgtgtgctttatgtgttcattgaggactaaaaattagtattagtagtatattggcagcaatgttttgaactcggtggcaccaactaaaattgtgtgatttttatttcgtgcataatatttgagattattttaactcatcaccagatttcagctactatttatcctcatttataaggttactttttttctttaatgtggaaaataaacaaaaacataaaatggagaacaaaattttctcttaactgcctcacctagtgtaaaactgtaaccttttaaaatacattgaaaccatttttaattttctgctatgcttcttcctttttttgtatgtacatacacatggacattggaataccacaatattttagagtgtgtttgcttggtttttaaaataatgtatatatttctgatatatattatgttaaatatatatttatttttatacatttatatataagaaatgtataatatatactatgcctatataatatatatttcttcctttgagtgaaaaagtaatatgtggtagacacttagcaaaataggaaaagtatatagaatagccaaaaataacccctttaaaataaccaatgttatcagttgggaatagatccttctagccatatatgtatgcatatgtatatatgagatatagatagatgcattacttatcaacaggtataaaacaatattttctaactgaattttaaaacaaagaaaaattttgatacatattattatttttattatatagtggtaaaatatacataatacagaatttcacattctaaccaattttaagcgtataattcactggcactaagtacatttacattgttgtgcaaccatcaccagcagaactgtatctattcaaactgaaatgacatatccattaaacaataatgcactagctacattcttccttctcccatcccatggcaatcaccattctgctttctagctttataaatttgactcttctaggggcctcctatatgtagaaccatatggtatttgttttttgttttttgtttttgtaactggcttgtttcttcaagcttcaagcttaatctcttcaagcttcatctatgttgtagcatgtatcagaattttcttattacattgtgtgtgtgtatatatatgtatagatatatagatagatatagatgtgtgtgtgtatatatatatatcacattttatttatccattcatccatcagtggacacttgaattgcttcttcctttggctattgtgaataatactgctatgaacatattaccatgattgtacaaatagctgcattcctgcttttagttattttaggtatctacccagaagttgaattgccagattattgatatattttgaaatatttttatggcattgttttaatgactgtgtagtattctattatatgactatactgtaatgtatataaacaatcctcatgtattgattatttaaattttccattatcttttagttttataaagtacactattaacacggagcttcttgaaactaaacatttatgctctctggtcatttccataggctaaattttaagaaatgaaactatgggtttaaaaagtataaactttattagggcttttgttacatatcaccaaattacaccactgatttcccataaaaattttatagaaacaaacattaacttcgtccctaaatctaaattatataatcagttttccttctaagacaagtggagtcacaccattatgtcactcatagcccctaattccaagtgggatttcctgttcggctttagcaacagtatctaaaagtagttttgaactctggttttaactgacaatcacctgccccttcccttttgaatttccagatttcactctgttgagtgggtttatctacaataacttgcatttaaaaagccctaaatgattctgttgtgcagtcagatttaagaaatgcttttctaaatgtgtggtattatgtttatatatcgcactcttggccaggtgtggtggctcacgcctgtaatcccaacattttgggaggccaaggcagatggatcacttgaggtcaggagttccagaccagcctggacaacacagtgaaaaccccatctttactaaaaacacaaaatgagctggcgtggtggtgggtgcctataatcccagctatttgagaggctttgacacaagaattccttgaacacgcgaggcagaggttgcagtgagctgagatagtgccactgcactccagcctgggtgacagagcaagactctatctcaaatatatatatatatatatatacacacacatatacatatacacacacacacatatatatagcattcttaatctcatatatatataatatatatataatatatatatattatatatatatatgacattcttaatctgttaggttgttttccaactcatggggtcatctatcaagtggatagtgtaagtggcctggttggatgaggaatggagatatgggtacttaccctgaattatggaagataattagtgagatgactcaagaaagcaaatttagttattcttctagtcatggttaggataaaatgatgatgtaatttttgcatagagccaaaagaagcagcaaattagggatttcattataactgaaataggttagctgtgtttccatttttgctcattgtacaaactcagaaaccaattatatttatttatccagccattatttattaagtgcctacctgatatgaatccctaataatgagaccaagctcttcttgggcaataaaactctgaatattgcacatttactcttggaatcactggatttttgagagtcagagtatcttcttttataggtacctcgaccccagtgaagctctttttttttctcctgagtgatatagaaatatttttttatttgaagagaaagattatttattaaaaaaaaaaaaaggagaagagtaacttagcatttcccctcctttgttgttcagatgaagagtcagtctagagaagtcacgtgactttcccaatgtcactaaattctaaacagtggtaaagctggcactttttttctcggtctcccaagttccagtgcacaactcttcaattgcatgcttcctagtgatacttacatttgccagtatccataacttcaactgggaattgtaaagtgcacctcatgcactacaggtgacctgcagaaattgttttatttctcttccttgtgtttgaaataataataataataataataataataataataataataatgaacacagctttaaagtcagaagagtaatattggatttatattccacatgtcagcagtgagctggcatgggatagcagctgcctttttaacagagtaaactcttcagctttatagttcacatcactttgttgtttcctagacactggcattctcattttctgttcattctccaatttattcaatttttcttctaggagagagaaagattttccagtgtctacattttgatcacttatctcttaaaaataggaaaactacggatagactgataaagaattttgtggtttttttttttttaacatgtcaactattatatttcactgttttattacctgagagaggtggatggtttttaaaaccccaaactatgcagccagatgacccaggcttgaaccttcgatctgccacctactagtgatgtgtccttgggcagttacttaatctctcgtcaatatcttcttctggaaaatgaggattggtttccgtctcaggagtaactgtgaggattatatataaattatgttcaacacaaaatgtttgcaccaggtaatttctatataaatgtttgctattattacacatttttggggttaccaataggtattttagcttgtgttttctgccacagggatgtccagacaaagtagataactgaaagtgaaaagcacttgaggtattcttcaaataactcaaataattgtcatgaaaatataattgaaatggaaatattcatcatcttaatcttctagcaagtcaaccatcccccttttgatattttgtatattccttggccatatgaaaatatcattctctatggcctcaattgtattgtacaaatgaattcacatcatgtgtttttcatttaaaatttacatttaaatcttaagcagtttcccatgtcatgtagctgaaattaaaatgtaataaaatgattttgaatttcgtgctgctgtttaaacgttgaccttttgctactgtctattttctccttctgttacattggaaaattttctaagtagaaatcacttttactcatcacactaaattttgccccaaatattctgtaactaagaactttctgagtgcaatgagtgtgactttctttgtctcatagtgaatctagtaagcagctcaatgcctgttacatagtagactttcaataaatttctattgaataaataatttggattgaatttctgggatttgtggtattgtgtttacttggcagtaaattcagaatgtactttgttttagtacatgttgttaaatactatttttaaatgcattcgtctctttcctttcttagtaagtttatttaaaaattgccctttatttccagaggggatttgagtcagcatcaagtaaaacttacacatatagtatggccataaaaatgaaaacaagtacctcaaagtcttcctggaaaaataatagtatcaatacattccaaattaaaatcattaaactatttagaggtggaggggcactaatgagatgactgtaattaggcacacattacatattttacagaatttcttgattgtcaagtcaataaggaaaataagatagttcatattttttcatggtcagttataatctgaccaaagaaatgcatttttcttgggatattaaccttcattcattcatcaaatatttgttaaatgccagcttatgggctatgatatgatgaagcataatgaggaagcagcagggaataaaaaggacagtctctactagtatagaagcagacatatgcacatgtgatatgtacagggagggagaagtaaagagcacccactgtgctggaggattcaggcaaagtttcacggaggaacctgacattcagcttgagatgtaagacattcctaggaatcagctagataattcaaagacaatggagaagtgcattggtgtaggtatcattgttgagatgtgagagagcttggcacaatagacatgaaagaaggtcaatgtatctcaaagagaggtagaagaggtggatttgcatccatcattcccctaacctgttgaagatttttgagcaggaaagcaatatgattagatttgcatttgcaataaatcactctggctaccaaatgaaggactcattgaaaaacagtcgtggacattgggagaccagtttggatgtttttagagaattcataatgaaaaatggtggaatcttggcatgggattgtagtagtggaaatggtaaaatgtggacatatttgtgagttatggaattccctatttagagagtaggagcaacaggatttagttcttgaatggaaagtaggcagtctcagaaatgattcccagtgttctcctttgagcaacaactgggtggatgagaaaaccaaatgaaaagcagatcagggtggatgatgaaatctgtttttaatatattgagtctgaaaagcatatgagacattcaagcagacacatgaaatagacagttgaggatttgggcttagtattcagaatacagatgaattctggagacagaaattctaaagtcttcataacatagaaggtatatcaagttgtggccatggtcctggagacaatcgagagacaaaagcagagatctggtgtcaaataaagggaatcattattcagcggctattgagcaatatattgggtattgtcattagtaacaatttcacagaaagatttaagaagcattttatttttcgtaagataatattccatttgatgcagatagatagctttctggtaaactaggttgatccagagataaagattaaaaaattcccagggacatttggttaacattttacttccaatggttctcaactagagaggaaaccacctcctgatggggagtttggaaatgaatgggcacatttttataaactgtcacaatgactggaggacactgttatcatttatcgggtagggagcaaaatacattactgtcaaactcaagaagaccatagtactctgttgagagacactgataaactcttgtgccacatatgtttctctggcttgctgattgtgaagttccgagctgactgtcaagaacggtcacagaccttctctagattttcacctccacagtactctctttgtcctgaacctagaggagatgacggctctgcctctgctagttccatattatttccctgtccttcgtgactcctctgcaattacatggggccatgtacataatacctgtgtaaatcagatccttgagaagacctagttggtgtgtgctgtcatttttatttgaatcctgactcttatggctatcttttccacatatcatttgtctcaaatatagtttcctagggatctcatagttccagatttagcttcctgttaagttacaagaagctcttggatagagtggtatctttttgtttggttggtttttgtgttttgttttgttctgtttttttggatattcgtctttaaaagggtaaacttgtcatttacttttgtaatttaagcagcctggatattcttgtcttgttggtggaggggctttacctttctgcttgaaggtggtcccaatagtactaaatagaaacatagtttcctcattaagcaatttattaaaatatgtatgttcaagacattcctaaaaaatactcagttaagactccaacattctattacagaggacgtggaaaaggcattttgaacctagaaaaaatttaaggtcagatttttctcgtcaataatgccagtcataaaaaagtcagcgtagatgggcattgaatgaaagagggaataaagctttgcttttctttgatgactcaagatcagcagaaacccagagttcctattttgaacactttacaaacccaactataaatggagacagtgactgagcaactgggctgatgacaggcatgctctctgctgcagctgtaaagtctgccccaagaaagcagttcaaaatttgcatagtttgaaattgaaaaccaataacattcattaacaaaaaagaatatagacctaactccttaaaagtaactttttttttataagtttcttctttcagtctctttcttggtgaagacacacacacacacacacacacacacacacacacacacacacacacacactatttaaacatcctgaagtctttgaattaaagcaacagggcacaatttcaggagccattgctttcttctaggaaatacctcactattagagctctctttggagatgagaagatttttctcaactttattatgaattccattgtgtatgtgtgagcacgtttctgaatattttacatattataactgtatgtttgaaaatagaagatatatatatatatatatatatatatatatatatatatatatatataatttttttttcctttgcagttttacgtgccttacatcacgggagctggaaggggtagagaataggaataattttaaagcatatttatttatgttcttcatggttaaagaaaactatgccaacattcttctggcccacatattcaattaaatacatagtgaatcttttctacttactggattatttggtgcttccaagcatttatttttggcatttcatttcgtttttgtttttgcaggaatttttgaagttttattatgatttaacatttttattttgaaaatcgagcacattttaaaaattactctgctgtagctgtagtctgcccccaaaaacagatacttcaaaattcacctattttgaaaataaaaatgcaggtatagaaatttacatatacagattacttatttatctatgatttgttatgtgtatataaatctatttatacaatcatctataaatacagatatgcaaatatgttattttttgagacttaaatgtctgtagcaatcctttttttatgtggtatttttccattagtcattttctaagcctcttcaacatgtaaagctctgtgaggttaatggggggagagtggtgtcctaggatgatgaatagtgtgtctctccctgtcccccagtctggtagagaagctgtgcacaatagattagaccaaatagatttctacattttcaatcagaattagctgtggccaggagataagaacagacaaggtgcacccctgtgtgtctgccttctctcttggagcaggccctccacttccccttttgtttaagttcagataacatgttacattgtttatgtcactattcttcatgaccaattgtcacaaaacttttcctctatgttacttcttttagaagttttagtttcaggcctttctcatctttaaatcattaacccagttttagttaatgatgtcagataagggtccaatatcattcttttgtatgtgtatttctagtttccctaacatcatctattgaagaaattttctttacctatcatctattctttgccccctcatcaaaaatcaattgactgtatacacgtggatatatttccgggctctctgttctgttggtctgtatatcttgtttttcatgccagtaccatactgttttgattactgtagctttgtaatatattttgaaattaggaattgtaatgcctccggctttgttcttggcttcaagattgataaggctttttgtggtcttttgtggttccatgtgagttttagaattgttttttctatgtatgtaaaacttcattttggtatttagatagggatctcactgcatctatagataactttgggtaggatatacattctaacaatatcaagtctttcaacctatgaacacagatgtttatccgtttgtttgtgtcttgtataatttctttcaccgatgtttaatagttttcagtatataatctttctcctccttagataacttttttccaagttttttatgctactgtaagtagaattttttcctttctttccttttctgctattcgtcggcagtgcacagatatacaactgatttttgtgttcatctgtgaacactttgaaggcaagattatgccttatttgtgttctacatagtaataaataataattagcagttattaatatttttcatttattcatttttattgagtttcgttggcagtaatttttgctttctttctttcttttttttcctattctttttagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaaggtaagaaactcagtaacataaggaggagaatacaggggtgcctatcttagtctgccttccccaggaagcgaagcctaaggcaaaagtgtgtgtgttacttttatttcactgacaaatacaatcccagggaaggatgagtgaagccagagaggagagagagactacttagtatgttactaatatggccactgtttagtatcaaatggaattgcttgctcaatctcagagaatcatcttccaaagcccacagacaccatagcatctgaggacaaagtgttctgatggagaaagagaaaataatttatttttcacatccttccctatattggttaaagcttccctctgttgtgcagaaacttcctctacaccttgcatttgcttggacattaaacaggtctgtagtatctcaagcctcagcaagggtagtgatctatgggtgagacatgtggagggcaaaactgagtgaactgctgtcaggctgtggccctgtgaaggcgattataactcccgcaatgttggtaccacagcggttgctgggccagaacaagtggccaaggacccaggaaatgggtgaggccaagcaggtctaagataatgcaaatgccttggacagtttctcctttgagaaggggctgcagtataatgcagcttgtttgtgaccccttgtttattcattttactaatcctccagaaagaatcttattcttcagcctttagcactattaagcaatgtttaaaaactccttatgagtgacagttacttcttatttgatttaattgtccatatgtggaccttttaagttaacactctctgttacttcgtctgaataggtaaggtgtaatactacacatgcccactcaccacaacttggatttttcattagtactggaaccaacacgatgttgattcctcccattatgactagaggaaccaataagaataacttggaatcggtgaaaatagaggaactgagccagtttccagccacttgggttggaagagtgcccttgcttcttttcagttagaactgtgagaaatcagaaatttgagagccctcaattagctagaagttcaatggtagttttgggggatggattgggtagaagtttggactgtatttttaaaaattctttccacatttttacaagattgtccatttcaagacagatctattcacatattcaacattgtatcaaaaatttccttatagggtatttactaaactgtttttcttatatgaaagcgtctgccatattaatggtgtcctatgtgaatttcacattctataggggaatagagctcttcctgacagtggggactgtgaagagctggagaaatcctatagccttatgtgtgaccactatatgaaattggccagccatgatccctttccgatagatagattccaaattagaattttaaatgattttaaacatgactcagtttcttaagtctctctatgaaaagaaatgttattacagttttttatttctttttaaaatgaatttgtccataatagccaatctggacagccttgctctttgttaatgtcgcagtatatttgcaccagtgcctcctggcccagtcaaggggagtctattttcaaaacaaccagttcagagaaacagattattcaacttaaccacagtttttgttttcaacaattgcaacagatttacccagggaagattacagtaaaataaaattttaggtcagaacaactgctgtcaaggtttaagttcaactagacagacaatttagccctgcccaaaacagggtgactgaaaggatggctgagtgatgttcctgaaggaatgacatggtgtctgccttgttggaggattgtgttatcccacataggaaccagacatgagagaaagcaaaactatgtgtcttgatgagactcacctggtgagaggtactgagctagtcttcagatgttgttttctcactaagtcactgggcactctggccagcctctcttcagcatttggaacccatccattggtgtaggaaaaagaatcagcccccactgctagaactggatctaaagtgctgggtccagccacatccctaacatttggcctgtcctcaccaactgacacagggagatggaatgaatttttataaaccactcatcagaaaacatggaactttattttacttcttatttgagcaaggtggttattcaagatgatctattagatgattacagattttggatatcagtagatttcatgttatttttaaaatttttgatatatttgtttttcaacagtttcatgtgttttcacatcatattcggctgtgcattgaaaaaatgaaaatcaaaccatgtacttttcactctgattattaagagtggttagaggttgatatttagccatctgtcctgtctgtgctttgggaaagggggaagaggctgatgaagttatggataaattctgggcgcgttgtgagggcattggctgatgaaagggtgggttccttcacagttggcctttgagcaaaacactactgtattctactgcacctgtgcacagaggaccttattgtccttatattgactgtttggcttaattatgtgactacgggcatgagaaatgagctccgaattcttatcccagttctttccttgacattcctcttccagtttgaggaaaacctctagacctctttatgtcatgcttcaaacctcagtaaagtagaacaccatctttactaattaattaatgattgcaaaaggcttggaaatttccaaaggctgaataattgccaagtgaagactattcagctttccactcgctttcatttatttttaattttttttagtcactgatggaaaacttaccctcatgtctgaaaacaattatactttattacattgagtgcttctggggagtttggcatttaacccattaaggaaaaagtttaaaagatgaaataaataaatctcccttatatttgagatgagctgctttagttttcctatatcaggatagtataaaaagaggaatatgatatagtaaaaaagaggagagacaggatggggaaaaggagaaaggaaagaaaaaatgaaaaggaaaaaatgaagaaaggaaagaggcagaatgagaacctgcaaggcttaggggatcatgattatgtttatgttcccataatgtgctaagcagtgaatttgcatgctacagtgggccatactgtatttcctataccatctgagcagagttccttgaaaaatagtgttataaataagtctttataaggtagaaatgttctcttctcactggaaatcctcttaaagatgcagtggaatctcttctctttgctgatttataaaagctaatgtcagctacatcttgccatgtagttcacagaactcgtgtcctgtgcattttatatatctatatctatacctatatctatatctatatctatatctatatctatatctatatctatatctatatatatcgctgtgagttgggagccacgttttctccagtatttagataaggtggctcagcttgaaagttccagtgctaggacctggaagctagtcacaactctcaagtctaaagtgaccaggcaactttagcctccaattatcataaaaactcatctccgtcagcctcagctattaaagggacaggtatttgctacataatgtgtagaagtgctggggctgtgcattccagggaagttggagaatcttgtcccaattagtgtagaggttatgttaaattctgaaaccatctactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattaattttatttatttatttatttatttatttatttatttattttttgagagggagtcccattctgtcacccaggctggggtgcaatgacgtgatctcggctcactgcaacctccacctcccgggttcaagtgattctcctgcctcagcctaccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggattacaggtgtgatcccaccatgcccagcctgttttaatttttgaaaagagaaagttatatacattgattgcactctaaagaattgttggcatttggagagagttatccgtatggtaatccctgtgttaattatgtctcaattctaggatcagagaaacaaaatggaagagatgattagggtgggcagaggaatgaatgcagatagatccctcaagtcagtagctaacactagaatacatgtgaagatgagaatggtagatattgcttgaggccagtgactgtaatattagtaattcctctttgtacagactttttagtttccaaagcactttgtggagctcacaaaatccatgatcattaagcccaagtagaggtctttgtctttctttttctgatgagggttcaaaagcccagtgatgagagccactcacttaacgtcatatgtcaaattcatcggacagccacagctccaagtcaggtcttctaaagattgttcccatgctttgaccgtggcaagtgactgaatgttggcatgctttggatggcaggagctcctcatcagcgccagtgtacatggctccactgtgacccatgttacctgcagagattaaagtgggcttaggcagtcaccatggcctttggataaaatcagcggttggaggggaagcacccattaaatccctgcctggcacccaggcctggtgccttagagctatacttccccatccccatcagtcacataaaatttgtcccgaggttctttctaccttcactaagtacttaatatggagttcagtcatccccatttctcacttgaaccattgaaatggcctcttacttagggtttcctctggcagtcatctctgtacccatacatcctacatgtaataccagattaatctttctatggtaccttatcattaattgccttttgcaaaaaccttaataagttcccaaccagttgcagaatacattgaaatcccaaactggatttctagttttatctctccccagtatcctggattccagctgatatgttacatttttagttaattctcacctctatggctttgctcaccaagttccttcttcccagtccttccccaaataaaatctacacatctaaaagtgacccattaagatccagctacagtgttaatttctcccataaggttttctcctcttcctaaaagctagttgtgtgttatttcaccctctcttttagatgttttcactcttttactgtactggagtcatttgtgttcctgtcttctatcaacctatatccaagcatatattagactaagttttaggagaatatcctatgtttctagaaacatatgtatgtagtaactatatgcttagttatttagcagaggtttattgaacattgtgttcactttgaagaattttggtagacactctgtagggccctattagtgtttaagacattgtacagctcaggtgcattttcctttaaggatgcatttaacctgctagatgtcatctcatttttaagaccagagaaaaagagagcagcatctgttgtttcttgactttttaataatagccattctgactggtgtgagagatggtatctcattgttgttttgatttgcattcctctaatgatcagtgatgttgaactttttttcatatgtttgttgaccgcataaatgtcttattttgggaggtggctgctcataccctttgtccactttttgatgaggttgtttgtttttctcttgtaaatttgtttaagttccttgtatattctcgatattagacctgtgtcagatgggtagattgcaaaaattttctcccattctgtaggttgcctattcactctgatgatagtttcttttgcaaaagctctttagtttagttacatcccatttgtcaattttggcttttgttgcaattgcttttggcgttttcatcatgaagccgttgcccatgcctgtgtcctgaatggtactgcctaggttttctcctagggtttttatgcttgcttttgggttttacatttaagtatttaatccatcttgagttaatttttgtataaggtgtaaggaagtagtccagttttagttttctgcatacagctagccagtttttctagcaccatttattgagtaggaaatcctttccccattgcttgtttttgtcaggtttgtcgaagatcagatggttgtagatgtgtggtgtaatttctgaggtctctgttctgtttcattggtctatatgtctgtttcaataccagtaccatgttgttttggttactgtagccttgtagtatagtttgaagtcaggtagcatgatgcctccagctttgttctttttgcttgggattgccttgtctgtacaggctctttttcatttctatgggttttttttcatttccgtatacgttttagcatcagtttgttgttgtccacaaaataggctgctatgatttggagattaccttgaatctttagatcaatttgaaaagagccgatacgttaacaatactgggtttttcaatccatgaagatggcctatctcttaatttatgtatgtcttctctaatttctctcatctacatatcatagttttgcatatattttggtaaacttgtccttaagcacttcaaatattggatgctattgtaaatggtattttaaaatttgtttataatcatttgttattagcatatagaaatagcaatagatttttatatactccctttgtatcctataacttgttaaatgtaatagttgtactagcttctttaataagacttcttaggcaattctacctgatcattttatctgaaaattgttgatgcaattgtttatttcctttatggataagcctattcatcaacattttatgtttgaaagatttgcttgctgattgaaaaagaaacagcgtgatacaactttaaaggaaataagttggaaaaaataagaacctttcctctccacttccataggctagcctacgtaaaccatcagacatagaagcgattttcagaatcataagtcttaaccccttacatttacagatgagaaaactgaggcctgaagagttacagtgactttcagagttatgtggttagtaaatgacctcatgtgaatgcaaaatgtaactcttctattctgcagttcttctctatattggttaaggatagttcaagacagaggaggtcagaagtaagtgacctttaaaaggtgtaataataactattgtcaggatgatcttatttcctatctttagaaccccatcatcagttttgtaaggccactgaataatagaaaatggttccgattctggtgctccctattctgtctcacagctgctcctgtgaaaacactcgttcatgggctctgtgtaattttgactcagtccataatctctctatcctgattttaaaagttatcatcagaatggatgtgctggtatactaagaaatgtctgtgaatattatttatttattttacttatctaatcattttcatagatttggttgtttaaaaataccccaggtctcaaatccctttggaaagttcagcaaatcattttaacaggtaattctggcaatatgtaattctttgtgtttacagagtgagagaaattctatttatcagtgttttttctttgttttgttttacttcagttctaagcaaagcagttattttgcttattgacatattgatatattcctttgggaatctcatttctttcttggccagctacaaacactcatactgtccaatttcaacaagagactatggttattctcttcttcaccaaacaaagaaatttgaaccattattgataaataatttctggtgaatattaaagctttgaaatgttttgcacacacagtgttaggaagtgtcttagagtgaaagacactatttttactactatagtatcaaaagtgccattgtcccacatacaaagatttacttgttaccttagttctttgatttttctggagtacagcaaccccaacttttagaagtactcttaacaaatgatacagtgtttgatctgtttcatctttggacttcagagaatgatcttcaaataatacagtttggtttatttcagaaggttgcttccttaaaacaaaattttgaaaatatgagataataacatttaacttctttttcaatcacttataaaatttacgaaacactctcatataagaaaaactctgtaagttgttcagaggcaacttctttagtatcctaccaatactgaatacctaagggagggtaagaactgacgtcgcctcactgccagcccagtgttctttccactctgtgaaacttgcctccatttgtagctgtctgtgtttgtatatattagctctattttgtgtagagttgtccaaacataaaatattcctttggcgcagagtttagagactaaaacttctgagtagtatttccgggacataacatatatttaacattatttgaaacccaagattcagtcaacattgctattaagagttaaggagctgaaactgtgcataccctaagtctgaattcaaggtaagaggtcccttgttattcagtctttataagtgtttggtatatttatgcctcctcaaatatgacaccatctttttttaaattcacatttaaagatgattgtaaaacaagaaggataaggtgtaagtgtggtagttgttttatttatggatttatcagttagctgttacttattttttgtggttcataatgcaattttaacataagtctgaataagtttactatagatgatattagtaggttttaccagaggaaaccatgcttttttattttatttttttctttttctttgagacagagtgtcactcttgtcgcccaggctggagtgcagtggtgcaatctgggctcactgcaacctctgcctcccgggttcaagtgattctcctgcctcagcctcccaagtagctgggattacaggcatctgccaccaggcccagctaatttttgtatttttggtagagacggggttttaccatgttggctaggttggtctcaaactcctgacctcaggtgatccactcaccttggcctcccaaagtgttgggattacaggtgtgagccaccacgcctggacagaaaccatgctttataatcctgctacccaccccatccaaagcacacaaaatattagttaagtaagctactagaagacaactgaggctggtggtctctgcaggggcagaaaaatgggaactggagaggagttcaggaaggcagcccagagaatatgaagcaggacccagcacacaacagcctgtgggccacatgtcacttgccacctgattttgtaaataatgtttgcttgaaatacagccatactcgcttcattccatattatcaatggctgctctcacactataacagcagagctgagaagatgcaacagagaccgtatggcctacagatattaaaacattttctgtatatcattttacagaaaaacattgttgactgctggtcaaaaatatgggaagaacgtcatgaaatttagattcttattaaaagttcttgaacatccctgaactatttaatattatttcttgtccagcagatcctgaatcttaaattagaagttgtgacagtaagtggaaattttcagggaaggaagaacagaatatcaaaatcaaaaattaacatgctatgtgcagagtaggttctatatccctcctttttttcccaccctggtaaactcttatttaaacttcaagatctgtctctaatattaacttcttggagaagtttgaccattcttccagttcccacatattattagcttatctttcctctgattttttctcatagcattttttcattcatttactaaaatatgcactaaaatatgcacctcattcagtatttttatataataacattttaagataatttgcatacagtataattcgcccatttaaattaaatggcgattaaattaatttaatttaacacaattaaattatttttagtatattcacagtatattttactgtattcttaaatatagtatatgtgcaatcattatcacaatcaatttctttacaccaggaagaaatcctctaccaatgagcagtgacttttctttttccccaaaccctctaagtctaggtaaccatgaatttaatatctgtatctacagatttaacaattttggacatttggaataatactatatatagtcttttgttactggattcttagtataatattttcaatttccattcatgttgtagcatatgtgattgctgtattcctttttattgctgaataatattccattgtatgaatacatcacattatatttatattttcatcaattgatgaacatttgaggtttttctatcttttggctattataaataatgcttctatcaatatttgagtagacatatgttttcagttttcttgggtatacacctaaaagtgggattgctgagtcacatggtaatttaatgttcaacattttgaggaactgctgaaatgctttccaatggggctaccccattttccattcccaccagcagggtatgaggatctcattttctctgcaacctcccaccgcatttgattttattcatattatgtgtctatctctcaaatacaaatccatgttcttcaagagtggaaaccatgtctgtttcagttttgtttctgtatgcctaatatagtacattgcatgtatcaggcactcatgaataaatgaaagagtcaaccaacaagtgaaataacacctactgaattgacatggaaccacatagagttcctattatcaagagttgttgggttgatgggtgcagaaaaccaccatggcatgtgtatacctgtgttaagaaacctgcacattctgcacgtgtaccccagaacttaaattttttgaaaaaagcaattttattccaaaaaaaaaaagagtcgtttatgtgggcttaaatagctgtgcttttataaatgttcttttttttaatttcagcttttattttagatacaggggatacgtgtgtgggattactacatgggtaattggacccaggtggtaagcatagtatccaataggtaatttttcagactgtgccctctcccttcctccccgtctggtagtctgtggtgtctgttattctcaagtttatgtccatgtgtgctcagtgtttagctcccactcataagtgagaatatgtggtatttggctttctgtccctgcatcaatttgcttaggattatggcctctagctccatctatgttgctgcaaaggacatgatttcatgattttttttgactgcacagtatttcatagtttatatgtaccacatttttttaaatctagtctaccatttccagctatgttcttcatctttctaccattcacatcctagtgcgtgtaaccgataaattagtattcatttagatggactccattttattttattttattttattttgagatggggtctcattctgtcgcccaggctggattgcagtggtgcagtcttggcttactataacctccgcctctgggttcaagtgattctcctgcctcagcctcctgagtagctgggattacaggcatgcaccaccacgcccagctactttttgtatgtttagtagagatggggtttcgcattgttagccaggctggtctcaaactcctgacctcaggtgatccacccactctggccacccgaagtgctgggattacaggctgggattacaccactattttttaatggcattttagcagttaaaaactgaatgctctaaaagtcagggatggcatgggcacaggtgaaagatgaaagttttgtctatttctatttctatgatgaaatcagttgggttaacaagagcattcttctaagcagctagagattctgttggtctcatccagccatcacccagatggcaatacaaccagtaaaaggcagataatggtatctgtttttgcagactttatgttcacaccagtgtcactcatcttaacctggactcttgtcatcagcttgatatttcctcactttcctctttctccccttttcaagttatagctgtgccttgacatgacttacccaatactctgtattctcttcgtgttcattaataggctcattttccagaactaacattggggcatttcaaggactttttacgtagcacatgagctgcttacaacgtaattctgtctagttgggacatatgtcatttagccagattgtttatggcattaccacagccaagcatatattagtttcatagtaatttctagggaaaaaaatgtggaggaaatatgtggtttttgttatacttgcaatgttactatattactgcttttttttaagttttgatttcaataaatacctagcatatattttcagatgccaaaggacatacaatgatgaacaaaaactcagctcgtcctcaaaatcgatatgtattattggtgatgctggactccacccactcatagatgtttctcattattgtgaaacattactttttggaaaaagagagctgggccaggcacagtggctcacacctgtaatcccagcactttgggagaccgaggcaggcagatcatgaggtcaggagttcgataccagcctgaccaacatggtgaaaccctgtctctactaaaaatacaaaaattagccaggcgtggtggcgcatgcctgtaattccagctactcaggaggctgaggcaggggaatcgctcgaacctgagaggtggaggctgcagtaagcccagatcacaccactgcactccagcctgggtgacagagagagactccatcttaaaaaaaaaaaaaaaaaaaagagagagctaacatcttcactttttaaggaaatagacattgcccccatgattgtatggatgactagatcatttaaaacaaaaattacataagggcttaaagagtggctcttaagtgtaaatgctaggaagcacccaattagttattatttcctgtatgtgttgccttcatggacattggttcatatagcctcaaaaagtctatgaagatactttttttttttttttttgaaagagagcgtcactctatctcccaggctagggtgcagtggcacaatctcagctcacttcaacctccgcctcccaggttcaggtgattctcccgcctcagcctccagagtaggtgggattacaagcatgcgccaccataatcagctaatttttgtatttttaatagagacagggtttcactatgttggccaggcaggtctcgaactcctaacctcaagtggcccacccgccttggccccccaaagtcctgggattacaggcatgagccaccgtgcccggctgaagatactataaacatcttgattttttactgagtcagaaactgagaaagggaaaaaattatttgctgaagactgcatgcctcaagtttatacccattatactacactgcctgcttgcgaaagtatgttttaaaaaattgtcactgctgtgcagcaactcaaattgtcactgctgtgcagcaactcaactttaagtcttaaacctagttatcttttatcttgagcaggacatatatgttaagctgctgaggatgctccttaacatgaggccattgggcgggtgtgtgccagacaatcctcctagttgtttctctaatacagagcttcaggtcgtctcttcctttttcatcttctagcctgccctggccaagtacctatgaatcaaccggcaaggcgaggggtgtatttggtgggctatagagtggaattaagcagaatatcaaaaattttagccaataacattgaacctcaaagaggaaagtactgctgagttctgatagatgcaagacaagctaaagacctccttagctccattgttctgcatcagcacaatatgtcctagtgagaaggaaagacatagcaaaactaaaaatgacctgtttttcaagagcaatgtcttttcacccaaacttgtgaactgcttgccaaaagtcaggactaacattgttttgtacatttgcattaaaagaaattatatcaccgttgaagagctgatcagagaaagggtataggaaaaaggaaatgttaaaataagctgtaaaatccagcccatttatatctggagtttagaggcagtctaacaaaatgaatgttccatttactaatcacatttgccatttattcaaaacaaacacggcttgagagaggattaaataaacatccaaaaactgtcgttcttgaaacctttggatagaacattgagttgcattcctgcaggagaaatgccaagtgagtgagcctagtccaagtttgtttagaaagccatatttgggagaaccatggaagtgcgaacctgatcatgtgaaaagcccaggactgttcagccttctgtggcagttctgtgagttctagtaccagactattaatagggagtcaagtagaaatatccttccttcccctccctccctccttcccttcccttccttccttttccctttccctttccctttccctttccctttcccttcccttcccttctccttctccttctccttccttccttttccttccttccttccttccttccttccttctctctctttctctcttctttggtgtgctgagaataatctgcagacagtgactctacagataagattgcaaatattttcccttccttcattccttccttctttcctcccttccttccttctttccttcttccttttttttcttttttaaccacatgatttctatttcctttagcaagatgttatcatgtgagggaagtcttaggtttctatatccctttattcttagtgttagcatttcttattaaagacagatgtctagttttctattttaagggttatctaatttcagtcataaaaatgtcctataaattaagacataactttgtcaatactcttctagaacataatagctaccccaaaatatttgttcaatgatgggaaattcattgatatttagaccttcagagatgaaataaatatgttgcctttgcttttcaaagatgccatcttgcccattcataagaaaactaagacccacagaatgactacccaaggcctcacagtataattaggactttaacaaaaatccataaaacctctggtattgggatatttaagataatacattgatatatactttatcactgtctttgataaaataacagtaaaaccattttaatgggacacatttttataaccattgtgaatttggtcctcaaaaaagaactcactgagatgatgagataatgcatattcatcctcttttacagatgatgaaacatttcggagaaggcaagtcagttttccaatttttcatactatatagatcattgaatctttgtcccttatatacagaatcaacaatatgaaatatgtggaacttgaaatcatagtttccaacttttctgcctatagaatgcccatttccagttgcttaacatttagattgataaacatgaaattcattaaacaggaaactgaataagagacctggactaatatttaggtattacttagtattccatccaagaagtgtctgcagacagtgactccatagatgataaggttgcacatatttcagaagccaaataaatgttgtgattaaatgattcaagtctgttaaccatttggtagttatgatgtaaatggctgttaaatggaaagcatttgtaaaaatgtatgtgcaaaaataaaggatttctaacaaaccgaatgggccttacctattttagttaatactctcaataatgagcagtgagattaatttataagtatgtgtgtgtgtgtgttaagatatattcacattttatgaaacctgaagctttgaagcttatcactgtggaaataacttctgtatgcataaaagtattatattatttcggtaggactgctataacaaaatacagtcaggccttcatattcaagtaggctgcattcagaattcaaccaactgccaatggaaagtgtttgtaaaaaataacaagtaacaataaaatattagaaaatactacaaatttcaaaatacaatataacaagtatttacctagcatttacattgtattgggtattttaactaatctagagatgatttaaactatgtaagaggatatgtgtaggttacgtgtatagcatatcatatatataagggatttgagcatccatagagtttggcatctgcatggagtcctagaactgatcccctgcagatatgaagggacaactgtaccacaaactgagtgacataaactacagatttttttttcctcacaattctagaggctagaagtctgagatcaaggtactcacaaggttgctttcctctaagagctttctccttggataaaaatggccaccttctctctgtgtcctcacatggtctttcctctgcttctctgtgtcctagtccctctttttataaggacaactccagtcgtattggattaaggtccaccctagtgctctcattttaacttaatggcctctttaaaggccctttctccaaatacagtcacaatctgatatactaggggttaggacttcaacatattaatttgaagggagacatgactcagctcataacaattatgtaggcaaatgaacatttattttaaatgacagaggaaatgcaacatgttataaattaataaaagctatgaaatacctcaaaaatcacattaataaaagctatgaaatacctcaaaaatcacaaaaatcttgaaaaataacactcttatgaattaaattcctgattactttttcttacatttttagcagcatattcattgattaactaactgtacaacctaatttcataatattttctgcagagagaatacaaagataatttcatgctgagagtttattactaccagtcctgccttacaacaggtccttaagggaatgataagcatgaaagactgttacctacttctacaaggacacctttaagtacatagcctgctaacactataaagcaactatactatcaagtctacataagaaccaggtaacaacatgatggcaagatcaaatgcttatatatcagtattaatcttgaatttatgtgggctaaatgccccacttaaaggacaccgagtgtcaaattggatgaaggagcaaggcccaactctatgctgttttccagagtcccatctcacatgcagtgacacctttaggctcagaataaagggatggagaaagctctatcaagcaaatggaaaacaaaataaagcagaggttgctattctatttcagaaaaaacagactgtaaaccaacaatgattcaaaaggacaaaaaaagggcattacataatgataaagggttcaattcaacaagaagacttaacagttctaagtatgtatgcacccaataagggagcacccagatttataaaacaggttattagagaactacaatagtgggagacttgaacactccactgacatttctagagagatcactaaagcagaaaaccaacaaagatatttgggacccaacacttgaccaaatggacctatgagacatctacagaatatttcacccaacaacaacagaataaacattcttctcatctgcacatgacacatactctaagattgactacacacccattcataaagcaattctcaaagaattcaaaataactgacatcataccaaccacattctcagaccacagtgcaataaaaatataaatcaatactaagatctctcaaaaccatgcaattacatggaaattaaacaacttgttcctgaatgacttttgagtaaagaatgaaattaaggcagaaataaaaaaaatcctttgaaactaatgaaaacagatacaacataccagagaacacagctaaagcagtattaagaaaaatgtttgtagagacaaacacctacatctgtaagttagaaaaatctcaacaacctaacatcacacctagaggaactagaaaaacaagaccaaactaattccaaagttgatagaagaaaataaatagttaaaatcagagctgaactgaacaaaattctgatatgaaaaccatacaaaagatcactaaaaccaaaagctgtttttttttgcaagaataaataagattgtcagactactagctagattaataaagaacaaacaaagagaaccaaataaacacactctgaaatgacaaagggtacattaccaccaaccccacagcaatacaaaaaaccctcagcgactcttatgaacagcactgcagacatacattagaaaacctagaagaaatgaataaattcctggaaacataaaacctcacaagattgaagcaggaagacattaaaatcctgaatagaccaataatgagttccaaaattgaatcagttataaaaaacctaccaaccagtaaaagttctggatagaccagatggattcccagctgaattctaccagatgtaataagacttgctggtaccaatcgtactaaatagcttccaaaaatcgaggaggagggactcctccctcaatcattctataacgccagcatcattctgataccaaaacctgacagagatagaacaaccaaaagtgaaaacttcaggccaatatccttgatgaacatagacacaaaaatcttcaacaaaatactagcaaattgaatccagcagcacatcaaagagctaattcaacccaatcaaataggctttagccataggttgcaaaattggttcaccatacacaaatcaatgaatgtgattcatcacataaaagaactaaagacaaaaaaccacatggtcatctcaacagatgcaaaaaagggttttggtaaaattcaacatcgcttcatgttaaaaaccctcaacaacttgaaattgaaggaacatacttcaaaataataagaaccatctatgtcaaaccctcagcctgcatcatactgaacaggaaaagctggaagcactccccttgagaactggaacaagacaaggatgcccacttccaccactcctattcaacatagtactggaaattctagagctccaaatagaaagagagaaagtcaaactatttctgtttgcagatgatgtcattgtatacctagaaaaccccatagactctgcctaaaagctccttgatctgataaacaacttcagcaaagttctagacagaaaatcagtgcacaaaaatcagttgcctttctatataccaataatgtccaaactgagacccaaatcaggaacacaatcccattcacagtagccacagaaagaataagatacctaggaatacagctaaccagggaggtgaaagatctctataatgagaattataaaacacagctgaaataaatcagagatgaaacaaatatatggaaaatcatttcatgttcatagataggaaaaaaatcaatattgttaaaatttggggcagtcatactggccgaagcaatttatagattcagtgatattcctgtcaaactaccaatattatctttcacagaattagaaaaaaaaaatattgtaaaattcatatggaaccacaaagagcccaaataggcaaaacaatgctaagcagaaaggacaaagccagagtcatcacagtacctgacttcaaattaaactgcaagactgcagtaactaaaacttcatggtactgggacaaaaacagacacataaaccaatgaaagaagctagagaaacctagtaatcatgctgcacacctacaaccattgatagtcaacatttgtcaactcaagatggattaaaagacttaaacgtaagacctaaatctataaaaatcttagaagaaaacctaggaaattatattctagaaatactattctaggccttggcaaaaatttcatatgaggtctccgaaagcaattgcaacaaaaacaaaaattgacaagtgagacctaattaaagagcttctgcagcacagcaaaacaaactatcaacagagtaaacagacagcctatagaaagagagaaaatatttgcaaactatgcatctgacagaagtctgatattgagaatctatatggaactcaaacaaatcagcaagcaaaaagcatccccatttaaaaatgggcaaaggacatgaacagacatttctaaaagatgtgcaattaaccaacaagcatatgaaaaaatgctcaacatcagtaatcattagacaaatgcaaatcaaaaacacaatgagattccttctgacaccactcagaatggctattattaaaaagtcaaaattaatagatgttggcaaggttgtggtgaaaagggaatgcttgtgcactcctgttgggaatgtaaattagttcagtctcactgtggaaagcagttcagggatttctcaaagaatgtaaactagaactaccatttgacctagcaatcccattactgggtatatacctaaaggaatataaattgttctattaagttggtgcaaaagtaattgtggtttctgccattaaaagtaatggcagaaacctaatgaaaagacaaatgcacttgtatgttcattgcagcactattcaaaatagcaaagacctgggatcaacctaaatgcccatcaataatagactgggtaaagaaaatatggtatgtatgcaccatggaatactgtgcagccatgaaaagagcgagatcatgtcctttgcagggacatggatggagctggaggccattattcttagcaaactaacatgaacggaaaaccaaataccacatgttttcacttgtaagtgggagctaaacactgaatacacatggtcaccaagaggggaacaatagacactaggacatacttggtgtagaggctaggagaagggtgagggtcgaaaaactatctattgggtactgtgatcactacctgggtgatgaaatagtttgtacaccaaacccctgggacacacaacttactgatgtaacaaacctgcacatgtatcccctgaaacaaaaataaaagttgaaaaagaaagaaaataatgtttatacttagaaaaaaaattatctttcttctagcctgagtgataaacattttttattattatagtttttaaaagtttggaaaactgcctttaatctgcacaacttttattagtattgttgtttgaaatttaagataatcaaatttggggacactcctattaagtttcttttatttgtgagctattacaacacccttactcttactgcagattcatagctgatgagttctattttgtgcaattagcatcaaaaagaaaaatcaagtcagccgtgcatttataattgtgttcagtgcattactaagcacattcctaaagagaaagtatctccatttgcatcatcgaaaaccaagtagtactccacatgtatacttttacacatctgactattggttgaatttccagcagactcaatttctgtctctatgcattttactcctgtttgtctcctctactagtctaatttccatgctgggtgttataggacacattaatgacacgtgacttctggtcccacaaatctgtgtcacagagctaggacagtaatgggcccaggcacattgaagcattccaggaactcattcctatacaatgacgatgggtgatgacttaagcacacaccatagtgactgcagaccatgtaaatatatcccatgacactcagctaaatgtctccctgactcaacctttcttaaccaatctcaaaggtcacatgttgattctaacatttccctacatgagcgtacacagaagacagagtagaagaaccatagtgaacatacagcttggtcccctcccaagaccttagtaggggccagtgtacatgagggcccctgaagcttcatttccttcctcgtcaaagcatgtttatttaaaagtatttattttactctggatacttcctcagaaatagttattcctttccttttttccctccctctctccttacctctgtcttttcctcaaacatttatttagtgtatactatattctagaccccatgttgaagaataagatacatatgctgatgtctacagcactgcatagaaagtaatgggtaacctaagtggttacaaataaaatctactagctatcctggtgatttaaaggccaccttcagctgaatgttcaggaaaacctttatgaggaagtagcatttgatctaacctataggaccggtaggatagggcctgggtggggagactgggagatggaaaggcattccagtgtgctggtgctgcacatggtgggacttctatcacatgtattctctatctgtaacagttaaagttttttggttacttggcctgggtaatggcaaagcaaatgtactaaaagaaactctggttttgtggccacctcagttcctttggagaatgtcctctctcagctgaagctgagaacatccagtcacatttctgttctggaaccccttaagctgtttctgtgacaacatctgaaagaattaagctttatccaagtcaccagaaaagggcttacgttaactgttttcactaagactctacgtttcaatactaacacttacggacaagtggaaggtattcttcagttgtatttggtagttcttctgtagcgccccttttgtcttcctccatttctctcttgctagccctcaactctaccccacgttcgttttcattatcttttttctcatcccccatttcctgcttatttgtttattctggtggctcttctctctctcatagacgacatagaagcatggccttctttctgaactttccttgacccagagggagaaaagtctaacatactatcttatttatgcaatctgaggaaagttgttggccagccatcacccagtgtgacctagtgacagaaccagtagggatatctgagtgttcagtctttgaatgattcttccaagtcatatagatgtgttgattacttcaatcttgaacaagatatgttgtcactatcatactgggctatgagtacttgagaacagggaactgtgtagtaaaattcaccacatatgctggtagcacacaggcatcaaccagtctaaacagaacccacccgggtcacctcccacgtcactgctaagacacagttctttacacagaccatgtaaatgctgttgtgttgttttgtcaaagcttctatcactcttcttgctgtaatttgagaagcaaaagcattaataaccagttacttacataactggtattgtaaggcttactggtggcagacagcattcctgtgagcagtattagcacacctctcgatgagaatggctgtgaactacattctttggagtaacaataagaaagactatacaaaacctggtcctctgtctacagtgaatgaacacgctcatcttttcttcccacagtgatttttttccagataacatattctaatggcatgagtatattaaaataaagtcagatagggtgaggaggggcatgctaacaaaaataatctgtcactcttgccaaatggaggtaatacagtcacaatatttacaagtaaaatggcagggatgtaattgaaagtacatctatatatcatctatatatcattcatatcattcttcaagctgttatcacagttccatctttgactgatgcctcttcaatatgttgtataatgtactatagagttattcctttttactcttttgctcatggaaataatttgaaggcttttaaccttctgatctcatttttcactttgttccagacatggcttactctctctgccatggaactatcagataaaatgcataatttgattagaccaaaactgtactaccatcagtctgtcggtcaacacaagatatattttaaggggatctacacaaaagtctgcatgaaaatattccatataaagaatagttacataaaccttaataaaaagaaaatactgggaagcacttagtgtctcagattctggaatcaaagctctctttcttttcgtttcttttctcagcgattcaaatgaccactctgatattttctttgccaaattaactttagcattggaggggcgtttatatagtatctggcttaaagctattatttttctcatttgctctgcagacatttattgatcacttactgtgtgccaggccctgtgataggaatggaggtagagaagacacaatcccttgccctcaaaggtttcagtgacagaagaaatagatgaagagaatgaggcctgaagtcatttgctcatggtcctacaggcacagagcaggggtgcccaacccccgggccatggacctctaccagtccgtgacctgttggaaccaggctgcacagcaggtggtcagtggcgggcaagtgggcgaagcttcatctgtatttacagccactccccattactcacattactgcctgaacttcacctcctgtcagattgcagcggtattggattctcataggagcgtgaaccctattgtgaactgcacatgcgagggatatattttgcgtgctccttatgagaatctaatgcctgatgatctgtcactgtctcccatcatccccagatgggaccatctagttttgggaaaacaagctcagggctcccactgattccactgatggtgagttgtataattacttcattatatattacaatgtaatagtaatagaaatagcatgaacaataaatgtaaagtacttgaatcaacctgaaactatccccatgccccaatccatggaaaaattggagaccacagaactggtccctgatgccaaaaaggttggggaccactggcatcgaggatagaatagggaccagaaagagattgtgcagccgtccttctagatctggttcttgtcaaccactccatctccctaatgtgggacatggcagaagagttacaactagagtaaaataattcttgttgtgagttgcaaactttatgggctccatgtttaaattatattattaaaatatgtattttgtgtttgatattaatctcatagacatttaggagaacgattagatttctgatgcctctaggcattcagaagtctctaactcacatgctgcattgtctgaaaggttctattttgtgatagtgcttcttgggcatcagtggggacagcttagaaagcttgtcgttgcatctaaataaatactgagagtttggatatgtttctaagttcctttcctttgaactgtggggcataaatctcacgagacagcttgttctcaagaggttaccagtacgtttggttctagtctgtccacaaatattgtgagaacaggcttattcagattattttgacatgctcagacaaggcgttccgaaccatgtgagaaatgaacgtgtgtgtgcaagggaaatacacacaatgctactgagcctctaagaggctccatttctcgtgttttgaggagtggaaattgtctcaaaaaatcagcatctcagctctcattcctaatgtatcagaatctagaagttctggttttggaatctgatatagtgagaaatcagaagatgtcctggggtgtgggagaatgatatgttctttagtcgagtttaaatgagtttattccttaacttagcacttccccagtggcacaataagcactcagtaaatgtttattgaagtgaattccaattcctgatttgaatttagtgttggagaaattccagtcaccgggctgataaaaagtggtgtcagattactggaaaaaggactatgtggagaagctgcttgcaagtaataaactctttgtgttagagtcacctgttttacccaatgcctagcctagatcgttgaaaaggaaattgaaggatggtattcagattaagaaacagatccctggattatgtttaagaatttctgggaggagccaagatggccgaataggaacagctccggtctacagctcccagcctgagcgacgcagaaggcgggtgatttctgcatttccatctgaggtaccgggttcatctcactaggcagtgccagacagtgggcgcaggtcagtgggtgcgcgcaccgtgtgcgagccgaagcagggcgaggcattgcctcactcgggaagcgcaaggggtcagggagttccctttcctaaccaaagaaaggggtgacagacggcacctggaaaatcgggtcactcccacccgaatactgcgcttttccgacgggcttaaaaaacggtgcaccacgagattatatcccgcaccttgctcggagggtcctaccccatggagtctcgctgattcctagcacagcagtctgagatcaaactgcaaggctgcagcaagactgggggaggggcgcccaccattgcccagacttgcttaggtaaacaaagcagccaggaagctcgaactggggggagcccaccacagctcaaggaagcctgcctgcctctgtaggctccagctctgggggcccagggcacagacaaacaaaaagacagcagtaacctctgcagacttaaatgtccctgtctgacagctttgaagagagcagtggttctcccagcacgcagctggagatctgagaatgggcagactgcctcctcaagtgggtccctgacccctgacccccgagcagcctaactgggaggcacccccctgcaggggcacgctgacacctcacacggcagggtattccaacagacctgcagctgagggtcctgtctgttagaaggaaaactaacaaacagaaaggacatccacaccaaaaacccatctgtacatcaccatcatcaaagaccaaaagaccaacattagacagatcaacgagacagaaagtcaacaaggatacccaggaattgaactcagctctgcaccaagtggacctaatagacatctgcagaactctccacccgaaatcaacagaatatacatttttttcagcaccacaccacacctattccaaaattgaccacatacttggaagtaaagttctcttcagcaaacgtaaaagaacagaaattataacaaactatctctcagaccacagtgcaatcaaactagaactcaggattaagaatctcactcaaaaccactcaactacatggaaactgaccaacctgctcctgaatgactactgggtatataacgaaatgaaggcagaaataaagatgttctttgaaaccaatgagaacaaaggcacaacataccagagtctctgggacgcattcaaaacagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagatacataaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccaatcccacagaaatacaaactaccatcagagaaacctacaaacacctctacgcaaataaactagaaaatctagaagaaatggataaattccttgatacgtacatgctcccaagactaaaccaggaagaagttgaatctctgaatagaccaataacaggatctgaaattgtggcaataatcaatagcttaccaaccaaaaagagtccaggaccagatggattcacagccgaattctaccaaaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaacgaatccagcagcacatcaaaaaacttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacagcccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcagttaggcaggagaaggaaataaagggtattcaattaggaaaagaggaagtcaaattgtccctgtttgcagatgacatgattgtatatctagaaaaccccattgcctcagcccaaaatctccttcagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatggataagaagaatcaatattgtgaaaatggccatactgcccaaggtaatttatagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacggtaaccaaaacagcatggtactggtaccaaaacagtgatatagatcaatggaacagaacagagtcctcagaaataacgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcacgggcaaggacttcatgtctaaaacaccaaaagcaatggcaacaaaggacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaaacacatgaaaaaatgctcatcattactggccatcagagaaatgcaaatcaaaactacaatgagataccatctcacaccagttggaatggcaatcattaaaaagtcaggaaactacaggtgctggagaggatgtggagaaataggaacacttttacactgttggtgggactgtaaactagttcaaccattgtggaagtcagtgtggcaatacctcagggatctagaactagaaataccatttgacccagccatcccattactgggtatatacccaaaggactacaaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaagctatcgcaagaacaaaaaaccaaacaccacatattctcacttataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacgtatgtaagtaacctgcacaatgtgcacatgtaccctaaaacttaaagtataataataataataataataataaaagtttgggacgaaaaaaaaaaaagaaacagatccctcatggtatcccataaaagttaccttaatttatgaaaatccaacctgtgcaatatgggtatcttttttacaatagaagtgatttatatgggctactcttcccatagcaagagtctcattgccttaccatatagctcttttggaattttttttttttaaacttgaatatatcagaatgatagtaactggccactggagaaaaagctctgacctcaagccaaagagcaatctgtctacatgtctataccatggcagtgattattgataacacaactgattattgtaatcacaacttcccatacagaaattactatttgtattattctccaaaaaataaggccaaatgccataatgtgttttttcagaaacagtagaacatactcttagaatgatgtgagtgcacactcactctcattctagtttattctaaacgagaatctgagatgaatgttccaaatctctccaatcacaagggaggagggtacatttgcagtggatttttctcagaaggttaaatctaaagaagtaattaaggctccacatttctgatttgcaggaaactgcgttatgcatttcccttggatgaaaataagtaaagaggataaaggaagactctcaaattgcagtctgtgtgacctgtttttgaataaacataatcatattccacagtcaattatctccaaagtacagtgtgttctccagccagagcgagagagtgagaggaagaatgtcagttagaagtggttagagaagaggacacatgcatagaagtgtacatctttctattgtcctctgaaaatttttatacgatttgggaggggttagtggggaggattatacagtatttttatgtgatttcataaatgtcaaatttcagtcatcagtaagagaggcaagcacaggtaggaaaacaaaatgagatatgttatgttcagcacagtaataaggctcctaataccaaaggaaaaacaagtcagtagttacaactattgaatagaagtggtctaatcggagcagcaggatgcgtatcccattttattatggcttcattatgtgttttgcaaggctctttggattgccattaaaataattttgtgcagcagcactgtgaggactcagaatccagaagcgtaactattattttcttttcttctttgttttctttttgaggtaaagttggcagcaaaggaaggtttcggatggaccaagtatagacacaacacttctgttaattcacatggggactaggcagcctcccacaatggctgtgacattcatcctgttctgatagaaactccctgctttctgtgtggcctgggatttgaatctggaggtctttgatccttagcctctcccgtggctggttaccggatggaacggacctgatctttcatttcccaaagaaggcctattaccatcagaagcaaaccgcatccttgcttttatagcagttgcgcttgataattattggtgatactgacatctgcccatgcttacttcatattcatgagcctgaagtggaattttttttttaagctaacatccccagttttggggaatagagtatttcctccaaagttaaaccctgaggtttatttcagaaaaccagtagtcaagtacccttcttctcactgagctaagaaatcctcataaattatttatttcccattttagacattggacagtgactcagtgtgccctggaaatattatcactgtattaattttctcatgtggctcagcataatgttagagaaatggatagttacaggtccagacactataaagatggagctaaatattcttctaaaaataggatgtttggttaacgtttagtagtcaacaactttcctgaagccacacacagtgccggactaagaaatggaataaatgtcctcatacagtatttggtgaagtctccctttaggagattaagcttttaatgttaaagattcagagtattttagctttatccctgagacttattatttgacgtgatgacatctttaactcaagaggtcaacaattgggataaaatgccatgctgtgggtgatggacgccataaaagtaacctgataatcggtcaggtgcggtggctcacacttgtaatcccagcactttgggaggccgaggcaggcagatcacctgaggtcgggagtttgagaccagcctgaccaacatagagaaaccctgtctctactaaaaatacaaaattagctgggtgtggtggcacatgcctgtaatcccagctactcgggaagctgaagcaggagaattgcttgaacccgggatgcagaggttgcggtaagctgagatcgcaccattgcactctagcctgggcaacaagagcaaaactccatctcagggaaaaaaaaaaattaacctgataattgagttttagttataaaagtgccaaaatgctaaaagaatttacagtttctgaccactgaaatattttgctctagcctgggtacaagaagaagcgagtttgagactaggaatgaatgagaggaaacttttgattcttactacataggttccttttagaattttgaatgtttagagctagaaattgaatattcattattctagcccagacattttacagaggagaaagtcaaagtttcagagatgaaagttgtacccagggccacacagttaggttgctgcaaatattaagagaacttacttcacttaatttggtgcatttttattcttctatttatagacgagtaaaatgtgctgagaccagtgcattttaagctccaagactgtcacttcttcatttgtcttaggcttttagattcaattaaataagtaatgcacctaaagattcatcagctgggaatactgtctcaccactgaatgacttaagagagataatattgccttgctgaagacatattataaaaatctgagaatgagcatgtgtgaagctctctgatactcttacaagaagtgaagtataagtagttgtggattccttcaaatgaaacaaaatttttctggacgcctttttagatagagtatatgcaacccaggagtatagatgtgatgtctcctgtcctgtgcaggagtataaatgtgatgtctcctgtcctgtgctcaggcaggttaggattctggcagaccatgagacacccctgagccatcactttaaaatgccccgtatttcagtagcgtctatgtgctaggatttctgtttgggagtacaaaaagcaatgagattgtttttcttgagtaacctgaagtctactgggaagaacccagtggtaacccaaatagctatgacacaaggtagaaaatagtaccaaggtagatagagataaaacctttgatacttaaaggaagacagaaatactgctgactgggaattttagaggaattttcatgaacaaagatcagtaacatcatccactatccatgaaatattgaactataaggcagttttagtactgggaaagaaaaactacatcatacctaccagtaagaatctcatgatcatcatattttaataaaagatgaagaggtaagatcgcttattctgtgttccaaagaaattcctggaggagaagggatctgagctagactttcataaatagagatgatttggatagaagaacaatttagagcatcctggtttgaaagaacaaaaggatctaaggcagtagccctgggaatgtacttcacaagttcaggatcaatgagtatccagtttagctaaagaaaacaattctagtgaaagaagtaaacaaacgtttggtaggatgaaatggttccatcttatggagaagcttaaatattgatccaagaattttgaacaccctagtggacttcaggagaaccttgtgactctgagcaaagataaaaataaattgatatgggaaatgatgttcctttcagattagagaaactcctgaattaatctcaaatttggaggccgcttagtataacaaaaaagtatattttcaatattgctgatatgtaatctaagaatggttctctcttcctgtcactgaaattcatctattatttattccaagctttaaaaaaaaagtactaaaataaaattgtgtgattgagcattgcaaaagagtgggtttttataatgtggaagccaaaattttttatcagaaaagaaaagagaaaaaagaatctatgctgagaggagatggccaactactacatagatttattaactcaacaaaagggtgaccagttcttccaaacctggtatttgttggtcgtatctattacaaggtagctgtggcttggtgcagggtgcagacaagagagggaacaggaagaaagagattagtgtaaactgtgaaatcaggcaaagctagactcaaattttgtctctgttttctagtaactatgtgtgaccttgaattattgaagctctctaaacttccactttcttgtttgcaaaatggtacgatggcatctacatatagaattatagtaaagagtaaatgagaaatacatgtgaatacctagccgcttctggaaaatagtatgtactcagttactggttatttttattatcgttgtaattactatttccagtgatgtgatgcttattaccttccaaagcaagtacttttatatttgaataagtgaaagctctttcccattatttctaaacccttgtcctacttctcagttctagaactttttttttttttccttaatggaaggaaagaaataaggaagggttggagagagagagagaggaaaagcacctttgtttgtatgctttctttagatacgttgaagacaatactcacaaatctcttcagtcgtctctccatttggatggccatcctcagtgcttaagcacttcttcataaatatgattttcagaagcatctgaagcatctgtattcggggtcctgtcctcatccctgttaagaaatataaggctcaaaatcagatgttgttatgtgaggtgtggtctcgtgcatggagtacaaggtcacttttcattaggagacaaatgcgcagtaatacctacagtgtgggaacgtggatcccttctctttaatatcagttttgccagtgccctcctttgtaacccagagtagcttcagataaacctactgagcccttcttttcttgttcataggaaaatatttttaaagggatagtgcatttataagaaaatttttatatacttcttttaccctgagaggattgcaaagtttgtcatgccctgattgacaaatataagttcaaaaaaaaaaacagaaaataaattccttaaataatttatatcagacaaatggatctgaatctaagcaaaattttcaggaaaaaaaatgtttataatcattaggtaaaagtagaattctgaccttatctttatattttctttatattttaaagctttgcctacatattccaagacttggctttcagttttcctaaatctaaacagagaaataaatgaaatcatgtctaagatttcttccgattttgacattgttatatgtccttacctgtaaaatgaagaaaatattttttctttttatcagggttgttgttaggaagaaatgatattatggatattgtgtttcagcctgctagggacagatactttcatagcttcattcattcaccctagggtaaaagtatcagtgttttcttctttttccttcaggatttattccttagtcagggagtgaccaaggatggtcagccagaacctcagctggtcacctggagcataatatggtaaacagaaccatacccaaagttctgtttacggaggcagtcctggctaccagtgaatgatcaggaaccctataagctagcccctggaagaacaatgatgctgattttatctgtaaaataattctttgcatacaaagtactataaactcagttggttctccctgcatatttttgaatgattgtaggcagagtttttgttatctgttttactaatgatgcaactgaggcccgtaggagtcaggttgcctataaaggcaaggatgtgcatacagaattacccaaagcaaattggtattttgtggggcacaacctcaaaaccactgatatcttgctacatttaagtacaaaaagctcctatatgccacagaattagaacattaccagatcttaaatgttccttagaaatcacctcaactgatgccccacatttggcagaaagccaaaaagtttctcagctaggaacaaaacacaagttccctttctatcacatggtgctgaagcttagatgcataaaccgaacaaatcatcaggaagctataaaaggaacaaacaaatacagtctctggaatcattgcaacctcaatacacatctcattgccacttcctggacatttgtgtctagctaggttgcttcccctgcctgagccttactgtgaatatgtgccaagcagagtgttgctgttaattgagctagataacatgccagtgtctggcctagttcttggcccataataggtattcaactaatatttacttcttttcatccactcacccttcttcttaacagttggaacccctgttttgaactgttcacttctactctggatttccctgtgtaagctcacttgcagaagagggtggaggtgaacacactgcatttcccaccatccagctctgacctgggcccaccctgtgcaggactctgctgactttgggatgccagctgtggtcctcacacagggctcactgtatccgggggcctggcttgatccggtaaagagcgtctgctgcggtgcctgatggaaagtgcccgcttaattgggagatagggcttcatgaatggatctttcattagttgaaaaaaaaaaatatttgcctgcaaggactgtaaacagaagacttgattcacttgttccttttctcctgccctctcttgggttttgtttgacttagcgtgtttatacctcaggacacagctggtactaatgcctttccaaggttaagaaagctttccctgccattccctatggtcccctttgtgtactttcaagagacaataaaggaggtgtggatgtgagacagagagtgcattcacattagtcctggctattatggggacctcagaacaagcatcacctccaccctgtctgcatggatttaagagagagcatctgagcacctgagcttacctcaaacacgttctttgaagaagagtcactgccggtcatttctgtaatgtatcacagctgtcctgacctgatccttctctgctctatcgtggctactttagcatatttttctcaaaaagtgttcctctttcataattaaaggtgagggaagactggatgaaaaaagctgtgggatatggtcagcacataaggcctgtggtcaaagatgggtcttcagttacatcgtttggtcttactaagcctcaatgttctcatttgtaaatctggaataatcattagacctttttcactctgcttgttgtgaggttcaaacatgagactcaatgaaaaagtactttttggacaatagaacactacataaataggaaaattttaatggaaccttcctcatattccattaatatgttggtgctctgcattatagtagtactttagttgacttgagcacatgatgtagttgactttagattaaactttcactaagtattacttagaaaaaacgagccatcatgtgattctacaatctttatgggctacatagggatggtgaattcttttcaccactagcaaaggctcctaaaggatcatgccttactcccactccatagatgaagaccttaggcccctgggaatccattgagctcacagaggtttacataatgccaaatcaggatgggaagttagatcctgcttagtgctcataactggcttatgaggtttccatttcagacaatgaatactcatcaaggaggattggtggggaaccatgagctgttcatgtgtactgctgcactcacgtcgtatccagacacccagatatcatctctggcccactgcagtaagatctctgtcttctgtcctgtttgtctctccttcattcattccttcatttgctctatctagccttcatacttcttgaatcactttgagtatggtacccttattttaaataaatagtaccctcatttgggtatttgtttccagtgttcctgaggctggggaatttctccagagtttaatgatgactctggtgctcaagcaccaagaaaatttccacttgagatggatctggcactggaggtttattttttcccctttctattttattgttggccagtttgggccagcatgttgctaggttgtattggtttcttagctcttgtaaccaagctaagatgcacatgtcaaaaaatattttttcttcctctctaaaaaggtttttcctcttttctgtaatgcttcaggaagggaaaagagtgtttgcttgattctaattctggcatatgaagtgtttgctacaaaatgtttttatcactgtgttatcttgtcaaagtgctatcgtcattgtcattttcagtttaatagcaggaatgttccattttcacaaaggatattccatattttaagtaaactcaacaaaggaaatttcaaatgcaaaaaaatattgatagtgagaagctaattagtttttttatttctcaaagccctacatttaaaatagctttaagtttccagtatgtcatgctctgacagtagcatttacaggtaaaggatgatgcttaactaggattatggttacattgtaaacactcaagccaaagaaaaatatatccttggacaaaggggttaggatgatttgccagagtggcctccagtgtttggatgacagctacatcactgtgatttaatgcacctttagtttcaggagttgtatccagactagtcctcatctcagcctcaccaaaggggactggacttaaccacaatagaactcagagctcctgcagtgaaacccagtccctttccatgcgggaagtgataaccgcaggtgaaactctgagctagggaaataccatcttggtagtcctgaagtgatagcacttacattcttttgccaggcatccaaaatcctttattcttcaaatagttgtgaaggtttttttttattattatataaagccttgcagtgagtcatagaagaaatgcactggggtctgagacagagagagagagatgaaacaactataattcctgagtcaactatgattcctgtcttcaagagtctcatgattaagaaatggagacaaagcagaaataactaattccaacttcctaagctaaatgtcataatgaacaaggaaccaaggaagcacatagaaggcttaggtaaattcttcctgagggaattcctctgttataggtaataattattaagcttccaccttgtcttgtttctatgtctctattattatttaatatttacagctaaagctatctatctatctatccatctgtctgtctagagttcctacctaatggtatgtttcagattaggatagatttctcacttgaaacagtctgtctgatgttttgcatccatccatccattcattctacaaactgttatgccctctatatggcaagcattttgctatatccttactacagaattcacttaggcactaatacctattttaattatggagacaaaaacagctaagaaaatgttatcactccatagatgagttaaagaaaaaaaacagggagaatttcttgaaggtgatgtcaatattatcataaactcaggcagtccatgctgaaaatgatttttttgtgagccagaatcccctgtactcatcatttattccctgatttactgcgttttattctgtatcagatgatgtgctagcataaagcggggacataacatcttctgatatcatgagacattgtttctaaacctcttttcttggtgattagacctatgcttgtgcccatcagagtcaaaggttgtggacacttgctccgctgcttgttttttctgctatcttctgtccttgttggttgcattctaatggacctataccaagtgctgtcagaagatgagagactacaaatcagattccacaaggatgttcacaaataataagcatttggttgcaatttaaaattggttggcagagcaatagggcatttgattattaggattttacattatctgagtgacttggaaatagaaaagaagggacttgtattatatgtccagaaaaaaagtccagcaaactataattcataggcaaaatccagtgcactgctgtgtttgtaaataaagttttattggaattcagtcacgcccatttgcttatgtgttgtctatgtctgatttctgtctacttggtggcattgactagttttgagaaaccaaatgacccacaaactttgcaatatttaccgtctctttattgaaaaggcttgaccctctataaaaacgaattaatcctgaaggagaagaaaaaataaatagggaccctaatcatatttttaaatttatacagcatgcagttttgaaacactcagtcaatgatgtagaacaattaaaaagaaaaaataaaacctgggctaagatgatagacaaattccctttcaacttcaaccagtttgttctgaggatattgtgtgcttcaggaatttctgccatatgctgggatattcagacatatataacgcagtctgccttccaggaacccttagtctgttagtggagatggacatagaaagcagcaaatactcctttgtgtaactcatgctgtatatgagataagataatgaggcagagaagagttggagagtagagatggcctggcttttgggaatttggggaagatatcataaaacagtagaaacttaaactatgtttgaaagcatgaactcatgatagacgggcaagggtagaaacaatcgttttatttctagaagcttcaactctatcttgaaatagtttgttgtgtatattagtccgttttcacgctgctgataaagacatacctgagactggacaatttacaaaataaagaagtttcaatggacttatggttccacatggctggggaggtctcacagtcatggcagaaggtgaaaagcacatctcacatggcaacagacaagagaagagagcttgtgcaggaaaactcccattttcaaaaccatgggatctcacgagacttatttactatcatgagaacagcacgggaaaggcctgcccccatgattcagttacctcccaccaagtccttcccacaacacatgggaattaaagatgagatttggatggggacacagccaaaccttatcagtgtgtttataatggcaccacagtttctaaagtattatccattatctttttggtctttataacagaggttggttgtaatcattatctccattttattagtatttcttaaaaggcttcatcaaagcagttaaatgactttttcagggtttcactgcttataagtggtaaaagttacctgaccctacctctgactctaaagccacaggactgtccccttaaatcaaactttctggcctaagtctacaggtattccccagaatttctaattgacatgaaatgcaagagaaaagagtctttgaattttcctgcactggagcaacctgccttattccagacattgccaagaaattgtttttgccactgacattattgcgcatgctgccagtggaagtaatagtgatctggacttcatatgctttcaccgaacatgcatatggctcttcttattagactgtcatagggctcccttactttcaactttccttggaggtttctctattttctgtcctcttttcctttccttgtttctgataccagcctatagatcctctgtcaccagttgggtttcttcatcacatggttttctccttctcaggtggagttttggccagagggaggagaatctgttcaattaaacagattctgtacaacagattctgtataatgcaaaacagaaccgattctgtaaaatgcaaaaaaaacccttttctcttgcatttcagatcaattctaaattctggggaatatctgtagacttaggccagaaagtttgacttgaggggacagccctgtggctttagagtcagaagtagggtcaggtaagttttaccatttataagcagtgaaaccttgaacaagtcatttaactgccttgatgaagcctttaagaaataataattaaacatcccctggtatttgagaaaagaggtatcccaagtcccaccatttaccaggtcctattactcacaatgctggtaaccataggtctccatcccttatgctcactcctcttaccacgccctgtctaggagctacttctacatttatgtgctcagtcttctatccagaaccctacccccaaatgtctaagctcctcacacctcagttctctgtcttgggccatggaacctctaacactggtttggaagtgtgtgtctttttcctcaggcagctggagcagagactgattccactgccaattcttgcctcaagaagagtcgtcttgagacaataggttgaagctttcactacatgttcttttagcaaaaaattataaagcatagaggttgagatgggctctggaatcagactacaaagattctgatcttactgcttcagttataagctctggatgttgagcacctctcctaatctccccaagcatcatctactgaaagggggcatcacaggacttccctcattgagctgttgtaaggattaaatgagcacatgttaagtttctggctgtgtaagtttttgttattacttttcttttgtacttgaacttgtcataccatgtttctattttgggttcagaaaatatggttaacataattataggtgtaatagaaattttggattagcctgtgaacataacacacaattatagcactgttttttttaatgagagaatgaattcctgagttctaaacagatgagttacaaagaaactcttggactgaagtcatccatatataatagatggtccagtttggagtagaagactgactgtgaaagataattgaaagtctgcaaaaatattttttactaaatgcactgtctttttgagcttgcattcataggcacatctaacgcacctgccccaatgtaaccaatcaacatcacatacagccctcagttactaagtttatgaggtaaatttattttccttcttggtttttgtttctttgcattttgatctttttatctctttgtttattaaataagaaattagaatctctgatcagtagattggctaggatctgcttatgagtcttagatgcaaaactgacaaatctttaattggttgtgccatcgtatctgtcctcaggcttgttagctaaagctcagttagtgatttgccaccactgccattgcttggtggtagaatagggtaaaggattatcatgccagcatcccttgtccgctgtgaccttagtcttagtgaacaaattttcttgtgtgctttctaaaatgcccatgacccttatttcatacttaggaaatagaagtcacaaagatttcctgaggacctcatcattatgtggagctaggaaaagtactgtggtttatagctctgtggtttacacaaagggaaatccaattgatttgcacaaatacacaaaacaaaatatatttaagtgccatgaagagaaacgatgttctttaggaattaagaggaggttcagaaggaaaatggtgttgattgaatctggccaactgagcttggacaatcagtgacctcagggaaaggagtgttaggaaagagacattcctgacagaggaaataacataagtagacagggagatagaacattctggaaattgaatctgtgttaaaatgccttaaaaatggtgcatcatacgaatttagcgacatttcacttcaagattcttacacaccttagggtgaaaatcaacaaagaccttaaaatgcagacaattaactctttttctctgtgttgtgtgtgtgtgtgtgtgtatgcgtacacacatatactccacatatctccacaaatcaatgacaatatcaaatggagcaattttccacaattttctccaagaaactgcatgcttaagcactgcactcagcaaaatgttgtaagtccatcaatatttctcagtcttgctgagtttctgcatgacccccaatagcttacccagtctcttcctctataagtaatgatcgcagattctacatctgcaagtacaagaatcctttcacaaataaattccagaggactccaacctgcagtgtctttagtgagtcagaaattaggaagatagcttcaatttggttatacccagcaggaaggaaacaatcctaatcatactaataccaatggaatattgtagtccaggagtttgatggagtttgaccagcatcctttagaaaggaaaactgcataaattaaataatttatatggaacaaacatatgtgtaatatgcatgtaaaataaaatggcaccagttattaatcaggtgaatgcatatatatcatagagaagtcaactatgaccagaagatacaaaatgaactgttctttaggctcatgttttgttttgcaatacagggcaggatattctctcttcctttagccttaactgatctgcttccatgttctagtcacttgaacattgatatgcatgtaaaataggcccctgttcttccattaactagaaaataaaaaagtgcccagaagggaagtttccatttctagcagcacgttaaaaagtgccagagtttgatcaggaagtggtatcagggtcaagatgagggaaaggacatcagaaaaaaaagtagaattatcctgttcacttcaaggaagacacacagcataaggcgggttttagaaaaggattaagagaaaattggcagacagaattagggagattgcttaatcaatatcacaatataacgatgctgggtagaagatgcatggaagaagcatggattatctcaatgacgattttattttgaagatagtgtgattatcacccctggggatgctggaacattacactggggatttagtcaccaactgaagcagatctctgggttgaatagatcaccatgaaggttgtttccaaccttaagttttcttaaatttcagaagttcaatgagttcttctccaaggatcaaggaggatatctactagaaatctactatagaatagagagaattggtctatacacaagtttatttaaattaaataatcctgataccattttgaacttttcagtcaaaacctaccatatgcagctcttaccagtgacttcagtgcttccttatacaaggtgcaagcggtgctaatctcacattaaaaaaacactttgggccagttgcggtggctcacaactgtaatcccagcactttgggaggccaaggtgggtggattacctgaggtcaggagtttgagaccagcctgaccaacacggtgaaaccccgtctctactaataatacaaaaaaaatagccaggcatggtggtgcatgcctgtaatcccagctactcaggaggctgagacaggagaattgcttgaacccaggaggtggaggttgcagtgagccgaggtcacgccattccactccagcctgggcaacaatagcgaaactcagtctccaaaaggaaaaaaaaaaaaaaaaaacactttgattttagaaagaaggtctgtgcccaggcgctcccaggtgctgccaggcctcagaggaagggttctgaagacaaacctgactgcctccttccacatgctatgtctgcaaatattggctgccttcaagctcacagcctgtgacagcaagttggtttcatttcttaaagttgatcttcaaagccgtgaagcaatcgcaaactgtttgagatcccaaatcaaagaacagattgtgtagactcaaaaaaagcaaacaaacaattacatttaaaaacaaagtgttggaaaaaaccagcaacaacctttctgctcacctgccaaggccttgtggctaagcttctgtttttgccaaattgtagcaaatcacatcagacagtgtccttcttgtactactgacaggtgacccatttcctggtggttaaatctggagggatttgggagttcttgctcttaacatgactttcccactgactggatttgtgattgtaagcacatcacactcatttcctccatttgaaatgcaggttctctgaagccttctggcttgaaggaataatagtgagtaatacctaacattggcattgcacagcatgccactgagggctgcccaatagctctgtgaaagagatgaggaaacaggattagagaagggaccagctcacagtcacaggactagtaaattatgaagtgagaattcaagctttccaatatcccttgttcttcctactacatgataccacttctagctaaccactcattcagtagctcttgaaaaggatattctgttacctcctttgaagataatatttgatccctactttctcacagggctttccaaatagagtccacattggcccatttccatggaacattttgctggtctttaggtattttattaattgctgaattgtttaggggttttaagttgtctaaggagactatatctgaattcaattatttttttcctctttcccctcgagcatgcacattctttgtaatactgtagtgatgtataagttttcaagagctgtcaaggtgtatatatatatatatatatatatttccaaaagcagatagtatagtacatttactacagttgtttcactttgatatggataaaaaatgtataaaaaaggcaaagaattctgtgagtgtcattacaactttaatttcaaaatttttgcccttatgttatttgctatacttggctttcctcgacattataaatcattgatcacaggctggtataaatttagcattaccagtggattctgcgtatttgatatgctctttttattttggttttgtcagtttgctactcgtgagtttatctttgaacagcttcccatggctatgggattaggtctgtactccagagcctgatatctatgggcctttttttcttagcctttctagtctttttaccccatatttcttcatgatatccatagtttgtccaacctaaacaaagagctagtccccaagcacactaacccgttacattcatccctctgcttttaatacaattgtttctctatagagaatacctttaaaaatatatataagttggctaagctcaaaaacaccacttctatgataatactcttacagattcttccatttgtaaatatgcatgctcatagtactcttacagcgttggtcctctcttataacattgttagagtagatactgtaaactgaaaagtgacacataaaaatacataatggtgcagctcagatatgtgtcatcttaatattcctattaaccttagaactttgtgactgtgttgggattacttgacatatttgtttatcaatcaacacagtgacagtgacaacgaatgagtaaccagtgttttgtttttgaaacatttgaagaagtgttccatatttctgaagttattagtttagtttaggttagtttagtttagtttagttttaacgacagagtcttgctctgttgcccaggctggagtgcaacagcgtgatctcagctcactgcaacctctgcctcccaggttcaagcaattctccctgcctcagcctcccaagtagctgggattacaggcacctgccaccacacctagctaattttttgtatttttagtagagatagagtttcggcatattggccaggctggtctcaaactcctgacctcaggtggtctgcctgccttggcctcctaactgaagttattttttaaattaaactaatacatgcaactggcttaacaaactaataggactaatgagtctaaaacaaacgacataccctccgtgcttctcctctctccactctctcaatcctacttcacgaaagacactcttggctgcttcttcctggcatttgcacagcttcatgtctaaaacagaaatgcatttctatctttggaggcataaatcttagacattatctgtggattaataacacaaaagacacggatatgccatccatataaatgtttgactgtttagagcttcctactctgggaaggattgacccatctccctccaaaattgagaaaagggactttcactggacattatcttcaagtccttgcagtgttccagaaggtgtgacaatctggtcctttggctggctgcattactgacctgctgacctgctgttttaggttgattatatttgcctttgagccaaaagagttacttgatgatactccagagccccatttccacacaacacttaggtttaaaagctgcaaaaatggatttaatgaaataatgatggagtgatttgaagatttttcatgtctttcaggaaacacaaggtgctcttagtgaccacagagctagcagcctcccctgcatctcaactttatgtttccaaatatagtctagatgcttagtaagtgttaaaaaataatagtgcatcttgatgcattctttatggtgtaaaataacctgttaggtagcagggataatttttcttcagcattagatggctgtttatgtatgatatatttctctgtgtccctgggacctaatgatcgttgaatacaggtgaatagaatgttatacagtagatggaacatgattatcaaagtcaggagacctagactcagttgctttctagcaaggcagtcattaattacatgttacgtcttttatcagaacctcagtttggatctataaaataggattactcatttccaccttggaactgtttttatgtaaccatcaagtaagccggtaaatatagttatctgtgtagttaactagctgctaacaaaggaatccagggtggcctttaatatatgttcggaatatatttattcaacaaatgtttcttcaattgttttccaagttagatttataaaaaatgagagcctggcaggcaagcaggcaagttggtagcttgggatgggatccactacagcacagaagtgcagccagagacttgctcctaactccccacggattgctacaaatccttgctccaactcgcagcttggcaagggatcttgctatcagccttctctcatggaacccattgtgcatatgaatatttgattagcttattccattttcattttatactattagttctccttgtggggttagatcctatgcacacacacacacacacacacacacacacatcatttaagaataggaaactattttgcaatctatatgccctctgcttgtaattgttactgttcccaatccatttcctcctcattctttgtctctcatccaaatggttttcactttatgtgtaacaggagtgagcttattctgaactacattggttaggtcctttaaagcgtaagcacgagagaataaaatgaatggaatggcacagagcacagctcacatatttgttttttagttttaaattctcatttgctttttagttttacacatatttattacccgtatttctcatagatttgctttttggttttacattctctccttacttttgccttggttctcctgatgtgtgaaaatgctcctaaggccaccaatcacaggattgtgactccttccccaactttgtttacctacaataattgcaacagcatgatattgttcaatgttggcatatgcaaacagaaaacctaagatctggggagccaattctttgcagaaggtgcttcaacctatctaaaagcaaaaacattcaataatgtgtacatgctttgaggtgtgtgtaatatttgtgtgttcattatgttattctcatagtcacaaaactcctttcaggtaaatatttgttcccattgtatgcatgtagaaatcaatgtttagaggggttgttaaatagctagttaaaatcagaaccaagaatcaaattcattatttctgtcttaaacttctctttcaactattttaggctgcagtagtaagcatcatatgacttcttgtcatctctagtgtgaaatggttttccaaagatctgtgtgtgtgtgtgtgtgtgtgttttaaataggcattttacttttaaaaggaaggttcacagtcaaactgagcagaaaatacaagcaagttcccatatacccccatccccacaaatcccacaaatgcatattctttcccactatcaacatctctgacgagagtggcacattagttacaatcgataaacctacattgtcacataattgtcacccaaagtccatagtttacattagcattgactcttggtgttgtacatgttgtgggctttgatgagtgtgtagcatttatttcccgtcatagaatcatgcggaatactttcactgcccctaagaattatccttgctctgcctattattactttctcccccaaccccggtaacccctgaaatttttactggcttcatagttttgccttatcagaatgtcttatagttgggaccctacaatatgcagcctttccatattgccattttactgaataatatacattcaaggttcatccatgtcttctcatggcttggtaactcatttctttctaatgctggataatattttattatatagatgtccacagtttatttatccattcacctcctaaaggacatcttagttgtttccaagttttggcaattatgaataaagtcgctataaacatccacgtgctggtttctttgtagacatatattttcagctcatttgggtaaataccaaggaatgtgattgccggatcgtatggtaagagtatgtttagttttgtaaaaaactgccaaactgccttccaaagtatctgtaccattttgcggtcccacctgcaatgaatgcgtgttcctgttgctacaacattgtggccagaattttattgtcagtatcagtgttgtcagacttttggattttgcctgtggtagcaggcttatttgcttatttgccatctgtatatcttgtttggtgaggtgtctgttcaggtcttttgcccatttttaatggttgtttttcttactaagttttgagagttctttggatattttcaataataatagtcctttcttaaacgtgttgtttgcaaatactttctcccactctgtggcttgtcttctcataaacgcttgacaaagatgcatttttgacatgcaccctgcctcatctatagcatgtcttcaaataggcttaagcgactaacttgagggaagctgatttatcttggagaactcctaactcatttttctttcattcatttaataggcagcagacttggggatataaaaggaatattctgatgtttagttagtgcttaattattttgcattcttaagtcaagcttttgactgttattgcagtgcacttgcacaaacatgaacatttcaacatctgctgttagtgtgaccagaaagagagagaagagaaaggaaaagaagggagaaatgttgactcaatcctgtccttatgtgaaacaataaaaatattttaaaactttctctcagttatgcgacatagtgcttttctattttttcctaaactggaagctccctaaggggaaaggatgcatctcatagaatctcaaggtgctcagcaggtaatatgcatttgagcaatgtttcttgaattaaacttgctagccttatttatcctgaagtgatataacatcgttgggctgcttcaaactgcctttatcctgatgggttcaactggcacaaacagttattaagatttgggagagtcagaggtcccatagataccatggactttgctgcatctcagttcttccattgcatgcctttggaaatctttcctgctggtgaggttctgtgagggactgtggcctgatagaatttgtttcatttctgtttgtttttattctttagaaaggcagagtagaaaaaacagtttaatgagataacaaatagaggaaaatactttggacttactgtttaaatttaaagattgactttatggtagctattaatagttccaacatcttgttgaatacccaaagcttaattatgtaaagagcttcttatttcctctctcctgccccttttcttctccatccccttgcaaagcaggcacaaaaattaaagctatttagagatatgtgaatcagcatattgcctatatctaatttatctttgtgcaatgcacacattcgtgaatttctcaaagccatgtgactctccagaaatctttaaatatgtaaataatattataacgtcccttagtgaatagcagatgcaatgcattattccaggtgtctgagtaatgcgaagaaaagatcaaattccctgttgtactacctgtgtcacatgttacattaataaacacagtcagcttgcaagaatagtatgttatctgaatttaatgaacttctgaactgaatggaatgcatctaattgacaaactgtcatcaaagagaacagaagacactacaaagtccaaagggaaagaagaaacaagtggggagaaaaacaaacaaacaaacatgatgaactgtgggggctgggattaaaatcattggaaggcatctctgtgtgaatgtgagcctgtgcagtaacctgcacgtgtgttgatgcctggtggtctttccatgtgagacatcttggatctgattaaagggccttgtggtgtctggcatttacagctttgtatttcccttaattgcatatacagactcaagaaagggatgggggagtgtcacataaaagataatccacagcaaagatctcaagctgttaggtaaatgaaatgtttccacaggagggtttatttttgccttcaaaatctcctggtacctgataaattaaagataaaactctttcaaacaagtttttacttttcttttctccacctcccatgctgtcatattgagtgtcacgtacatcgctacttaaaactccaacgggtagagtggctattaaattcggtctgtatatacatgatatatattatgcatattttcagaacatatgctgtgttaccatcttctgacccaaagagaaaagctgcagtaaggattttttcaggactgtaattgggcaaatgaccttgtaacgcagtggtctccgacctttttggcaccaatgaccacttttctggaagacagtttttccacgaacccagggttggtggggtagggatggcttcagtatgaaactcttccacctcagattatcggcattagagtctcataaggggcatgcaaactaggtcccttacatgcgcagttcacaataaggttcgcacccctatgagaatctaatgccaccaccactgatctgacaggaggcggagctccggctgtaatgctggctcgcctgccactcacctgctaggaacaggccaaggaccactatcagtccatagcctggggattggggacacctgttacagaatttatactgttaaatgtcacttgatatgcacactaaacctattacaaaccacatattgtcacttgtcataattggacagagctgcaatgaggttttggttttaagtgccaactcacctctaagctttttcagatccttgagctaaaagtgtcctctttctgaaatcctattaccatttattgtatatctttaatgaaagttttagtcttttccttcatattaatgttattcacccatttggcttagcacccctcttagagataaagctctgtgaagatgtgtttcttactggttcatttcggcatgccgctaaatgtgtaaaacctagaagatatcccatagccttgtttgaataaataaagttacacatggtgtttcaagttcacctatttctttgactaccaaaagacttctggttttaataaaacaactgtgaagttcaagtcctgtgtattctaacactttgatttactcaatggcctgatagaaactgtttttaaaaattatatttacccttagcattttcctgagtattgtctttagctattggtggggaagatggatatatgtgtatgtgtgtgtgtgtgtctgtgtgtgtgtgtgtgtgtggagagagagagaagagatacatggacccattgccacaatcttttaattatgtgaaacaaaaaatatttaaataacgttgaggttatccatatcttctgtattatattctgtgttactgatttttttggatcaaatagtgatttttcatgagctaggtataaaaatattaccagggactaaaattaggggaaactgggagtaacttagagtgtagccagttgtttttctactggtgctaccggcattgaaagcaagagagttcctccctgtgtggggatggcctgtacatggcaggacctgagtgtgccaggtctccagcctttacactttggtagcatcttccccacacacccagtgtagtacgccctctagagggatccatttcttcagtgaccacgtctttggagagccactgtctagatttttagtgcacaaaaatggagtgtgattaagggttttctgaggatggtgtattgttttatgttttctgttgctccactcaaattcaaattttgctgttagacttatcattataatgaaattgaatgttggtaaatatttttgtaaagtatatgccccttttctgtgttgaatgggctacaggcattcaataccccgtaatacccaaaatatcattaatttccagaaaatataaaattgtcacaaaatctaaaaactggaatattaggaaaaaggaaagaatggtttccataaatcactttgtttaacatagtttctatgtgtttgtctgagtagttgttttattagaaaattgtaatttcctctctaaacagagcaaacatattccttcttcttcttcttcttttttttttttttttgagatggagttttgctcttgttgcccaggctggagtgcagtggtacaatctcggctcactgcaacctccaccttccagttttaagcgattctcctgcctcagcctcccgaggagctgggattacaggcacctgtcaccacaccaggctaatttttgtattttttttagtagagttggggtttcaccatgctggccaggctggtctcaaactcctgacctcgtgatctgcctgcctcggcctcccaaagtgctgggattacaggcatgagccacctcgcccggccagctaacatactcttttgttcctaaatacagttttaaaagcacatgtcttgagactaacttgtcctttcctttgtaacatcagtcagttttgttaacaaagtaagtgaggaactataaagtttgcattttaggaaaattttgcatttagtatataattttatcttagcctgtgctttatctggcaggatctgatccatcctataattctacaattagtgttttggtcagaaatgcagtcatttacatttatccctttgacattttgccattcttattcatttatccagtcattcaatttcagaatactaactttgccagatactaatatcaaggactggccaattcattcatgagtagatgaataacataagtgtcctgactcaaggagcttgtaaactaagaattgtaatgttataaactatttatatttctctagtattttacaaattaacaagcaaaattgtgtgattctatttgtagtcaagtgacctcagaagctattcagtcttcaccatttcctaacttatgacttgatctcattctagccagtgacgctctatagtattatatttattatgtcatccttaacggtgtggaagttgaaggaccagaaagattcacacagacttgtctttgttcacaggagtagacccatgcctctagatttaaaaggttcatcaaggcagtataacttagtagaaagaataagaaactgtaagtctggggtgggatctggcctcagtaattctctggctgtgtaaacttaggtaagatgcttaattttaaacacagtatatccttctttgggaaatagaatataccttacggatttctttataacaattatttttcaacaggaaagaaggaaagagaaatgcttgcatggagccatcatttattcaacagtcactcatcaaatacttgttgaatgcttactcggtgccaatcacttgtccacacactggaagtcaggagtaaatacaatcataaaaattcctgccctctgggtgcttacatttctggttgtgttatgctgcagggagaaagaggagattttcaaaggtaatagtacctaataccatctgaaatcctaaaatttctgccttactgtcttccacctaccatccccattggggaaaccttaccttagaggaggccactatatagtggatatataatagtgtttgtattttatatcttttatcactgttttctgcacacagtaaaacagtgataaaagttatcactttcttaagattttgaggttgctgtacattctcatttgtgaacaaaaactttgctctgattacgtaggattcatttaaaatccatggaatcttttgacactgaagttagaagttcattttatcaacaagtgaaatagtctcaggcacaaggtggaaggatgtgagtcctaaaatcttcggtaggagttggctgggcgcaatggctcacgcctgtaatcccagcactttgggaggctgaggcgggcagatcaccaggtcaggagatagagaccatcctggctaacacggtgaaacctcatctccactaaaaatacaaaaaattagccgggcgtggtggtgggcgcctgtagtcccagctacttgggaggctgaggcaggagaatggcgtgaaccccagaggtggagcttgcagtgagccgagatcacaccactgcactccagcctgggtgacagagcgatactctgtctcaaaaaaaaaaaacatctttggtagcagttttacatagattcccttttgacagctcccaccccagcaactctgtaccatagttattggtaagcacatcttccagatgtgggaactgtggcttagaaatgctatgaagccagttagtagaagagctgaaattagaacttggtattctcaacctcaccatctagtgtgctaatcttttttgtttttgtttttcttcctgggacagataccatttgtgacctgttgagtgagactgatttagtccactgtgttaacaggaaagttgttatagtttttttttttcttccgtattgtttttaatggcaatgtaaaacatgtgaatctgaaaagagaggttctgagaaatttgtgcagctcctttttccaaataaaagatagatttctcttgatgaagccttgatggttggaaattaagacaagaactgaaagcaaaacagcctactcaaggttagacagtgactcgagtcattccatgcacttaaacaatatttaggatgaccctatgtaaactcacattatcacttaaaagccagtataaaaatactacccatctgctgtgctagtcctgctgttgcttgccacatttctctgacaagctgttacctcagtatatagagagagtatacattttggaatccggagtttaagtttgaaaaaaaaaaatggtatctggtacatatggactagattctgttcttccaaatgtagatttgtaacctcatttattcttaaagatgatgtgttaagttagctttttttcttgactctgaagattgaagctcttataattttatgcctggacatgaacaatgtacaataggaaatcatttagtttacactcgccatatgatatgcaaagtgggtgttgggaggtgtttatatcaaacaccataactaagttctaaaccgctctctggaagctatgtaacttttcaggtattaaaggtttggaagatttgtaggtgcagtatgtataattgcttccatacaagtaattttttagtgccaaaaaactctaattccataatttccagtgccattataacagccgagatgtaatcttccttcttaataggtatttgagcagaagaggcaagattgaaagttagatcctcaggcttctctgatgcatcaatctgcggataaagcctttagctaggaattacaatctggaacagacgtgcaagatcactgagtcatttgctgtttttccgtgggacaattacttattctttttctgcagatttcctaggaaatactccaaagtaaaaaatatcaggagcagcagtatgtgatcttccttgctgcttattgttcatactctttatcgcttctcagctttttggctaagatcaagtgtattgtttatactgtctccacgattttcctggaaatcctttttggtgaatataaccttgtgcattacttgaaaatgggcattttaatcattttttcattccactaatatttattgaatgatcattatttgtaagatcttaggagacctgtcaaagacaagcacgggctcatcaaaatcttaaacttgtgtatagagtactaaagaaggagcatgtgaacatatgattttcagaaaattgagaagggaagtgagtggggagccctttgagactggacagaaacaagaggaccatgacactgaagaggacatttttaatttcatgttcaccctgagattggtaatcaagagtcttatttactcagagcaagccgcataaatcaaaaccacaatgagataacatctcacaccagttagatcattaaaaagtcagggccgggcatgatggctcacacctgtaatcccagcactttgggaggtcgaggcgggcggatcacgaagtcaggagatcgagaccatcctgactaacatggtgaaaccccgtctctactaaaaatacaaaaaattagctgggcgtggtggcgggcacctgtagtccgagctactcgggaggctgaagcaggagaatggtgtgaacctgggaggcggagcttgcagtgagccgagatcgcaccactgcactccagcctgggtgacagagcaagactccatctcaaaaaaataaaaaataaaagtcaggaaacaacaggtgatgcaggtgatggagatgatgtggagaaatagaaacaattttatactgttggtgggagttcaaccattgtggaagacagtgtggcaattcctcaaggatctagaactagaaataccatttggcccagccatcccattactgggtatacccaaaggattataaatcatgctactataaagacacatgcagacgtatgtttactgcagcactcttcacaatagcaaagacttggaaccaacccaaatgtccatcaatgatagactggattaagaaaatgtggcaaatatacaccgtggaatactaagcagccataaaaaaggatgagttcatgtcctttgtagcgacatggatgaagctggaaaccatcattctgagcaaactatcactaggacagaaaaccaaacaccacatgttctcactcataggtgggaattgaacaatgagaacacttggacacagggtgaggaacttcacacaccagggcctgttgggggttggggagaggagggagggatagcattaggagaaatacctaatgtagctgacgagttaatgggtgcagcacaccagcatggcacatgtatacatatgtaacaaacctgcatgttgtgcatatgtatcctagaacgtaaagtataataataaaaaaataaattaattagttaattaaaatttaaaaagtcacactattaaagttagaagacatgccctgaatcttccagtcaaaattccttgtttacagatgggagaaagagtgaggaagggttttgccaatggtcacatagatgtcaaatatcatttactgagaaaatcagcataagaacccaggtctctctctttttttttttttgtttttttatcactcaagccaatagtttttccacccttttagttctgttatttgtcttctccactgttattcaaggctatctcaggccagaagcagaggtttgaactcttttcagatgagagcatttttgagactgggacctcatgttgaactaaactcacctccacgttggcacgcacgttacttcctcttccactgtataattttgccgttggattaaactcatgtggttggtgctaaggctttgaccacaggcacatttgaagattatacttatttctggatacaacctcctttgcctccaaactgaaaggttggaaggatgacgggaacaaactcaagtcaagggattccaaatggtcacatcttatgaccacaggctttatatttggagcgctaccatgattaatgtgtcctcgttgccatcctaagacttccatcattttcttccattgtctttctgacttcagctccgttgctacttctgggcagttataggtttctaacccaatagggcaatttcagtttcccccgcgttttctacataagttgtcctttctccacatatttgtttatgcagtttaagtcttgccagattgttctctctacgttctaaaatctttccaattttgaaagtcttagatcaagtactacgcagctgaaaatggctctgcctcttttatggcatttaatatctaccttggattatagttattataacgaccatagatactaaaactttgaaaagaataacaatttgaattcctttgtcctatccccataggacctagcattgcctctttcaattaataaatgtgtaaggaataaattattttggcatattatcccttgtcttttaaaagtttcacaggagtccctttgcaatcaagttaaaggctataaaaatttaacatctagttgtgttggcagagttgtcagcatttacttcagtttatcaaacttcaatatttatttaaattgaaaccaatcagccatttttttctatgcaaatcacaaatctcatttattaatgccttcccctccccctttcccttactacatcaataggaagattacatcttgacatgataaaaggagacaagctttcgttaatgttaagaatctgctccatggccccctttgcccagaaagtcatgaattctgataatcaaggggcagttgcctatgttatttttttttaagtttctagttaattatttgctcttccttatttgcattttgagatgtaacagtagagcagtttacccattctctcctgaaaactatgagtctgtttcagacaaattactatactaggcacccaccctcagtggaggtgcaggagactctaggcccggaatgggtgaaataccagaagttgcatttgaatataatattgactaattagtcagccagaaatgagagctctaaacatgctctttttgtgtcatttactgcatttgtggagcatctaattataaagaaaataagtattcttcattggttgctagtaaagctgccactgaagggcaaaaagacatatagcaatcattgtttaaatagaagcgcttgaaaattttccattaattttcgtgtttgcattttgaatgctttcttgctcacacttgaggtatcaaactgaacaagtctgaactgactgcgtaagaatttaagcaagaactgggaggggtagaaatgaggaagctatttgcattcctggaagacaaaactcacgtttataatctttcttgatactaaggcagtttgtttcccaaatgctatttatggtgagctttttgtcttcaaatgtttgttataagactcttttttttttttaatcatccagtgcagaagttcatgaaagaaagtgaaagtgcacccatacccccattcattttccagagcttaccctgtttggtacattatcttgttggctcatgttttgcttggttttgtttatgcaactttttcttattaatttgttgttgtcgttggatggagttagggagggttaaaggactggagtaaaaatgctatttatctttaccccttcttcacttacagtgtgtgtacgttgatggagggggtggtggggatagagggtgattttacctgctccatttttgtttctatttgctgctaccagcttgcttcttaaccctgggcagaggctgccctgcaggcaggagcagaataagctgtctgtgcccttcctcttcctatacctttgaagattggtgcctttcactgttttccaatcgcttgttctttccataagctcgttcccttctctccactgctttgacaacaccttttagagttgctcctggagctgctgccaagacaatagtatgttttctcttttaaaggtctaaaccctgggaggagaggaactggaggaattgagtcaatataatatacgaatcactttatattttactatctataatttagtttttgacttccatttctaaggaaaaaattgttttcttttattgttttttttttttctgtttccattcagcactcgtgtactgagaatccccaagctatattaagtcccatttgggccattaatgtgtgtgcaacatggtctgtctgttccagtagagaaaaaggcatataaataactttcttatcactggttatatgctttgaaggagtacaaattaaacaacctgtggaagttcaagtaaaagaaagcttatttccagtcacgagaagttaaatgtgagctgggcagattcataatagagaagtaccgtttttttgtttgtttgtttgtttttaactctgagggccctgtgagcttggtcaatttacatcatctcatgaatgacatagggccctatatgtggaaacaaataacaacaacaacaaaccactgtagagtcatatcaaagaaaaatgaaggtggtattcatccacatcaatattaagataaattattaaatatttataaaactctttgacagtgtacagcctctataattaatcaatgtagcactttctcaatacttccccattttaattagtaccaacatcaatcataattaggctcatgctttggtctctctgagacttttaaaacattatgggtagggggcatttttcaggattcaggtatcagctaagagttcatttagccagtagatcgtgaccattcttcctctccctgaagctatgattctggatactgtggctcttcctgctcctccagacatagagaaaatggacaagtttctccttccccattttgagtgcatgatgtgaaaacttagcttgtccagccaaactggaggaaggagaggcgggacttattggagtaactgaaaagagaaaaattggaatatgagcagtaccaatactcagtctcttaaggaagggtagagtccctttctttctgtctctgtaatttttttcttttttgtttttttttttttcaaagaagattgcataagattctgtctctctaggagatgactgatgaaatataccccctgggtcatttgcatcttactcctttgtagtgtagggaagaacattccaaacccattataagcacttactgttgttgggcatgtcataacaaacacaatacctttctggaatatactgctgagcccttggctttttgctgaatttgcctaaaagcccttctgcctattgagtggccacattctgaactagttatacttggttaagttttcacacagtacactctgggatactagggttgcaacaatttaaaaaagaacatagatggaagctttatatctcaaaagctcctacctttgacttccctgacaatttttccttctcctgctcttcaactctatgtttcccaactttgtttttgtaaacacgaaaagtaaattttttaccattttgtgcctaattcctcttctttctctcttctctttttactcatcacaggaatgtcttagctttccttccttctccaatctgccttgggtatagagtcacgcctttaaatcttttagcataccacaatgtaacttacataaggaaatgtttaatttgggaacctcaattggttttgttaacactgctgcaccgaagctctagctgaattcacataatctcatgattttagtaaaggtaacaaaggaaaacgattatgtaagtacctacttttcaacaaacattgggctgggtttcttctttacattttctcatttaatcttcataataaccctgctagataaggtttaccatctcattttgcaatgtggaatctggagcccagagatattaaataccttgtacgagagtaggtgtgcaaagctaaactttgaacctaggcatctctgacttcaaagtctatgctttttccacctcatagaaagaccatccagaagatcaagtgttggaaccttccgaggctgtgacatatttattacttcaaagtttattatcacaggacatgcatgctgctttagcaactagaagtgtgtgaatgaatattactattgtgttgcataagtccttggcaatattactttttaggtgccattctaatcctgccctgtttggaataattgtgattacgagggcataggagtaattcagaaattttttgaagaaatttctcccacagcattagccttagttatgagtataatacaaaagaagaggaccagccctgctggaaggtaaatgaaaagatggaggaattgaacgattacataacagctgttcagacttgtggtactgattagagtcatttgtagagatgaagcagtgtgtcaagccagtgtgggctagggtatactgggaagttctcacagacagaatgaagtgggttgcggcaagccctgaggtatggcaaaatctggacagctagcctggatcttcatttttcattagttggcttccttaactgctcaacaagtagaccaaacaaacaaaccacgcatacacacaaagcaaagaagtaaataaagaatggtggggctaagactgtgaatagctcctagcaaattagagaaatagcttcaagtatatgccttctggatgatgtatgtttgtatatgaaggacaacacatcaaggggtgttggtagtaatctgtgctaagcttagaagccagtatatcattgttctagttctatttctactgtcgagtggctttatagccttagacaagtcatgtaaccgttcaggccccaaatgtccttctggaattacagggattgaactggatgaataaaaagttctatttcaactccaacatttaataattctaaagttcttagtgagctctgattgctcatttgcattacataggcatatattaaccattttaatatgtatcagaaaaggtatgttctttttcctcagaaatgttgaagcctgactttgttatagaaagcacccaggaatcatgtcttcagagttcctaatttttagtgttttcttgtactgccccgactgctgcaatcctctctcttacattggaattctgttttaagttttggtgattggaatcctctttttgatttaagagaaagaatcctaggggtgaaagattactatactggaaatgaaagattactagtctctaaatgagaattggctttggtctgtaatagataaaaagatttttaagggaaaaatattagaaaagtgaaaacgtttttaaaaaaaataggtagcagtcaccaccgtattctggtggaatcgaattcttgaagattagatttgtgtattcatggaataatctagacaaaatcctgccttgcacatagtggggagatacactaaaatactgaaacagctacattgtattcaggtgaagctacatagatgtaaataaagggcagccagcgggtacaagctgtcaattaagtgttttcaatagtctactccgtgtcgccacatcttaggtaatttagataggtagaagacaggtcattagcactgaagttgagaacacatttgaactccagaatgggattaatgcatctccaaaaaacgtgtattttctaaccctgtgcaaaaattatatttgaaaagattaaaacaaacaacagttttcttcgttctttgttatatgtctttgtacttgaaaaaggtaaaattctgcattacgttttaaacaaattgtgccagggtaaagggtaaaatctccatcaacatctaaaggtctttcttgttcagaaaatgaaggcccctctcctgcattaaagaccaatgtggccttatagatccttatacagagggaacaaaatgacattagacagactctaaggtgccctcaattattcccacgtggtggtattcatgcctttgtgtaattgcctcccaatgagtgtgggagggacctatgatttctagccaatagaaacagcaaaggtcacatgtagtctttgatgacttgtgtgtgattgtgttatataagactgtaacatttgttctatgaggggactttcacccttgtaggctttaaagaaacaggctgccatgttgtcagctgccacctggagaggtccatgtggtaaagagtgagggcacctagtagctgacaagaaactgaagccatcagtttagcagcctgcaaggaaccgactgttgacgacaatcatgcaaacttgaaagcagatccttccccagtcaatcctcagttgagactgccaccccagcctaactttgcttgtagacaatgagaccctgaggcagaggacccatctaaaccatacctgcacttgtgacccacagaaactgtgggataataaatgtatgttgttttactctgccaagtctttattgttttatagatagctaatacaattatgttacttttagaatctaacattttcttcacctttcgttttctacataatagttactaagtgaatgtgacttgttatccccatcctcaaaatcattaagggtcttttatttaatatttgatttatctgtggctttgtgaaattcataaatctgctcctcagtttctggtatctcttcaggagagatgccctcttactctactgtatatggaagttgaataagattgaaactgatagagaaatacttgttgaatcaagttgaattacatgaaatgggcttctttaaaagctgttattaaatcttcctgtggctgtcctagagatgatataacagaacttctgctgggaaatgggagagggggagggaagcgttccatgagctgctctgtcatttgcatgccagtgaaattaagtttgaatttacattaagaggagttttgaaatttaggatctatcttaccaaatcacaattcagcctaacaaatgttatggaagtacaacaggagcccggactgtccattgtcatctaaatgatggatgtgtttaaggtgtttacatcagtgctgtttctcccacctaccctaggtctgggtggttgcctgggattgtttactcaaagacagtagcttgacaatttggaaatgacagaggacgctgatacttgaaatcaaactgtagccctggaatagcccaaacatggtcccagggtggtcttgcttctgacttatgtggaaacggccaaatcttcaactacattctgtagcttttctttattcacccagccaactggaagatgagtacctatcttggaaatttcccagaagcagcaattcatactttccttataactcttaacacattgctttatagtttctgttccaatgccagcaaagcccctctttgaagactcagtttccgtcatgctgctctcttacaacacgctttcctcaattctgaatgaatgagcagatgaggatgctgaaatgttagcataacaaaccaaagtcttcttctgttgcgggacattacatttaatgtagctttatacagctcagatttatttctataggttaagcattttgttaaactattcctaaaacacttctgaatgggtcaccagaaagaatatggagcaatcaattctactgtaacctagccaggcaaatattgactatttcctgataccagcatatgttgtatatttctgccttactctagtgagcagaaaatctgtgaaggtttttaggaattgcctaaagacacgcagttctcaaatggcaggaaggagagtaaatcctagtctttctgattccaaactttatattttttccattaaatgaatacagcatacttacatacatacataagtaatacatacattcatacatgtattcagctgtgaacattttttgggcaccctcaatggcccattcgctgtgttggatgtgatgagggatatgtagatgaataagacctagatcttgcccttatagggaaaaataagatttaaataggttaaatcctagtcttgtgggaagatagaaaagatgcacaaaacgaaagccagactcaaatgagtaaagttagattataagtctgcagatgtaggtaggtaacctgagctttccaagaactgtctcctcacttgaagaatggcagttaataatctctgctttatagactggttgagtggattgaatgagaacacatgggaagatgctggcatttaataggcaacccataatagaaatgttaacatgtgctctggggtatcttcagaggtattgggagaggagtccctgcctaaggaagaagcagtgctgggcagaggaaggaatgtggacttggattggaactcagtggatctggtctccagtcacccaacaagccatgtgactgtggaccaactactaactgcataggcaccttggattccacaattgtaaaatggacatcactggaaagccttcctcatgaagtgattagaacagatgcagataatagcacaggtgtggttgaaaattgtgaacattcatggaaaagttcacttgttttttttttatttgtttttgttttactgtcaagaatataataggagccactcaatttatgactctgtcctttcacttattattaaaattatggtattccttttgccactcctgtggacaacatagccaagcaaatgagcattttagtctttctcgtcgtcctgtcttagtttgccaaaactttgaatactctgtgtgtgtgtgtgtgtgtgtgtgtgtgtgtgtgtgtgtgtgtgcgcgcgcgcatgtttagttgctgttgaaaatatttgaccactatgaggaactggtaaatttgcctgtgctcaggaatacattacatggatgctctggttagtcactttgtactttacatctgacttttcctccatcagagacaaaattaataataaacaatttttaagattttggataaaaaccttattaaaatgcatggcatatttttcttttttcttatggggctattctaagcatttgaaaccttttgatgactcagggtcatcaccatgaccatctattgttatgctctgctgaaactcagtaattttttcctcctatccccccaggctgtcagcggccatctctgctgtcactgtgctgcctttcacagtctttcccactaccttctaaagttcattggttttaatctcctctggtatgaggaagaaacagcaaaattgtcattagaatcattggtgaataggagtcaacaaacattcactagtggcccaaaggagcactcatcagaggaaaaaatgttgttttattttgaaaaattgctattttataaacccagagctgctactcccccttcttttcttctccgttctctttcttcatctttttctttcctttccaaccttcatgaaaactggaaatatggactatgacttcatatgctcttacttaccctctgctgggattttgttctgaaattgtaacaattagaggagtgtttctaaattggatcgcttcagattgtctcagttctctgtgactttaagaacaagctgatttgaagccacatactgttggcagctttcatccatttatttggactatcaagcaagaatgctcacaatctttcatatgaaagaagacatctttatttccagttcacactcttcataataagaagggtatttgaaataaagccaaaaagcataacttacttctctaacttcatatttcagatgcctgcaatagtgggagaacatttttttactaccccaccttaccctcaaatcagtagcagaaaataacagtgatgcattcagacagcaaaaagagaaaataataattttattaagtttacaggaaaggtctcagctttcttaaaagcctatctttaggaagtaagtaactggagctgcacacccaacagaggaagatgactttacttatcatttacttagaaattatctttgaaaggatcattgtgctgttgttagcaaaaaggagcttctgtaaatgtcacctcaaactttgaaatctgggaaagtctcattatgaaacgcaagttttatctttcatactcagcgctggagcactgagtatccttgcattcatgaagactttctggtacagagtaaacggagctgggagcataagtgagaatgcagctccagctgacagacccccagctctatcttcccaggtgcatttcctttttttttttttttttttgtgagacagagtctcgccctgtcaccaggctggagtgcagtggcatgatctctgcttactgcaatcaccgcctcctgggttcaagtgattctcctgcctcagcctctcgagtagctgggactacaggtgcacaccaccatgcccagctacttttgtatttttagtagggatggggtttcaccatgttggccaggatggtctcgatctcttgacctcgtgatccacccaccttggcctcccagagtgttgggattacaggcgtgagccaccgcacccggccgcatttcccttttgtacactaggagctaccgagtaccagaagtctttgttaggatgcacagttctttgctcactctgcctgggacagtggctcaacatctccagtcccctttgagttacctccagaaggttcaggaagagcctttccctccaaaatgttcatagcatttgatctaccttctctaagataagcagcttttgtcacattgtacctagggtaaagatttgtaatgccttaactctatgccatctgtatgcttcctgcggacaggatatgcttctaatttatcagattcccttaagaaactacaccatgatgcacttctcaaagtatgctcttaactaatacttatgggaggaaaaaaggaaggagaaggaaaaggagggaggaaggaaatcgtgtaattgcagaaagtttatgtctgggacccttgtgtaataatgttaaataatactttgacttttacgccatttttctatatacaaaattctttcacatctattttcaccactatcctgatattgtttgcatgatgtgtagtatgtatgtttttaatgtgtgtgcatattgtttgtctctcacacatacagcagccccaacactgacaaatccaaattctatgagtacagggagtttgttgtgttcactgctgtatccccagcaccttgaacagcacctttcaaggaggaagaacctaattcatgtttgttagaagaatgaatgacaatattgtcttatttgatcttcaccataatcccgtgaagtgaataccgtattcatactgtatcctcgtttttttgcagatggcaaaactgaggccttgagacctgctcaggtttgcatagctagtttttggccatggcaagatttgaattcaggtttttctatttccttattctctcctttttgtcttctgggaatttgctatattaatagcaaagcaagaaatgtcacacaaagaaaaattgtttccaattttaaattcatgatgcatatgcaagaaattactgacttttcaatccaatggtaacacagattgtgtgatttttaggaggaagagcctttcttttccatctcttgcgtttattagcatatgtgtcagtgcacacacatctacaccgtgcagctctcaccttgtacttttccagtctgaattcgttttgtaggctgtccctgccctgactatcccaggtgcctatcagggctgtgtcttggtcaggctaaggccaagcaacaggcaccagcatttgttatggttaccttggcaagtgaatggggtttgagggaagctggagagcaggcatttcaggagtagaactaggccagtctgtttttgtaaaaagttgatattcaccctaattgtagctcatgttggcaagcggagtaaacacccatgcaaattactaagttgtactgaatgtccaaggatgtcaataatcatcttgaaatccaaataaatatattttttactgaaacggaagccaggcaccacatgcagtttctctctgtcactggagacagatttggcacatatgcatgagacagagaagggcaactcttcaggccctaatgcacacaggaaactagggatgtgtatatcatacttggcagcaaaatagaggtggggcagccatcactttctgttctcaagcacctctcttttttcctatattttaaaacaggatgaccacaaagaagaataaggtatacagtagcataggatcctaaattaaagcatgagggaaagctagcattagtttttcatctaaagtccatttgggtaggaatgagtcagtgcaaaactgtacaaaggtgatcttaagtcacatgttatgttaccgactctgtggcaatggctgtgagtagtccaggaactctccaaggcctatttttaaattcacttagaccaagcataatgaggtaaagggatgtctatacacattctcaagtttagttctctgaccgtgagtcagactgtgggccatggacctgggcgtctcagtggtagcaggactcattttttccccttttctttctcataaatgacttaggagacacattggagaaccctatgtgctccttttactggaattatcttttaaggaagtactgatttcacctcctgtacatggtttgctgagatggcctattggggtttcccaccagtccacaactggaagtttctatttgcacattttgactgctagttctatatttagtcaaaagcctgccttttgcctggtttcttagggaaatagtctgtaggagttgctgtgtccatttgccttgttcacttgggtatttatttgactgtataccctgattatttcctaaattaacaaaaaggcacagggccccaaatgaaggaagaccccttgtaatttgttaaaaaataagtttatgaaaatgtgtcgtcaggaaatcagagttgtgttgcggggtggggagcatgatatacatttgtgtttgtatgtttctaattgtctacagatttatggcctactgtaacaaagccattgtaagtgtacagtgggagggtcaagaaaccttattctatggattcaaacacattatgcatacaatttacacgtaggcacaaaaatatcccttcaaagaccctccaataagctatggtatagttgaggaaacactagacttgaagtcgggaaaccggagtgttgtcattttaatctcaggctatatctttacatgaacaagagaactttgtgttatttttcatattcgaactctttgtgctgaagattctgcagtcaaactgcaagacacatacgcattggctgatcagaaatgacataaccattcttactgcactgagttgatattcagtcaataaacagtctaatctcggttaaatgtttgcatatttttagacttttaaaaatttgaaatcagcctctcaagttccattagacagttttatcacggacacatcaagttccatgtacaacaggctgagaaccattaagctacaaaatttctaaaattttctccaggttctcagttgctaaattctctcttgaacatttttggggataaaaaactggcagagaaaaagaagaaagtacacctttttacattatgaaacacctatgttcaccttatccatggagttatgccagtgacctaatgcctattaagttcttccatgttccaaaggtctttctgtacttgaaaactcataggtgagtcaggtccttcactgatagcttatagctaaaaaccacttgggagaggggctgtccaggtcttatgtcaaaactttgtcccatacgctgttagtgttagaaatggagccgtcagcaaatagaatctgttgtttcatttaattacttttcaatatgccattaccagaaatttttatgtaaatacatattttattccctgaggcttgtcaatctgagaccaaaattatacaacactgaaaaaaaaaaaaacaaaattttctttttactagttctctccctgtgttactgtgtcatctctcatgcatggtataggatgatgatggtgctcaaacttagccaaagactcttttgttggtattcaattggcagaattaatgaaacaaatattttaagatccctgaatatgtgctaaaagcatataactacactactggctagtcagtaattggtgcctcagaagagttaggtatttattcatttaccaaatacttatatgtcaagcactgttccatgtgttttcttaacccatgtcattgttaaaacaaccctttgaaatgtgggtactgtgattatttccattttgcattgaggaagctgaggcacagagaaagtaaggaacctgcccaaggtcatactatcaattgtagtggtgcaagacagtgggctctgaagtatgttctctctatgacgacactgtgctctgagggagtgagagaaggaggacattgtttggggcccagtgaattaatgaacaagatatctgactaggatctgaagactagcagaattgaccctacagagaatgtttgaccctacagagaatggctggctgttggtgttcacagccgtgagcatagtgtggtccacagcctcggtgtggaaaatggtctctgtggttgaattgagagaagagcaaatgaactggtctggaatagggtgtacacgtaagtagaagataagattgaaaacaaatttagtgccaaaatctgagggaccttgagccccatgccaaagagtctgtataccttatctaatttgtttaatggggccactaggcaattacgggtccgggacccgcatggcaagaatgccttccatccacagcagcccttgatgtgaggtcagaaagctaactgctaaacttgcagtcctgagggaacaccctcaaatggataaacccagctaagcaagctggaccatttccttgggaattattcacctctcaatcaaagaaggaaacttcccaaattcaatccatttgccttaacgtggtgtcccattaccacgaatactgagttgtatacattcttccctagctcccttgaacaagcttctctactacttttcttaaaaaaaaaattacccatttatgacttatttattatttatccccttcctataagggaatgtccactctttgagatcctcattcttcctccatcatgatgatgtgatgatgtaatgatgtagtcaaggcgcttccctggcctaatgtgtatgagggcaggctttgaagtttgacagtcttaaagctagagtggtgtcatgcattgctcacctctctaatcccagatttcctcctctgtataatgggataaatacctttcctatgaacattttcagatttttaaatattaataattcatatgaaatactcagcccagagctctgtacaaaatatattactcaataaatgtagccattgatattattaataatattattaaatattgagaatgaattctaccaaagtgcatggcacttccagtggctgattctgttttatgtagccacaggcctttaccaaaggcaatggcaataaagagagggcacagcaagatctatactcctttaaactaaggtaacccacttcagttagtccccacagcttctcttgcaactcttaccctattagctgtttctggggagaaatttaatgggcatagatactgggtggatagaccataccccagtgatactccagagagtgaaaaagagaagttaacacagggcgtgacttcctatgtttaacttgcagttcttatcttacgttgcccatcagaattatctgtggcatattctaaccatattcttcctaggcctcacccctagagatactgaattaattgttcttgtgggtagagtcactgttatgctttaagcttcccaagtgattctgatgggcagccaagactaagaatctatgatttagatagaagatgggaagccgagggaggccatgggaaagctctgatggtgagtatgggaagaatcaacataaaacaagcactcaacaagtgtgcatctagttgaagccttgcttctcctgcatttgttatctcagtgtgctatttaaaagcagcacaaaaaacaaggagtgaagaccttgatatcaaggatgtgaaagctacttctaatcttcaaacagatattaggcaggggctttaagacttcaacttgagagaaaagctaaggcacctggtatgtgtgtgctcaagtgaaatatttgtgctgactgagggcttcaatgtcaggctgtctgaaaggacacaatatcaacagctttgctgtgcttgtgtatgagtctttaaatgaatatatctggttatagcttatctcttttctccatgctccctcatttccaatttccaggtaatggagatcatctagttcggtttcagctgctttattttgcagatgagcaaacccagtgatgcctgtgatctagatggaggcagatttcctctctcccccaccctggtataccatagtctgttctaatgctgggatcaaggatgaaagtgctaatttgggagtgtcccccactttcttactagctgatatggtttggctttgtccctacccaaacctcatcttgaattgtgatccccacatgtcaagggagggaggtgattggatcgtgggggcccttcccccatgctgttctcttcatagtgagggagttcttatgagatctgagatttttaaggcagttttccttgctcttgctcgcttctccctctgctgccaccttgtgaagaaggtgcctgcttccccttctgccatgattttaagtttcctgaggcctcctctgccatgcggaactgtgagtcagttaaacctctttagaaattacccattctcagggaagttttttatagcagtgtgaaaatggagtaattcaatgaccctttcttactgactcattggtctgatttcttgaccaaagctctgaatattcccatgtcatcctgtctaaccagctgtcttatactctttttttttttttttttgagatgaagtctcgctctgtcgcccaggctggggtgcagtggcacgatctcggctcactgcaacctccacctcccgggttcatgccattctcctgcctcagcctcccgagtagctgggactacaggcgcccatcaccatgcctggctaatttttttgtatttttagtagagacggggtttcaccacgttatcttattcttaacagtgtctgaggtatttttttgaaacacaattcttaccttaactgccccaggcaccacggcagaagaaccatgaccttgctgagaggcactgcatgccaaatgagacttagtttttccaaagtacttgggagaagaaaaacaataatctatatgatgggcttttggcctaaacccatatcctttagatgacggaatttggcacagctcatattctggtttaaagaaaaatgttttgttatgatgtcatttgcctaattaatagcaaaagaggattgaattttccctatgcaatgtcatctagcctttgagattttagagttaatgactcaaatcaattgtcctgtcttctgtgaaaccttcctgatgccttcagttggataaatctacccttggtgttcataaggcattatattgatgcctctgatgttatgcagatatatcccttcttggctttgtttgcccattcaatgaacatttgttgaacaccacctatatgccaagatagttggaagatggaagtgtggtacacagaggatgtggaagggaatcacagaagatgagactatgaaggcaggcccttcaaggactttctaagtagtactcaggagtttgacaaagaggagctagaagaggtttgtgaagtcagatgagtaatataattaggtttgtattttatgaagggcaacatctaaatatggcttgtctattcagcaagcacttattaagtgccttttgcatggtagacaacatgcttgatgctgaagatacaagaaaaaatttaaaatggtccttgccctcaaggagctcacagtctattgagttacctttctgactttcccactagattgtgagctcctggagggcaggcactttcgttcatctgaaaaagagcttaaatttcagtgttaatcctagattacaatcccgcctctattattttaactttgttcacatctgttaactgctctgaaaatcagagctaatactgcctacctcatcagggaaagattaaacgagaaaagaatgagatgtgattgacacagcaggagctctgtgtatgctatttcctcctctatctctgtgcctggtacatggtaaacattcaggacacttctgctgcctgcttggctggagagcctgtctatgcagcctcagtgttgggaggatttgagcctggggtcggcctggcacccagctatggtagttagcaaatctatcctcagctcagtcagtgatcaaatcactggctctaggctgtaaactaacagggccagaattgggttctggactctgaagcccaggcatgcatattgcaaaagtcagaatcgaagtcataggaaaatgatgaaatttcctttctggccagaatgctattatttcaccaagggcaacaaatcttcttggcaggaaaagttgacttgcttgtgctttgtgtaatcaattgtatttgcaagtgatggagtccttctcacagtggcttagaggaggtgttaaccactattctactctctacttccatgagatcaacttttttagattccacacttgagtgagatcatgcaatatttatctttctgtgcctggcttatttcactcaacataatgtcctccaggtttgtttgacatttcattgttttcggagaattttcacagttcattatctcacttcacagttcctaatagtctctctgaggtccatatggtaagaattagtaccctttactatatttgttgaatcacaagtgagcggaggaatgggtatagttgagacccacagaagtgaagtgacttgcccaaatccatatagcttattatgctacctgtttgttagaggtttcctgttgtatcagaaactagtgagataaatattagtaatttttgtcccattgacacatgatggtatatcaggaattctgagctcattttttttttttggctcaataagtgaccttagaaaatccagaatgggatttttaagttgaatatccttctctgacctgtgaaatcactgcatctgtttccctgactttatcacaaggtaacccaagatattgccaatatttacatgtgacaaactctgaaagatgtgcataatgctcccaaaggtcatcatcttcatacctaccttataaagtgcaaatggaattgacctagtctagaataagcaggcgagatgcagagagattatgtgacatagctaggtcatgtgactagtatgcagcaggcttggggcataaatcctagtcctctggctcccgagtccagtgttcattacgctatgtgacatgtcagtattgctgtttgctcggggttaggcttttcctttggaggttagagcttgataactctaaatcgataaacttcttagtatgccacagtaatgctagcagaaagtatttgttgaagcaaaaaatatgttgtttcaaggggtctgctccctgaaagataagtttttttctttatttgtggttttacatctaatttttctaatgtttcaaaaaacattctgtgttcctttaatctacaagttggaatggatacggtgccctaattttcgtgttccctttgagcacaagcaataacacattttaaaggatgataaatagctgtgtaaaatgtagatgggttctataaatacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactccttaattttcatgggcctctatttgtagaaggatgctaacaatattatgtgtagtttttagaacattcatctagtataatccctatacattttaagtaggtaattatgggttatctctcatgactgtttttatcttcatctgagaccctttctttcttcctttaagatacttctatccatatttttccctagagagaaacagtattagctactcctgcctgtcagtttaagctactgtgtcatgactattttgcatttctaagtttatccttacctttatcatcaaagtgctgactaatgcagtatctgccaccttgtgcctgctcagtaaatacaatttgggttaaactttattcatttttagttatgagtgcaatataatgacatagctaaaagttcgaaagtagagaagggataacaaataggtactgataatgccactcttgtaatactacatgtagctgactggtgaaggccatggactatagagtcatactggaatccaggcttcagtgccttgagtgctctacttagaaatctgtgctttaatttccttagcactgaatgagggcaataaaagtaaccacctaatcaagatgcagggtggatgaaatacatctgaagcatttggagtaaggcctggcccaaaggttagctgtaataataaaaaggtggatggtgacgatgtacatgatgatggtttgtgtgtccctttattcatattgccattcacaaattacttgagtagtcctacttctcctgtttggtttatttgttgcaagaaacatgtgcattagaagattgaagatgattgcgcccacttgaggaaaccggacccagagaggtgaaatgatttcctaaatagcacccagaaagtttatgatagagaggaacatagaactctagcagccaggctgctctattcttattttctctatacttttcttgttggaaaaggacactgttgactcctagttaccatctaacattgtggtccaagctacagagacagtagagcacattaagttctttcagtctggcttttatgctggctttgtgtgatagtgcctcatatccactgaaacgtaagtacttaaggagtggatgggaagtattcctggaaactcacagctaagcttttatgtaaagacagcacataaaaaaaaaaccacttttcataactttatggaacctgcaaaaaaatcttggcttccttcatgatgcttgcccctagagtgtcagcatagcccttgcagagaaaccccaggatacctgtatttctccaccctggccttcctctgagcattgagttgttagcatcaaaaaatcaccacagccacgttgatcctcattttcttcagcctctatagagcctgctatgccagggtcctgggtaatctgcagacagctgctgtcatgcagcctcatatatgggttgactttaccagcaaagaattccctcaccttcgagacatcactgacatcttcatgcacagcacagacaatgaaacaaacaaaaaagaacaaagagggacataaaggttggaggtcatttacatttgcatttacttgaaaggaaacatgctaacttgttgacttgactcacttgatgtactttttcgagatttcacctggaatcttgttcttgctagatctctggatatgcaaatcccatctttgtccaagacctaattcaaatgccaccttttcttgagaatgtcccttcatctcctgagctacaaccatctcccctttctctgtgctctgatagcacatcattaaaacattttacttcggattgatggacatttttgtgtgtctaatattttctactatatcttctagagggcaagacctacttctcaatatctttagcatggcacttactaggcactcagcaagtgccctttgaataaatgtattatttgcaatcatctcttcaggtatatgtagtttttgtgttagaagcttgctaggttgcatcttgcaagagaaacaatgtgatccttcacatgtacttgttcttctccgaatgactttctatgcaagaagcactggaggctgagttcatacgttcagcattgtcagcagaattgagtcctgaatgacctgggtcagtcactacattagatgatttgattagaaaaaagaataaagccagttataacttgttttctgcctattacccaggatatttagaatgatggagatgcagaagcatttagagtttttgatgatactcatggtggtatcatgaaaataacaccttgtgtgtttatggcacataattacatgaaactcattttattctcattagagtgtcaccttgaatcctgttctttttggtcttaatgtttagtgattagaacttgggaagcaatttctagaaccagaatggtcgggtacaaatcctagctccttctcatatcagctctgagaacttgggcaggtaatttaacttcatgatgtctcaatttcctaatctgtacagtggggcagccagagtacttatttcattgtattatttgagaagtgggaggacatagtgcatagtgattctataaatattactattgcaaccaccaggctttgcataaggccctaagtcaagaaaactttcaccgtttaacagagatgtttctctctgaaaggcatgttatttgagaaatagttgttgagatgaaaggggggaggcaagatagaggccagcttgatgagggctttgaactcagccctatcaacaagaagaccatagggctgcatagactgaggagaaacactctttgtttgtcgaggaaaaggaaacttgcaaagggatggcaccagcgcagcccgacagaattctctgtgggccacatctgttcatgccagctgttgtcagtgtgtgtcgcctcgccgagaataacagcaatgattttcactttatagcaacttccatcttgggatctcagaatgctgcataaatgtagattagggctcccaaaatttttgccaagaatgagcatactttacagagcatcaagaatgcgtcactcttctgagtgaatctttattggtgcaaagagaattaaacgaatattgaattagaccttccttcctgatgtgagctttcttcttgattttactccttattttctagatgaccttgaataactcagtttccctccttgacactcagttttcttcttataaatgaagggattcatgtactactaaatggtctccagtgtcttttctgtttctgaaattcacagaaggcagggaatctaaagttgcctcccacattttagaaaggcctaagttgttgtagaattgaatattttcttagcattttattcatgatatggtaagaacccggcagaaaatttttcagtttggtcactggaaaatgacactgtcctttagcttctaatgtgaaagaatatagtattatttacctgtttttccctttgcccacctttaggtacagtactatttattattttattttactattttaagatttaacattaattctctagcttatatctcagattgataagagcagttctacttcttttgatgagtcaagtgaatgaatgaagacattaaaaatgaccatgtcggccgggcatggtggctcatgcctgtaatcccagcactttgggaggcagaggcaggtggatcacctgaggttgggagttggagaccatcctgaccaacatggagaaaccccatctctactaaaaatacaaaattatccgggcatggtggcacatgcctgtaatcccagctactcaggaggctgaggcaggagaatcacttgaacccgggagtcagaggttgcggtgagccgagatgttgccattgcacactgagcaacaagagtgaaactccatctcaaaaaaaaaaaaataaataaaaactaaaaaacaaccatgtctctcaaagccttgtactcagaccacctgcatcagaattagttgggggtacttgtaatatttttggtttccatctttgtgcgcagagagactatatcattaaaaaatgtttgtccttaagaaaggttcttttgatagttcaagactttgtaatgtatgtgaaattccactacaaataagtggatgggttgttaaatctcactggcaaaaggcagatgagttgagagactgaggcacttttgttgcggttaagcatccctttctggaattgatgactggattcaaatcccaggttctccacttattatcacggtaatctttgtactccagctttctcatttgtaaattcagaatagaagccacctaatatggttgcactggtgatgaaataagttactcaatataaaacattttgaacacctactaagcactcagaataccttatttatactcttgtaaattatacataaattaatacataaattaaatactaatgtatttctacctttcagagtttgtgggaatggataaaagattccttcaatatgactactattattttaatcatggtcagtgattgattagaaatattaaatgttgctggtctttagattcactgtcagagcatgatctttcttcccctcggctgcagtgctgacgaataacactgagtcattcatattctctcatccaccttcctgccacatttgaaagacatccatagctcatatttgacagactgtgtgtgagcatttaatacaaataatcgtgcgccactgtcaaatattagcacatgccatgtgtcttcttatgtattactcacagtggctctcagatgaaggcatctacccagctcctctgcctactttcccaactccatttacaggtgaagacgctaaaggggggaacaaaaaacttgtgaaatgttatacaaaactggaggtataatttggcatttgaaccagcttgttctgcctctgaagcccacgctttctccattataccacaatcaatatttctgaaagtaaaaaaggccacattggtctccagcttctggtctaattagcaccatactttaatcagtgagtttgactgtcttgattaacctttacgatagaccatgtaagtttcatatttctaaatgaatatatagagatggctgtaaattagtggaaaaacactaagctggaatcaaaagactcctgcctaactcttggttctgccacttaatatgggtatgattttggctaatcacttaacaaaccactaacttggtttctacagaaagaagaaatgatttcatgcattggacaatattaaataatctagtgtgtgtgtgttgcacccaagtatcttttgactgtaaaagcacatagaaaggtgaaggaattttaatcccatggttgatagagtagaatgccacctcagttcctctgaattctgtccctcattcaagtcctaattcaagctctttaagcacacagtactctctctctctctctctctgtctctcttaatctgtatcatccattgatacacttgaataatatttatacatcatagtatatctttaaggatgatattagtttcttaattggtgtaggctggaccatctcatttaacttatggctcatgcctgtaatcccagcactttgggatgccgaggcgggcagatcacttgaggtcaggagttagagaccagcctgggcaacacggtgaaaccctgtctctactcaaaatacaaaaattagacagagaaattgcttgaacctgggaggcataggatgcaatgagctgagattatgccactgctctccagcctgggcaacagagagagaatccgtctaaaacaacaacaacaactcacaaagtaaattctatttaccccattttatttttgaaataactaataggtagtaaaattcagcatcctgcactggatcatacaattggtaagctgtggatgtgggatttgaacccaagtaagcagaccctagaacctatatatctaaggcatactgattactatcaacgttcaattttttgctttgttcttttatttctccttcatataccttgatttcctgactggattataaattctatgaactggttgcatctcactcattttgatgactgctttaatgcctaattaattactattatttgtggataatttaatatagatttcataggaggctatagtttgctacactgctcgtgtactctagaaacaaggacccttgacttttttctcttctttggctataagcttatcttcttaccatgttgagatactttgatttgattttcactggtcaagcaaaaaaacatgttcttgttattttcacttaggcactttgtctgcctccctgctgaggcccaaaaattcagtgtgatcggtgtgtctgtcagaaggtaggattgcttgcctagggtggcattgttattgaacaaaacacatgccctttctttgcatcctaagtgtcttggattgctgagccagaaccgctctgactcaaatgaaaaccaccttgtgttaggtgaaagatggggagttaaccatttgtttgctggtttgcatttcccacgaaaaactcaaaaacagaaatttacctcgccatggaaagtgatgtgccaagcgtcatatttgcatattaaaaccgaaaactgatttgcatgttatttcagtgtcttgtgtcacgttcaggcatctgtcaagcccactagacagaaacagcttgtacagtaggaaagtgtttttatgcatatcagactgaaaatctaggtgccttatttttatcagcaacttgtccacactttgggctctccaatctctcctaggttcatacctgaaaatactaaagaaaagtctggaaccccatgttttataaagtatgtttcctgttattttctaagagctatccatttttataatattctgtttagataattttaaaattataaagagaaaaactcaaattaatcataatatcacaatcctgacataagtcttgttaacatttggatatattcacttctagtagctgtttgataatacttacataggctaacatatactggcccttttgcatatatatttttatacatttgtaattatcagatgtactattttcatatcttcttattttttggcactataatggcaagaattatgacaatccaagtatctaaaataacagattaataaaatcttattttgagcagacaggaaattagaaccagtcagggctggagccgtggcaaccgaaactctgtgccgtctttttgatagtgctttattaaaactgtagcttgtaattgaggatagtttttctatgggacaatgcatagaaagctgtgcatggtgataaaacctttttttcccgacattagagcaactagcccattgcattcttccaggcaaccaaatgaagatgaaacgtgtgcctggagtcactgccaggcatgtggggcacagcaaaggccaaaatatggttttagtttgaaaacccaaccttgaataatggttcattctattcatcaaacttttaggtcatgggtcttgcctaggtgaagccatccaatggaaataatgtcttggaattctcttgcctttattatgtcaaatctctaatatataacatccataaagcctaattaatgggaaaaactgagtgtatgttttagccataacattgtggaaataggttcttttagtttcacacaaatagagatcttctcaccccaccgagaaaactcgctttctcctttacggagggcccgcatggaggtttagagggaaggaaccctgaaatgagaactgtgaataaggttggcaggagatctttgacctagattctcctcgactctgaggatttggcgcttctgctctgcgactcgcttttcttacttcttgcctacccggcaggataacatcagtggttgtaccttgtctgccgaagcctaagggaggctgctctgctctaaatagccaagcatgagctttactttactatttgtcttttggtcctaaaggcgagactgtacaagaattaatagttggagaggcagcaaggcatacgttcaccaaatggcatgaatttcaagatttgtagctaaaaagtactcagagtaattacatcccttgctaaagcaacaattaatgtgaaattcgggtacactacactgaagtcctttatcagcagatggaaaagtggagagttactggagagatctcattctgcaaacattctgcttccaagaagaaaatcatctttgttagtggtttctaagttgtccctcttgataattataactgacatctatttgatatttaatatgttacaaagcttcttcatatgaatcagatattattattctccagtttatatatgagaaaatcaacaatagaaaaagaaatcactggagaacttaagtagtatcttagacatcaggcctaagagccagatgctccaagcccaggcactattatagctgccttgacacgtggagacggagagaggtgggtgtggagagacctcactttcccccagctcagcctagataaaacccttgtgtgcagagaccagggccccctgactggatgcccaggccttttcccagctgcagtaactcttccaacaactcctcctgtctgtaattcagaatcatccatccttggctatgactccaaatttggtttaagaaaaggcattttatgggcatcgatgcatggcatgagaaagggaatatgaggaagtagagattttaagaaaatcaagatttcgaaagttgaagatcaactgggatgagtttcaaagcaagaatcaaacttttaaagtcaaaatttctgggtcttcctctttgtgtccttaaaattcattcttcaataaaatggaacataagaatagaagaaccaagagcatgcttttctaatcccaaggagctgtgaggagtgttcatttagaagatttcaattcagatagtcaggtatccaccttccacttctttccttctctgtggccatcgcttttaacctgaaacagaagaggtatccagcaaatcatctgcccctggccagaaggggttctccttccatttaagcagtgagatgttgagagtagagtataattcagtgagagtcaaaaagtagaagcagccacaggaaattgcaaactgcagacttgacacagctaaatagaaggggggaaaagaacgaaaatatcagaaatatattttttctggcaggctttcagctctaaaacggggctaattctaccttttgaaaagaagataatttcaatgtttcttttttttcaagaacacataattgaagttattttccctctgagggaaggaacctcttgtacatcactacaaatggacaagaaaaatgagcagctctggtacccagagtgatagagtattcattatcatgtaatctttttgaatatcttggctgccttttcccggtgttttatccgcctgagcggtgcttttctggtaaggttcagatttgcagtaaatttgagttatctaacaccatgtaacaaagaaatcaacagcaggtaagcactcaagaaagaaaaatgatcacgccaaggtcagccccagaggaactcagggggctgacattgcgacagatagtgggtatccattttgtaaattggatccttagcacacaggttaaagtaggtaaattgtagtaacaaagatgcaagatggtgtggtgttttcctgggagccatttgcaccttagtgcgggctgtttcccatgcttcctttttcctttagaaaggatgatggatatttttcttctccactcagaaaaggggcagtgggatgataaggtgattaacctttgtgtgttcttgatttcatgccccaagtgtagtgaaagttcagtaggctgcagaaaccctgtgacctgcccattgcttactcagattcagaatgctgaatgaagttctggatgtttcaggggatgctgacaactggcttaagtcctctcataaatggaaatctctgtcataatgaggtttccacttactcagtgtgtctatttttatagactacaaaggatctgtaaatatgaatatctgtgatttcactctaaagattggtaatgatatgtgtcttgcatactatgggcacaaatgggcacaaaaaaatgatagagtagaaccaaaggaagctttgaaaataacatgttacacataaagaaactgaggctcagaaaatggaaatgatttgagcaaaatcactggacaacttaaaggcagaactaagattaaagatattctgaatagtcaggtcttctgtatttatgggtttctatgtaaatgtataatcaaataccatgaagtgttatatgaatatgacagatactgttatgtatgttattcttaatctagtggagtttccttcttcatcaagggtcctattcatgtgtacattttgtttcagaagcaagtcttcattactgcatagtcccacccataatgtttaccagggatttagacccagatttggctgtaaatttggcttcatattaagtattttcttgaatgacaatcacctgggcccctagcaagaaaagaggaatggcaaagaagaaccagttttagataattttcagctgaaaaaaaaaaaatctttattttaagaagggaaaatacagaaacatagaaagaatataaagcattcaatttcccatgactttcaacgattaacctttgagcatattgtattgccgtaaggcaggtcagcctggccagcgagtgacttatctccatgtggtagttcagggcccagtctccatccttcctgtgcctcacaaggccacatctaactgcaaggagcatgggaaatgtagtctagcagtgtgcccagcaagaggaggaaatggattttggtgagcagttagcaggctctgccatgcttagtaaacatcagtcctttttaaagcatattagccactaaattgctcagaatgccacgatatctggctgcgttttttttttttgaaagtgtcagtggtcttggtgttagaagatgtttgccaatacacttacttcagaagcatgactttcataaaaactcagctcccatttttaaatctcataatgacttcccattacttaaaacaggcttggcattgaccatatcttacttctcttttctcatcctagttctgtttttttccctttttttttttttttttttttttgagacagagtctcgctctgtcgcccaggctggaatgcaatgatgtgatctgggctcactgcaacctctgcctcctgggttcaagcaattcttctgcctcagcctccagagtagctgggactacagacaccaggcacccgccaccatgcccggctaattttttgtatttttagtagaggtgggatttcaccatgttagctaggatggtctcgatttcctgacctcgtgatccgcctccctcagcctcccaaagtgctgggattataggcgtaagccaccacgcccagcctttcctcttaacagttttttagatatacatgttcctcctgaaatgcctttaactttcttccttctttcttttcttcttcttcttcttttttttttttttccggctgttgtacgcaatttattcttcaagatcaaactacaggtcatctttttttggcagccttcttccgtctcagaacactgaattcatacctgtgttttagagcttagactttattgtaattgcctattttcatgtctctttcttcccaaactgtgagttgttagagacaggatctctgaataatttgtctttatacttaaagttcttggcacttggtaatcccgtaggagatttatgttaagacaattttgacggagtcctctaaaatctgtcgctcagtaactcacctgtggatcatataacgttaacttgcctttagtaagagattcgggtatttcagaaacaaacatattagtgattaagattgatacttacaagaatgtctttttttaagagaaaggtttgcttcacaatgtctttgttttgctatttggcagcaaacctccactctgataaaagaaatctttgcttagataatagactcagactaaaatccaaacagccgcacagtaagagaactagaaagtcttggagacaatgatatcaaaaccccgagaggcattgcagtgaagaagtatgcccaactcagcacaccccagtttcaacgttctgctgtttttaagcagcggtacctctacaaggttgctcacttatcttcttaagtctctattttctcatccagaaataggattacatgtcatacagggctgttgtgtaggcatttgagatttcacatctgtgaaagtaggcatcttgaaaagggtcttgcaaacatgaggaattaatatgctacagtgaatatgttgctgatacaactcacacttctacttctgaagaaacgagaaacaaaaataacacaaactattccctttcagcacctcccaccacaaatattcaatcgtgttttattacccatacaatatgctagaagttgcttattaacaaataagttggacacagttgttcatttttcttaggaggtattgagccctaaacactatcgagagagaggtattagagtaggtctctgattatgacagtaagaatagtactggattactgcttctaggctcgaacactgaaagttttaagctgtcttctttggtgtaagagacaactcttaacggaggaaccctgtgtttctccatggtgtattccacaggtgttaagtattctgcactgggttagtgacagccgtggagtggaggtggaggctgttctctagccaaataaacttcagaaatactgaaagaaatggtctctcagaatctttcatcataagaaaaaaacaggaatccataattagcattagataaaagagtagaatctaacagaaaatagcctttccaagtgttatttcagaaacagcatagcaagcaaatagagtattcagagaacaaaaagaatgataacgtttttctcaaaatctgtgaaatattgacaaggtaagtactttgaaattagatttatacttgaaatgtaagtgctaggggtagaatctaaatttctggcttagatttataaaggacaggatcggccttcttgctgccttgtctatattgaaagggaaactgatattaggttgagacaatgataaattgtgtctgttctctgagggtccatcctaagactgaagacaggaattatcaagttttctctaacagtcgtttggcttaattaaaacaacttgcaccattattattagaggtaatattttatacttttctagcactctctgtgggaagcatcgtttgcttggggaaaaaatgcatggcacttggagacaggtgacaccatattttgggctcaaggtctccctgtattgcaagcctggagaaaaggtgtaggtcacttcccaacctcattttcaattccactacctgaactgtaataatccactccctcagaggcagtttgagagattcaaagagatcctctttgttacaattgtctgaaagtagttaaactctatttatcatgaaatgtgggttatctcactttaattcttacagagactgtgaggtaccactggcaagtccattgatagaagagaacctgaagttatgaaaggttgacaagctcacctaaggatgccaagtgaaggtcatagtcaaatctctgtctctaaccttaatgatactgccgtataatgtattcctttatctctggccaccagtatattagataaactcaccatctcatttcagtcttgctgctctcccattcaccctctacttcagcgggaactttctaaatatgattagaacactcttctaaaaacacttaccgtggtttctaatgcctggatgttcctaattgagaacatgcaaatatattccccgtggtctgtgaacttcttgaaattgtaagtaaattttgtgtacactgcagatacctgttttgttgttgttgttgttgttgttgttttgtcaaaagacagtttaacacattagattttgagacttgtccacgttcttacccaaggcctggagcccctagctcaccgagaagccctaaacatctcagcatggcatggaagcagtaattaactgacccttcctatttttccacctgtccagaccgaaatactgaaccacttgtagtttttcccactcacaccaaactacgtctcaactttgaaactgtgctcctctcagggtccttcacttggcctgggttggaagctccaggatagcgggtcatgtctagcatatctttatcacttgaagtcatcatgtttaaaaagatttatattcatggattacaaaagtagaactacttgctgtacaataaagaaacaaatgtagaaagtgaaagtcccctaagattccacctgctagaaagaatctcctttaacatttccgtacctggtctttatatagacctgtaaataaactgtagttactttatcctattctgcagttggatttgttctttatgaaacatgtcttgttcatctttgcaggcttgttccatagatttacaatgtacgtatctgtcattgtctatttaggtgattcttttgctggttagtttaccttgttagtccttgttcctcctctcaaatatggctcctgtgaccaaccttcgtcatttaattttattcacttgtatgagtacttctgtacaattttcctggaagcaagtcacatgtatgcaatttaaagtttaacaatactggcaaccattcatccaatattcatgtttatgcaaatacctatcaatatactatgctatatatatatataattttttttaattttttctttttttgtgtggggggaaaatagaatctccctctgtcaccaaggttggaatgcagtggcacgatcttggctcaaactgtaccaccgggttcaagcgattttcatgccccagcctcctgagtagctgggattacaggcgtgcattatcacacctggctaatttttgtgtttttagtagatacggggtttcacagttttggctaggctggtctcgaacttctggcctcaagtgatctgccagccttgatttcccaagatgctgggattactgatgtaagccactgtgcccgacctgtgctttttataattaatcatttgtgcatgtttcttacccccactagactgcaaaactctcaaaaacaaaggttgtgtgtaatatatcttcatgtccctcctgggttcttacagaaggtacacaaaataaaccctgtaagaatgagtggataaaacaataaacaaaagaataactgaataattcagtagcttctctaatcctcatatgacaggtaatgtttacagttcagaggaggtcctaagtttaacctttaatgtttgctaataaataagtcagtcaaggatgagctcttgtcctgactttatcaaaactagccctccctgatttttggggggctctcagtttccctgtctcacaaagaggagattagcataatggttcttcagatcctggcaagcaactcaattttttttgtctgtaacctgagcatatgccatagtttactcatcactgtctcatctctaatccaaattgttcaacaatgcaataaagtctcaggctaaggttagtgaccagcataaaatatttttggccttttcagccttctgcgtgtctgtacttcaaatgtctgtatattttgggaaaccaaaaaaaatggaaattattttagagaaaaggccaaataggtaccaatcaaccttcttgactatgtttagaagacatttaacgctttagacatcacacaaatgattaatacccatcttggagttgtagtaaatgttgggaatgatagcatgtgttcagagatttgtactttacaggattttcacgtccaagagctcacttggtgtagtgaagataataggagaatgaatatgtagctttcagttttgttgaacttactcttgtaaacattctgaaaagagaaccttttggccaactattttaacaatgcataaatatcaaggcaagagcattcccaacccacatctctgcccattactcatggcagacatcatcatcagttctaaatttaaataatagcatttctgtttttatcacacttttattaagaatgttggggtgagatattagaaatggtcaaatttataggcaatggaaaatgtgataaattcccttttaatcacatagcacaaagctactttaaatctagtatatggcctttattccttttttacatactttttattcttcattgatgatctcaagtactctctcaattgatatttgattctcttgcattgctataattctggctcgcccgcctatttattttttaattttttttttactgcagtatgttttggggtacatgtgagttttggttacatggatgggttctatagtggtgaattctgagattttagtgcacccatcacccaagcagtgtacactgtacccataagggtggaatgaagggggaatagacaaaggccccagtggccctgcatgtcccatatgggtacaggggatgagggataaaagactatacattttatatggagtctttgatccctgcccccctgcccaacctggccgcgccaaagccccaaagtccatcattttgctctgtatgtcttcacatcctcgtagctttgctctcacccacccatttcaacaccaacccagtgtcaatgctactgacttatcatcactatttgaaatctggctgtttgcagtgctggaaaaatgaaattactcaacttccttaactggaacaaaagaactagaaccaaaatgttcgctttctggactcctgtactcgataagatttatctcatttcctatctcaaagtttatatgtggtcccgaagtacacaacttccacaagctctttatgctgcttgacttttttcacctgagtgtgagaaacttctacctgtatgttttctcccttttagctgaataaggcctagcctgctctgctccctctcttcaggaagtccgtcgcgggctatgcgagaggtcccaccttatacccttattttgctcttcctgcagctgtttttctttaattattaatgtgcctgtatctctcacttcactgtaaggttcataagaaagaaagactcaatttatttttctcataaatgtataacagcaaatagtgattacttagcaattgttgaacaaaatagattcttcctattgtaaacatggatttctaaagcctgatagatgactcatctagataaggcaaatgagtaaagagatgtgtccaaggttagccactgaataagtgataaaactaattctaaaacccaggtctcctgacagccacgtccagtgctttttcctctccagtgcaatcgctgcttgtttaggctgactgccttggttgatggtctaggtggcaattaaaggactgtgtgctttctgcctttcagggtggccattcagggcaactggggccttcgtcagttgccccttcattccgcccagaggatgagcttgagcacctgaccaaaaagatgctgtatgacatggaaaatccacctgctgacgaatactttggtgagtggggcctagagctgacttctgaagtaactatcttgctctgatttccttccttagtaattggaactattatcagctccactggtaaagtatttgagtccagatgcatgagagttgatatacatccccgcacaactaagtaattgtaggatttgcatttgcaagactgccatagatgtgatgtctacttagcttatactaaaatttcagtggtccttagagtttccttagatacaaattttattgttgagacttattttttaccagtctaggcaacatggggagaccctgtctccattaaaaatacaaaaattagctgagtgtggtggcatgtgcctgcagtcccagctactcagaaggctgaggctggagaatcacctgagcctgggaggtcgaggctgcagtgagctgtggctcagtgagctgtggttgtgccactgcactccagcctggacaacagagtgagaccctgtttttttgttttttgtttttgtttttgttttttgttttaaaaaagaagacattttttgacaacttattagcttcccattaggcagaaataggatttctgtgtatgttcccatttctcactggtctaaagattcaagtaaaaaatgtggaattggatattgtctgatatccaatttccagattgtactcttaatttttttttctatctcagttgaagaaatgatgttttctttgtagttttaattttcccctcttcaaacttgttaataactaggaatggttaatccttccaatccatgaatataatgcaaatttatgaattatatgccgattgtgaggttctgtggacgcataacctgtcctcagtgaggttaaaattgttcagaaagaggtaagacaagcatacaaataattactagtctaggtagaaagtgataaaagacatgagaaggcttaggtcaattgttgcaaattttatttttattttattttattttatttatttttgagacagagccttgctctgtcacccaggctagagtatactggcgtgatcttggctcactgcaacctccacctccggattttgagcaattctcctgcctcagcctcccgagtagctgggattacaggtgcccaccgccacacctggctagtttttgtatttttagtagagacgaggtttcgccatgttggccaggctggtcttgaactcctgacctcaggtgatccacccgcctcagcctcccaaagtgctgggattacaggtgtgagccactgcgcccggccagaagttttaaaagctccatttattaggagcatccggaatactttggtaaagaattggtggcacttgaatctgagccctttaaaccagtgcctttcacattttctgtggtagaagaccattttcctcccaatctgttggagaccagtatttttgttgagtcagttaaaattaattactagggaaataaaagacacaaaataaaatggaagatgaaattttatcattattagagttaactgttaacgaattactcttttaaatttttatactagtttctaaatattaatcctttgttcctgtatttatctcatccagggtgataagcatttcttagacacccatccatggaccactttttgagtggcactgctttaaggacaaatagagaaacgacatttggggaacagtattagtaaaggcacaaagatggggaaattgcacaggatttttgcttcttcaaatattttctattttcatgtcttttttgctcctatatgggaatatgtaatgacaggtcaactgaccacaccagtccaaaaacacacagtagatgaagtaggaggtattaggatatgaaaaccctggcttttatttgtgttggggtggcagtttagcttagctaaaagagcaaaaagagtgggaatgaaacatctggttgtggtctcttctctgtccctcgctggccaagcaatactggcatgtcacccatctgcctgagccccatttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgcagaactgaattagaatgcagatctgtacatttacacaccacactgtaaaagatggggaaagctagccaggctacatatttagaagagtgtttatggtggagattagctttggacagatgggaaataagagatgagcattctcttctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcagaaaaaggaaagagaaaatcaagagagagaaatggaaaagtatttatggaatacttagcctttgagtaagtctttaaaattgtgctaattgagatttggaagtaggaagatagtagagaagtgaagtcatttctcatgaggggagtttttgacataacagggaataaaaccactggagtgaagtgtccacgtgagaagtagcaaatattgggaaataaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgactgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaacaaaatgtaaataaatgatgtcaacagagtaggttcctttgtggtcatgttgctttgcttccaagacactcttttttttttcataagtagaatgattcatgaatatgttattatagttcttgtttctttgcggagcccctcatcactcttaacagttttatttatattgaattataattatcgtatgcttaaaagtactgggagaggtaccagaagatcacctcacagatgacttaagtacaaaggagaaaaggaacttttataatggagaggtctcctggaagccgtcttaaaccaagtaatgaaatttaacatcctcaataatgggacagactggcatgtgccaactgaatgtaggaagtctgcagcatcgtctaggcagtggtcttgctaaaatatttcagctctatccaaccatgaggaagtaaaaaatgcagatgatgggacatgcttcaagacacctgtcctgaattctgcaacactgtcaatgttataaaacactattctagattaaaggaaattgaagagacatgccattcaaatgcaaggcatgtgtcttgattgaattctggatgaaaaaaaaaaaagctgtaaaggattggtaacaaacttagagaaatttgaatatcaatgatatattagataatacatcaatgttaatttcatgatgatattaatggtgttgtgattatgtaggaaaatcttatttttatgagctatttgttgcagtataaggtgaggtatgattgtgtctacagttttattttgaaatattgatagagtgacagaaatagagagagagagacagaaagagagagagggatgattgacagatatacgtagacaaacagagatagagataaatgtggggaggcagaatcacctcaggttaaaacagctagagatgctataactgcaacaactataaggactcccctcctctctaaaagtgtactgaagcctgtcacaaatgaattaccttaagaatcccttcttgggtgggtagagagattgacatttctgcaccttctcaactttcctgttttaatgactacagtgggtctttgaaatttcccgttatcgttttctttttttcttattttttaccagacatacacatcttctattgctggtgagatgaggacaattgtggtagtgatgacaaaagctgatatttacctagagctccatatgtttaaaaaaccaagtcgcagccacaacatgactggcagacctggcgatgatgtcttcatttcattttttggatggggaaatagagattcagagaggctcagtgagttgttcaagctcacatagctaataattttggaatttggcctcactcttctgatctcatgtctatcataatacattaccattacagaaaggtatataaatgctgttcctgctgaatgttagtaactggctgtttctctcccatgtcataacttttccttatgaagttatgatcttcaagtgagagatggagggactgcttctgcccaagattacatgtttgtaatctggacttcgatgtcactgatatgtttcaactatcttaaacatcctgaattaactgctgtgacatggctgaggtacatacattaggaagaccgtctaccgaatacctacctatcagccattttgcagtctgtagttcttctcttgaccatgggagaaggcaaatcactaatagccaccgttcttattttttcaagtcaggtttttttataaaatataacaaacagggacccttaactgtctcagctgggtttttttttaatgatttcttctggaaaggtgatagttttagtgtttccatgccttcttttgtccatgttcattataacttgtgactgtcgcattacagtattaggtaaatgccacagatgttgaaccatgataaagcagttggatgagtctatatctctaaagggaagatacagtctctatactgtgggcatttgccatctacttggacttaagttttggctataacagatttccttaccatggacctgtgtctttccattaatactggtgtcattgagagggcctctaaacactaccctgtagaggaaagggaggaaacatagtagaaagttgggggtaggagaaaattcttacccagttcaataaaccagacagtgagtgtttagcccagctcatctacaggaagccttggttcaagtgcttgcattttagagcaaattttttcctagacaactagaaaaatatgttgatactaaaggaggctctcagttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtggcacgcacctgtagtcccagttactcaggaggctgaggcaggagaatcacttgaacccaggaggcggaggttacagtgagccaagatcgtgccactgcactccagcctggtgacagagggagactccgtctcaaaaaaaaaaaaaaaaaaaaaaaaaaaaaaggaacatggggcgatgaagtagctgtaaattattataatttagagtcaattcagagcttataatagaaaatggaaaacttttaaattgagtattaaaatgaataggagagaaaggtattattctcagaaaattgggacatctacagggctagttgccagttttaaagtttgttttttcaaacagttttaggcagctaaaggaaagcaaagttgagtttttctccagataaccttgagatatctctttgaaattgtccaagacttttctgtgttggttgatacagccacagccttaagtaatacacccagagcctctaagttttatgctttcattcattttgtaagagaaagcgtgtttgtatatgaagcttttcatacatgcatgtctgtgactatggcataattttttccaaataataatattctggctgaggagccctcaaggctgaaggcaacactgttggaagacagtatctctggaaatggatgttgtaatacatctaaggatggactggaaatatctgacagtagatttttaagcatagagctgtaattatcttgacattgtttatatgatattgtcttattccttctttaaaaaaaagcagaagtatgtgagccttaaaattattgagtgagctatttgaagaatccttcagagcagtgccaggtaaattatcttctcagaacttagcatttatctaaggaaactttttgttcatctctgagtattgttagtaggagtttttgagaatttttgcagaaaaccaggagtttgttccagtggaactaggccttcatttttcaaaggacagctagacaaaagtgaaggcatgaggcagcagggacctagcacatgctaagccttgagagaagaaaggcgttaacatgaacaaagtgctatgatcggtcactttattggttatgccagctcattgtatttggtgccttggtatcaactcaattaagatgaaaatggagggccagtgaatgttcatgaatagaaacagaacaaaaaaaacaatgaggaggatggtccattttctttctgcactagtgggaccagttgataagtgagcttgtccagaggacttgactaagatgcttaggaaattagaaaccatgatttgaggtgcagttgaaggtatggagagaggaaaacctagagccctcattgctgttgaaagactatcatgtggaaaaggaatttgacttaatatttgtgattcaaaaattagcaacaaaggcaagtgaggggagtctggccagttcccattcagcgtaatgaaatcactttcttaagagacagaagaaagtctttgtaaaattctaggtcagaatctaataatcccttgttggtgaaaatggtgataggtactcaagcaactgatggatgattagattatacttcataagtgctgtccaattctaacattttgtgacttaggcacaaacaagacgctaaacttgtttggaagttagcgtcttgcatccaacttctaggtctacccctagattatcattattattattacatgatttcaactaacatttatataatgctttttaaagcacttttctacatgttatatcacttgagcaagacagcagtcctacaaaatagacagtgtgtttatttccatttgggatatgaagaaatgaaagatttcagtgattaagggactccccactccccagggctctccactaccctcacaagtcataaagcaggtaagtagcagaattgccctggggcacaggcctacagactttaaattcttttcacttttcaccccattgtgctgttaacaccatgttgctgaattggtcatgggccataagatagatgagttaacatacttcatgttttagctttttaatctgtataaggaacgatgtgattactttgtaaagtgcttagaggatctcaactgagaggtgtaaagtaatttgtatttcatagtttgtgttattatgtgacaagaaaatggtttccaaagtgcttctatcaattacaaactgggaaatgactccaggtaggcagctacctttagtggatcttgttttcacagataaatgacctaattaatgaaaaaccccaaaaccacaatggaagaaaaattagacaataagtggcttagagagaaggttgtattgatttggggggaaaaatgggttttttggttttgtttctctctaactttttgtttagggtatctttgagttgtgggaatagaatgttctctagttaatgaggcatattagatatattttcttttgtggtagtgacttctggtaatgtttgttcagagtagtatatgtttacagcactaaataaataataattctgagcattttatgtgttctatcttagcatacattaattttttattaatttggctagtgtgtttgtttgtttgtctgttttgtgtcagagtttcactcttattgaccaggctggagtgcaatggtgcgatctcggtgcaccacaaactccacctccaaggttcaagcgattctcctgcctcagcctcccaggtagctgggattacaggcatatgccagcatgccaggctaattatttttgtatttttagtagagacgaggtttctccatgttggtcaggctgatctcgaactcccgacctcaggtgatcctcctgcctcggcctcccaaaagtgctgggattacaggcgtgagccactgcacccggcctggctaatgtgtttttaagcattgatttggaatcccagacttagagtaaagaagaatgtgatcttagaaattatctaggaaaatccttcattttctagaaaactgtatcccaaatgacttatccaaagccatgcaactaggtgtgttttgaattctatggtcaaaattttctttctgagtaatggacagtctccgatggcatgaagaggaatggcagggctgtttacaaaggtgcagacataggtcgggcctgctacttttgtgatctcagaccgtagatccaccttattcaaacataagaacacattgtccttaaaaagaataaaataaataacttttaaggaattttgtgtatgtatttttcaaatacaaaagaaccaaagttttcttattcaaaagaaacaaaagagattcccagtatcttttatctcagtgtctttatccaatttacttgtaatatttcctatctgttttcttcactaaatgtaagtctgcgtgagggcaacaatttatgtttagttcagtattgtgttcctatcattcctggaataatgcctggcacatcggagatatttaataggtgttaatgaattaatgaactaataaatgaaaactgtgagcagactttcacacttctgtgacaggacatggtatatagtaaactatagggaggaaatacttcattcatttaagatatatttatttagcaccttataaaatcataaaacgttagagctggagggaatcttaagagactaggaaaacctcttcatttttagagatcatgaaaatgagtgagatttttagggtcccaaatttgttagtgacagagccacagagtataactcagattttctcattcctttttttaattcacttaagggcacaggaaaacatataaactagagtaagacatggctgctacatttattgaacttaaatttaaattgttttaacacctttggacttgatctcttttgcatgtatcttctgtgaaatttaaaggttcaactggtcaatgaagagagtacttggttaagattttattttttaagtactgggtcacatttcctccacctgtaggtttcatctatagtctttggttcccaggaccatttcgtaccaccacaattttcttctgttctaatctaattggattggatggatagggcatcacattgaaagaaacattcttttcttacgtttacttgagttgtccatagcaacctgtcctgaaagattgtccgtttaaagtaagcctcttcaagactgtgaaccaccacccaagattggtgtttcataccgtcttgatacaaacagcagacatccagtcattcagctgcgttaggatcactatctctttatcagaagaaagaagagaaaagtagaagagagatttctacttcataattgaatgttctttgcttattaactgtggaagcaaacttgaaattctgggagagaaagcactgatggggcacacattgtctgtggtgcaaagaaagtctcagtttggtactggtacctgaacctgcaagtgctaattatgcatcttctggtattaacacacaaacacaattaactgtgaactcagctccttttccctttcaaaccaccatcattcccccaacctgcactttccccaccactttctctaaaacacacagataagcatctccttacagactttgaagtgacattaggattgtcagaaggcataattaattgactgtcagcaaagctattgtttgaacatctctggagttgtacttggtaggcatcttgtttttttgttgttttgttttgtctgagacgtagtcttgctccgtcgcccaggttggaatgcagtggcgtgatcttggctcactgcaacctccacctcccaggttcaagctgtgctcctgcctcagcctcccaagtagatgggactacaggcacgtgccaccacgcccagctaatttttgtatttttagtagctatggggttttaccatattgatcaggctgatcttgaactcctaaccttgtgatctgccagccttggcctcccaaagtgttgagattacaggcgtgagccactgcacctggccctgttgtatttttaattgaccgattctttcctctacaaatatttattgagtgcctactactcaccaattattgtagtgtatactatgggagataatggaaatgatataatggccaaggagagaaagcatttgtcaaatcctctagggccaagggctttgatagagaacagatttcacaactggcagtggaaaatgtattcttttccatcccggttcagaggattttgccactgtacttgtgccatataaaatgctgaaatagttcatgagaagaggtacaggcatacatcttcctggtgtgtgaagatgagtggcaatgcactgtctctggttagagttcccaccaaaaattgtaaaatacttaaaaagaaaaagcaaaaaatatccgaggcaattaaaaaaaaaaaaaaaaagggaaatcacagaagcaggtccaagttaatgaccttatcccaattctgttcctaagtctgactctgatgttagtcatgttgtatttaattcttccagatttcctatagtactgtacagctctgatctcagtcctcacttggttctaaggtttgaccatcaaactttgagcttgcatgagccttgaacttggctctactcctatctggcagtgagcatcatttgttaaaattcaacaagagcaaacagaaacagtgtacactagtgacttgctgaaagagcctaagaagatacagtaggcaggagtaatggaaatgagtttttaacctccactgactcaccctttctttcctagtcacccttagggtcatggcaaagttacagaggcatttagaaatcatcttgcttgaaagcttccctttcttcagtcattagtgagcatcttcataattttttttaccatatatgtaaactatccatagtattatttgcctaatatttttatttaaatcaattaactttttatccgactttgtcttccttcatgtcaataacatctataatttgattctgtgggttgaagtactaagttgcttctttcctgtaaaagatattaaactgaatactatatttaaattttaaaaatacggctggaattacagatcacatctgtaatcccaacactttgggaggccgaggctggagaattgcttgagtccaaaagtttgagaccaacccaggcaacagagtgagacccccatctctacaaaaaatgaaaaaaatattactaggtatagtgatgcacatctgtggttccagctactcatgaggctgagataggaggatcacttaagcactggaggtcaacggtgcagtgagccgtgattgcaccaccgcactccagcctgagtgacagagtaacagtctgtctcaacaaaacaaaacaaaacaaaaaacaaagttcatttcatgcaccagctaatgtttgaaatattgagaaatgtggatatcattcaacaagaagaaaaattgataggataccatggtgaaagaaatggtgtcctcaagcttacccattaagtgtataaagcataattttttcttttttcttttgcatgcggagtcatcatgttcttgtgaaggatcgtgttgtgttgttagatattgttccaggcatccagcactgagaggcattgccggcctgatactgtcccactgactcactgtgacatcttaggccggtttctcttccataggtctcatctctcatatcacgagattagaacacatgaactattgtgatccttttgaccttaattcctttgcctcaaacacttttcatatattgtcctctctacactgttaaaatgtaggtgagtaagaaaagcagctgccccatataaaatttcagtgctgcttgcctcagagttctggagaattgtaaacaaacccaagaattatatttcctagatcactttatgctctgcttgttactgttacccatttcctgaggtttatgagagggtcactgccttgaaagtagctttcaatgccaggtaataaaagtggaataggatgttgaatatgatgaagaataccatgcactaagtgttgggtacactagcagcgtcactgtgtttcagcattttcagtaatggtgttcagtcatggtaattggcataccggctcagtaatggtgtttactaatggtaactggcatatgtgagtgatattagtgtgggtaaccatcaacggagcaatagtctaatgtagatgatacagcagtaataaaaatgaataattcatcttttgtcagatagcttagtaaagtgagcactagatttggagtcaggaaatccaagtgtaagtcatcttttctgtgtgacgttagtgacatgtgacatttgtgctctccttagagtattttgttatacagtcttgagaactcttcttttagcagctttaaaatgagtgttattttgccagaagaactaacatatccatggacaagtcagaagttaaaaccaaattatttcagttttcttgtttagattagctcttctatagaacctcagagtcttcctgaatttcaggtatttcacttattaaaaagataattatccctatctattttatgtgcatattgtgggaatcaaattaaataagtcggtatgaaaaagttttctaaaccgtagcagaagaccaaaaatttaagaggtgttagtatctccacctagtgcagcatctggtttgatttgtgtcatttatgattagtgtgtaataatcattcctctaaattgttaacgtcagtgtttatctctatttgaattaacactttgtattttcttatgatgttctgttgtaattggaatatcgctggagaatacaaaaagtgttttttagtcattgtgtgtgagaaagcaacacaccaagatataccacaatgttctcgtttgctgagcaaactactcttgctttttaatgtggaatgtagaagaactaattgaaaagagacaaaatgaattttgactcaaattgaacaggatgaatcataacccactttctcatctgagatgtgaggaagaaaatgtaaaggaaaccaaccaccacacagctttactgtcagtgtcagcataatcaatatagagtgtttttcaacagaataaagaatacatttctgcaaggctgagagttgcaggtagtcggaaacctagttatttttgctttgtctatagtctgctaaaattgtctcgttctgccttggttaaagcattctaatcaagagagtttggggcccctcagtaattgcttctcaaaccattcagaaatgtacctgtgatctctattgaacagaggccaatcagagactggaccctctattgaacgtctggtcccagtgtcattttgtcagatggtcaagagcagggagacggcagacatacagaaacctggacaggactgaattgctgcttccctgaaaataacttacttgggtttattgatgtgaatgattaaacaaaaacactttgtcctattggattctagaatttcgatgcataatccacttagcttgtgaatgtagcttaaaaaaaaaaagattttacacaaataaagaggcactatagcatatcccaggaaaaaaactctaattcctaagtcaaaatttatttctaatttttgttactattgtatttgattcataactcttatgatctttattttcctcatgtgtgtttatatattttctattttactgtaaaattactaagatgggagagcacatctttcttatcttactcttcctctcttccccaaaaagaaaaatgagaagaggagatagagctggatgatttttttaaatatctttgtgccactccaccaagagttttgcttgcaatagaggttctctagtctgatttgatcctaaaccattctcactaatgattctgcttaaaataagactagtacatattgagcactgactatttagtatgagttctacatgcattacttatatctggactataactctaggcagtagatactgttttttacaatgagaaagctgaagccaagatgagttaaataattttcccggaatctagtaattagagttgcaatttgaacacagaacccagctcttaacccctgcatataccatgcctgtgactatagatttcagaaaatgagctagccaaagcctggaaaaagattagactcacaggatctgtgctcattccatgacttttctggtaaatcctattctgttttttcctctactttccttgggggatgtttttagtatgatttgattttctctgattgaaagctctcactactaataagggagcaattagaaatacaggtacaccatctctttgtttgctctgtaccagatgtctgctgagacagtgtctttgccctcctacatgggtagtagtgcccagttgggctgcttagtccagataacaaaaggcgatttctgaccgtaattttttttgttgttaataacacttgaaatatgcatctttattcctccattccttcttggacttgaaacttggttattatgattgtagcaatatttatgtccagaaactctcttctccccacaatttgcctcaatccagtactgctttctttcacacacgtaaatagttttaacttttaacgatccatgcctatggcatcttctagtctagtgatgtgtagaaaagccaggcccagtctcattgcccaggtggaaataagagagagcaaggaaaaggggactgattttgaaaataaagtcaccctgttgacatgtcatcagtcaaaagagttcagtgcaatagctagcaattggctcactcagtcggaagttgatgctattttaggccgtcagcggcagtgtcaatgtatctgtgaattttgccattttatttcattaagatggttcaggaagtcagacactgattaactgattcttcgacttagttcccactcctaattttggatgtgtggtgtctttaggaagctgctgtgtcaccttgattctaaagaaaagtttcgttgtgcctctagagcaatccggaacagtttacccttgtgtctggttatgctggaacctgctgtgttctacctctctggtcacaggtggtatggggatacttttgcttctggttctcctctggcagatcaagcaaatacaatccaagtgcgtgcagcccgttcccattcaaaatgtatccgtcataataacagcattctcgctgacgcattagactcaaggtggacttaatttggagatcacctatgaagacatctgtggaaggaatggcctcagcattgcagtcactttcgaagtcaagaggtattctagacagaccacacagcatgtataggtaagactaggaaaattctaagttttgtgttgttgctaggggcttgtaatcttattttatttgtaaacatgctctaaataagaaggataaggatctctagataggaaatatatgttgttctttgtttctccatttattcaataattattgaaggcctatgatatgccagacaattgttccaagcatttccattaaacattagtccacaaaatatagacagaagtgcttacaaatagctcaattccaatatgatacattgctggagtttggtgatatgggaggaaagaagttagaatggcttactatgaatggaaaagtggagaaagattttctgacatagatcatgttaagactgaatattaatggaatttttcaggtaagccatgaattcaagggcatttcagacaaacaattcaatagggacaaaggtatagagaccaacaccaaaaaaagtgcaatatgactgccaaagaatattggaaggagaaatgagactaaatgaatgattagtggccagatcaagagggcctcttatttcttactaaagaatctagagtctgtcctgaaagtgtggaaactccatgaagggtttcaacaagggaaccacaagatattgattaaagatcactctgggtactattgtggggagaggtgttcaatgggacaagatttgggggatgaagatcagtctgggtgtcatttgtacttgtctaaggggaataagggctggaaccaagatagtcatcttgtgacaatttagagaagggtttcaaaggggcgtaagagggatgggctgagacttattcctgggcctctatcttgggtgggtaatgacatcactaagtgatgtgagaaaaagagaaggagttcagtaatggtgatgccatcagtccacagagatcctctctttatcaatacttattgagcacttgctgtgtgtacacactgttctaagcattggtgctacagcagatgaaaagcttcttttatggggcttacattccagtgagaagaaaatgatgacacataaataaaatacatagcaggtcagatagcagtatatcctattgagaaaattatgcaggagaaagggatagtgagtgatacagtggtattggagtggaagtattatggtgaatagtgtgaccgctataattgtgaggtctctattatgggtgaaatctggtctgcctaattttgtttcttttccattttttgtttgtttgatgaattattatttctcgtaaacaaggcaaataaacagcaatagcaacataaacatttacaagcacatagatgtaggcataatagtttgtgttgccaacataacacatgccaggaaaaacaaaagaaaacagcagctaaaaaaagtaaatatcaaaaaagggagctttctcagacacaaattcttatcattcaaaatgctgtgtagtttgaattagaaagtcacagaatgggaccttagatttaatccaaatctcttagtttaggcagaaaaaccttcagccgagcaaggaagtcagttattcaaggacacacaggtaggtctacaatttaggtgctctaacttcatgtctaaggatcttacccttatcaccatcccagaaaagcccaaagtagcttgggtctgaatttccactttgccacagtaaccttgagcaagttttgcttctctttgcaacagtttgctcatttgcaaggtagggatgattataaaagtgtctgtgatagggggttttggaggattaaataagttaataatacatgcaaattacttacagatgtgggctgacacacagttaatgttcagcagtactgagagtattgaaacgttatgatacaggctacttaggttttgtgtatttgaacataaacttcagaccaatttctggtgatgaccacgggtaagatattctgtgttttagttaagatgatttccagttaagatgttgaaatattaaatacttttcttgggtcactgaataattataaaatatattaaaataactttgatatttatttcattcatagaagttctagacaatccagtctagagaagagttatgtaaaattctacaccagaaatagaaccctaaccttgaaagacagggacacttattcatatatgtatgtctaacacaaatgggcctcataattgttgacagccacttattgagcattgaccatgtgccaagcagcatgctgaacacttcacatagctggtcttacttaatgctcacaacaggtaagcattcatatccggatttttcagatgagaaaattgagtcttaggcagttcagtaccttgtccaaggttatacggatatcaagagcctagatcttcataagccaagtctctgttctttttgctcagcaaatacctatttttaatgaggatgcttttctcaactagctactatattctgcaaccagtctgcattttacactgctatcctttctgtgtcattcctaatactcattcatagaattataagatcatagattgttaaggctggaggaaacctgaggagtttcttggttctcagcataaagactcagaatcacctgggggagctttatcacattcaaaactacacacccacacacatctaccttgtatttacaatgaaactctgatctactgacataaccctagatccactgagaaaatattattactcggagaaaatttagctgatggagtgtgccataccccacgtgtgatgagataacaaaaaaagttgacaattactgatctagtccaatcttacatcacaaacatgaaaacagaatgaagagtgacaatcactttctaaagatttttaaaatgtcacttataactatctgcaaaagaacctgcgtcttttgacttataatgttaagtgattttcttgtttattccttaaaactgcctttgtagaatgcactatgttatttgatggttctggagtaatacaaaagaagagagtgattaatttgcctgggatcctacaacaaaccagttgaccaagagataataagcttattatattatgcagatctatacctattcacttcgtttagttaagaaacagctcatcaatatggaatacacattttcatagtagatttgtgggttgcatagcttttttgtgtctgttttcaatttctgttcctttgataactgaacaaataacagagatggtgaaacccagcaagcaaattatcttccagattttatgtgatctcccttctctagtgagttggtatgtctactaatgacacagtagattataaggttatttggtttaagtaaatatttatgcagagcctatgatatgtccatctctgtcttaggtggggtgaattagaattactataagtgctttctgaaaaaaaaaaaaatgtaccatgaacaaatttagaggtctctgcccccaagaagtccatagaccattataggttagagaataaaaaatatatgataatcccttttcccatgtgataaatgttataaaggagctctgtacctatgattatgagagggaatgtttgagagctctaggaaaaacctccctagggagattaagaggtgatatctgatgtcttcatgaaggaataaaatgtttccaagtagagaaagagaagaaagatgttagatacagaagaaacagcatgtacaaaggtatagaggtaggaaaacatggtattctgggaacaggaagatgttacttcctaacagaacttctctgtggctgaagccacattgagttgagggacaagtagtgggacaaggaaggatagagagtctggagttcagtgataaaagatcttgtgtgatagtcataggaaggatgttttggatgtttacctgtgcaaaatgggaaattgttgactattgtcaaacaatgggtaacatcagattagtgatttatgtaaaactgaagggataaccatttctactgctgtataccacttggataaccttataaagccacttaatagggaataatggggctggaaatttaatgggaatagatttaaagtgcttgtgggataagaaacatgatattgctctcttttgttctctttcagttcaaaacaggaagtgcctaggtatgcagaaatgcaaatcaagccagctatatttttggtgtgttttgtgtgtgtttagattttcacacatcagcaatactgtaagaacactatgtggccaggcacagtggctcacgcttataatcccagccctttgggaggccaaggtgggaggattgcttgagccctgggagttcaagaccagcctgggcaacatagtaagaccctgtctgtacaaaaagtgaaaaaaaaaaaaaatggatgggcatgatggcatatgctgtggttccagctaatctggacgtggaggtgggaggaggatcacttaagttcaggaatttttggtggctgcagtgagctgtgaccatgccactgcactccagcttgggcaacagagccagaccctgtctccaaaaaaagaatactattatgtgaataatccaccagattcaactaaaaaatggccatgatgttttaaaagtacatatatacacacatatagatttaaagattactttcaactttctaagaaattagtagatctttagaaaatcattgtgcgtatgtgcatatgtgcattgtttgtgctggtcccaccttcaaggagaaaatatttcaagatcctgatgcttacttaagaggttgtatgtgtttaccatggaaaggaccttggaaatcatctcctaattctgacttcattatttatttattttgatgaagcaaatggtgcccagattgaaacaggagtgtaagccacagccaccaagtgccagtgcccaggctaacacttttctccattaactctggaaaccttatttcctttttgtaccacgtatttacagtgtttggtagttatgaattgagtgaattatcccaaggttggagatatcttggtactcacttgtaagtggagaaacactaataggaaaatattctgggaatctggtaaggaagtatgagtgaatttatcatatttaacctttgttcaaatacattaagccctttcttccctttgtcattctcaaactggatcgacatgataggaggagaaattttatcaactaaaaggggttgtgtcaataagtgtttatgatacctctaaacttaggccttaaaacaacacaatctgtgatctgacagttctgtaggttagatgttcaacatgagtctcatctggctaaaaccatcatgttagcaaagctgcatttgtctctgaaggttctttctaggggagaatcccccttgctttttctgacttctaaaaactgaccacattccttgacttgtggccctctttttccatcctcaaagcctgtaacatagcacctctgaccatttttttcatagtcattctgtgtctggccccagctgggaaaagttctccaattggtaaggacctacttgattagatatgacccacctgaataacctcacatactcttcctatctcaaaactcttaacttaatcctatctgcaaagtccgttttgtcatatacagtagcatgttcataggtttcaagcatttggacatggtcctctttgggaggcattacgctgcctgtgacagtgctcttctgatacattttcagtgatcttctagacataacaatcctggtcctgggaacatgcatggcggggacctaaataagtctattttttaagaggccctaccctttgcatagattctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttttgttttttttgttttgttttgttttgttttgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagaatagttaggtcagaagttacagtagaaactttcatggaatacacaaaagggaattaagtaaggaaacttgtgaccgatgctatgggaaaggacatgtttgtcaaagcaataggttcttcctgagttagagaacaattatggttcccccatggaaatgtttatctgacgcaatgagaaccaggtcagacacaattcagaaatgaaatgaataaaattattctaagatctagatgggaggagacataagggattgtgttttgatagtcttaagggtgcacttacatttacatccccaaattccctcttccatgaaccactgtgcactgtacattgccacattaatgctaactgtgccaattagattaactaatattggtcaaaaaagaatatcctggccgggcgcagtggctcacgcctgtaatcccagcgctttgggaggccgaggcgggtcacggtgaaaccccgtctctactaaaaatacaacaattagctgggcgtggtggtgggcacctgtaatcccagctacttgggaggctgagacaggagaatcgcttgaacccgtgaggcggaggttgcagtgagccaagatcacaccactgtgttccagccctagcgacagagtgagactcttatcaaaaaaaaaaaaaaaaaaaagaatatcctaatgaagagaaaaatgacagaaatttctaagataactgtttcatatttcttcattaaattaaaatgaaaatacatcttcttagagtattggggtataaattaaactgaataataccagtgaaaatgctctttcaactataaagtattagagttgagaaagttctttttgtttgactattcattctgtcatctcaccttagtggtaatttcttctgcttggacaatagagcaaagttgggccagtaccactttggcaatgggcatcaaagtcgaagaatcccatgtgcaggtcgaactcagtgaaaaagggctggaactggctgctcctgcccgcttcctgccatagtcaggcccacatttgaactttattatttcgggggtaattaccttgtgtagtcgtaaattttaatccaagtctcatatgtgactgtggatgggtacagtctaaagggaacatttctttatttctctgctgcagagtgactacgtctacagtcaaaagttctcaacctatcttaggaatcttactttacttcaccaaaaacgtgtgtgtgtgtgtgtgtgtgtgtgtgtacatttatataccatacatgtacacgctagtatgctttagttaaaatacaaagcctctgtagaaaacagaagaattctgcaatacccctgaaaaataatttattttctacatgctatctcataaatctgtactaaaatcaattttgaaaaattaagccccccttctctaacatggtactctctctctttatttgaattgtttcatgcacttcaacaattatttctagtttcatttcttttcatgaggactttattccaagataattcaatttttgttgctactgtgcaatctttttgcttgttgttgttgatgtgtggttattgctagtttaaaggaaactcttgactttgcttgctcatatccaaacactttaccaaattcagttgttaacaaacttatattaacaacgttttcaggttcttcagtgattattaggctactgaagtgtttttgtggttgttttgttttgttttacttctattggaattcatgtggctgtttatattttgctagaaaattatgcattttgtcaagattgtctactgttgttactatgatataggcgtatttctcacttatactttttaaaatatctgtcttgtccatattcatagcttccttttgctttgactgtttttcctttttcctccttagtggaactttcctaagaagtgtgtatatgtgtgtgtgtggagtttgttttctaactcattacttttaacgtttgccttattattttatatatccttctttaagtttatttagttattcattgttgtagtatcttactctgaatgttcatttatatttctctgtctcttctgtttactaataaaaagcatttaaattgatgaaatgcctctccttgactttatctgcatcccatttggatatcttttaaaatttatcataaaggtgttataattcagtcattcttccacataagaattattcagaaacttatttctaaattatttttatcaaaaaatgttattctattttttaatttgaaagaatttaagtcttgaaatttattagtgacatgtaaattcctgactgagcattatgaaacttgtttagttcattgctgaatttggtattttgtcagctgggaacactaaatacccccacttaacttgctatttgtgaagctcagagtagcattggggttcctgtacactttggcaattgccccatggctaatttggccaacttccaattcctcagggagcaacaaagagttgtctcattgccacctgctattaactaaatgcttaggattcagtgtcctaggggtgactgggagacatgggaatggattattgtaacagcctgtggaacctccttccctggggaattttgagaacagcaaagaaccatctgtctgggctggttttaggagcagccctgcctgaaggcaggtgcacggattagatgacctgtgaagattgtcatccatcccaatgacttcaatggaaaggatgcatttgctgaatttgaaaagagtccaggaggaacactgataggtttggggagcatatggtcaagagcctgagggtattgagcccttcttgaaattggagacactcggtgtcaccccatgccctgaattccagaatgccataatctacacgtgaacccagcagtcattcacccttgaaaattatgtgcagatgtggttcacattggagtattcacgtcgttgttgatcataagcagaattcctttttaacacatagctcaactgatctatacccagaacatactgttgaccctgattcttctggttaagccggatctgcctgtataatacatcatttactgacccactgacattgagttttcttagcttgtttctcagtggttgttctgtgtttgtttcaggcaattaaatatgttgatgcatgtttcagaagagctctcctaattatatcaacaatagctttattatagttagaaaagacaaaatgctaaatgaattagccgggttaagtcacatttattgtgatttaattcttactgtatgtagtgtaatataaataaaataaaaattttattttattattattattattttttgagacgaagtcttgctctcatcccccaggctggagtgcaatggtgcgatctcagctcactgcaacctctgcctcctgggttcaagcaattctcctgcctcagcctcccgagtagctgggattacaggagcctgccaccgtgcccggctaatttttttgtatttttattagagatggggtttcaccatgttggctaggctggtcttgaactcctgacctcaggtgatccacccacctcagcctcccaaagtgctgggattacaggcatgagccactgtgcctggcctgtaataacatattttaaagttacagagaaagggcaatgtccccaaaatattttcatgatgatatgtcaga

SEQ ID NO: 346 - DNA, 681115 bp, Homo sapiens
ggaaacattgaacccaaagaatgcaggaagaataaccaataaatatagtagtaaaagaccaaatttttagctctacagttctggaaaatatgcatatcaaaagctaagttatagcatttttgatataatttctacttatgaaaaatattatatatacatatatacacatatatacatatatatacacacacacacacacacacacacacacacacacacacacacatatatatatatacatgaaacttcaaccaaaagaaggaactgtaaggggtctacatgactgggaaaatattaggcctattattaaatctaaatagatcatgaatagttacatgtacatgttgtaatctttacagcaaccaatgtaaaactgtgcagagataccaatataaaatcaatataaaaatcaaaagagcccactaaataatactcaaataatccagaagtagcagaaacagggtggagaggaacaaaagttataaagagaaaaaggaaacttacactaaaattgtaagcttaaatccaaccatgtgaataatttcattaaatgtaaatgaactaagcacatatattaaacacagagtttgtcacactgagaaaaataaaaaacaagagacaagcatgcgattctataataaactctaaatagaagtatatacacaaaagtaaaatgataacacaaataaacacctagttaaaatggcataaagcattacttcaatgttaattgcatcattctgattttctaaattgcatattgtgttgtaagatgccacttttgaggaaaactggttgaagtgtaactaaacctttattacatattttttcaccttaatgtgtatctataattatgtttacagaaaacattaaatgaaagtaaaaggatggaaaagttttatcatgtaatcctgaattaataacacaaacatatagtgtggatatttctttgcgtttcttttttgttgttgtcgttgttttttgaaaaagtctcattctgttgcccagactggagtgcagtggcacaatctcggttcactgcaacctctgcctcccagattcaagtgattctcctgcctcagcctcctgagtagccgggatacaggcgcccgccaccacacccagctaatttttgtatttttagtagagatggggttttgccatgtgggcgaggttggtctcgaacttctgacctcaggtgatgtgttcacctcggcctcccaaagagctggaattacaggcataagccacaacgcctggcctttttttgttttgttttgtttttgagacagtgtctcactctgttgcccaggctggagtgcagtggtgcaatcatggctcactgcagcctcaaactcccaggctcaagcaatcctcccacctcagcttcacaagtagctaagcctacgggcacgcaccaccatgcctggctaattttgcttattttttgtagagacaagatctcactatgttgcccaggctggtctgtaactactgggctcaactgatcctcctgctttggcctcccaaattgctggaattacaggcataagccaccacacctggcccagtatggataattcatgggtaaaaaatgtaatacttgaaaaacaaattagatgttttcttattatttccacatagcagagtactaactgtaggacattgggatgtacttttgaataagaaatgaaggtttaaaaaaagataaaataaaacaaaataagtgcctaaaactgactggtgaggggtttacccaatgcatgagcagtagaaagaatttaattttttgcatccaggatactaaaaagtggaaagatagatttcttttttttcctgttttacttcttttgggttgctctatttgatctaattaaaaagcctattactcctatgctatgctgatggaagagaagtcttctctaacttagtcccagtgagattgcctcctctgggccaacaatgctcatctagaacttggaatttcgataaatccattctgaggtgatgagcagcagcagcaccagaaaagttgatccaggccatctaggaccctccagggaagggctcaggcctgtcaaagaggcctgatagaaactggggcctgcagtcagtcagggacattgaagctctcctgacacggtcccaccagctgggaaaacactcggggtctccctcgggtttgatcagatggcaagttccccattccctgattggcccaaagctttgacctgttggacccggggcctatcaaaggccaggtgtcctctccccattggaaacctccctaggctcaactcttctcttctcattctcctgctggcctgggagcatccaggccaaggggtgaggtggggacagccctacattaagtttttatttcaaggtagaaaatctgtccccttgattgtttgggaaactataaaaagactagggcagctcagggtctaaaatacagcttcagggagtacagagttagagtgcagaaacttcaattccatttactctctagcaatttacctaatatcaaaacatacagttatgttatgtttacaaatatgcacgcacctctattaatatgtgttcataagtacatacacatgcaccattacgtttacacatacatgcatgtaacaccaactgatgtaaaaatcattgttttatgtactcagttttcctttgagtttaccctcttttctctactttttaaaatatttatttctaatttggggagctactaactgagattatttttcatctcactgaaaaacagttttagaatttcctgtagagcagttctgctggtggcaaattccatcgggttttgtctgaaaagtagccattttctcctattttttctgtttattatatagaaagataacttatataaagtaaaattcacaggtcttaattatacagtttgatggtttttacaaatgcagatgctcatgtagccaacagtccgatccattctcacaacatctccattactgcagaatggagacattctgttccagtcaatgtaaattatcccattacacctaccaaatagaacgtgtatgagagacacctttctcctgaggacttttgcaaagtggggtggatcatgtgtcccgctcccactgaaaagggctaaatggaaaactaaagtctgaaataaaataggaggctgccctgacgaggggtcccactttgcccttggacagagaacaggccgtggtcaaggccctggtccgggcagaagcctctgtcaggacccactggcatctggtcacagacacgatggacctgggcctaggcagaagggggtgctgttggtctgctgctgagggctctgtgggtttctcagctgggaaaccaaacacttgaacttggtctccacgcagggttcactggggccagcagctgggctctctctgcacccttggagagcctcaggccaggcccagcccaggtaacccctcccagaaatgtcaccccaccactgggactgacactcaggcacacggagtgatttggttgggcagaggaagaggagcacatttgcatgaagggcccctctctctcctctgggactacagggtgggtaagaaatacctgcaactgtcagcctcagcagagctctggggagtctgcaccatggcttggaccccactcctcttcctcaccctcctcctccactgcacaggtcaggatggccctcagcaccctgacctccagctcactgataccacctcccaaacttatgccaggaatgtccttccctcttttcttgactccagccggtaatgggtgtctgtgttttcagggtctctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactggcattcacacagtgacacaggcagatgaggaagtgggacagaaacctcagcctgctcagggtcttgttatatgacaagttttaaattttcaaatatgttttatatgtacacactccacttggaagcaccgtctggtttaaaatgtttctactctcaatttctcattcaagttttctgaagtctcaggaaaactaaaaacagaaacaaaaatatcatgatgactatgaaatattacctaattttccaaatatgctgaattcagtgcctgtggagctaaccattttctcttgacagaagaaaaatgagccttagaaattgtttccaaatcctgaaagagtcatcattccatgtactcaggacagatttagagagtgctgaccctgccctttgaaagatgttatttgcctcttagtgcccaaataaggaaggataattaggaatcagaagcctacctagggctcccctctctcctctcaaaattgcacttggtgtcatattgccctagaatttatgcctggtgctggcaaatatttttaaatttattttttaatcttttccttttctgcaatcaaatttcttgaggggctgagaagaagaaataggcccagagagaagcaaggcagtctgggtgcaggctctagacagcccagggagaagaaagagggagcagctccctgtgtcctggagggagccctgtccccattgggcttcctgctctgatgtcccctagtggaggctcctcagggagtccagcctcccagaactgccctataaacctcacagtgagctaagcaagtatatccaggaaggagggtctgtggagatgtgagactaaggtgtgttatggcctaaacactgcccatctccatccttcttggggatgacaaagtgaacagtggaggagacaggatacatgggtgcatctggacctcaagcagtaggctgttctgtggtctgtccctaaatcttgtgctggagaccccatacgagagccactccctgaccctgggctggagccctctaccccctgctcacaagaccagcagctgtttccttataggcccccagggagccacagaacagcatcaaccaagaccatcctcttcatgtgtcagcttttcagggagggatcgaagtcatggcccaggaaagggcttggacagcccaggggaggaggctggttggtatgaaggatgccctcctcaccctgagctgctggagggagtacaagggacttggagagcccaggctcagttgatgatcctcaggatgtagagctatgtatgggtctccactgtggtctctcccccgccttctccttcactgcacaggtggctagggctcagtgtcagggctggtgatcaaaagaccaaggtttatgcatgtgtctctgtccactgacccacctctcaccctgtgtctgtcttaatgtccagcgtcctgagcccagcctgtgctgacccagccacctgcagtgcatgcatctgtggggcaggtgggtaccagctcctgcactagaagcagcagcaatgttgggcacgggcatgtgctctggtacaaacatgcctccgagagacccagagctccacatatataaaagcagtcattgacccttaggggcataggcccaatgctgaggctccaggttggagaacatggcctctctgagcatctctggactccaggcagaggaaaaggctgatttttattctcagcttgggacacaagcaccaaggctcaggcagtacttcaggccagtggggaagtgggagaaaaagctgctgcccatccagcaatggagcttctctgtgcagcccccacttcttgggcaagtcagctgattaacgttgcttttcatttgtttagtaaaaatttagattttaaaactcactccagtgaacgcagtgtggagaatgtgtttctgtcctctcaattctaccctcacacccaacccttggcagtaacaaattgtcgtattgtctcatattaagagaaatccctcaataccaagatcaggctgtcctggaaaccaaatccataatgggtcaaaacaggaccagggtcattgtgtctgactcaggatagtcgactcccaaaggtctgtttatccacctcattcactgagaagctactatgcaccagcctcagatccagggattcaaggtacatgatgaacaagagaggaaggggccctgtcctcatggagctgacactgagtggtggaacagataaggcaatcaagtaaaaatgtcaatgcgacaatatgatgtcatcacacagtgaggagagctcagttgggggtagaggagccatcagaaggttgggcaaggaagacacaggatctgactcaagtttatgaagaaaagtccagatgcctcaaagaagatgaacaaggagacagcaagcatgaaggccacggggccagttggggtcattggagagaaaggtcaggtctagcctgtgtttgtaagaggagggactgaagcctgggtgaggagagagggctcaggaatagccttggaaagtggagggagtggatgcgaaacccctgctgagggggcctccatgagcaatgaggctgggggaggccctgagctaatcaccatgatggaaactcagacaacagcctcccagcctctttcaaagttgtcacaggacgcttttctctccaaatggcaaggggggaatcccactatgagttttatttgagatgtctcttctccatgtcctgtcctgtccctaggctaaattcccatgcgcaaacaagatactgctcagtctcaggtatcacattcacacacaaatgctccagaatgagggaatgcactctgaccaacccaccaggaatttttgcctttgagaatactagatcagatcactcacaccatctcccctgacaccatcatgttgaccagtgggttgtctgatcggtttggacagcagaatgcagatgcctgtagttgcagctggggtcagtcacatgctcatctcatggctgggagactttgggtccagacaacaggaaaaaaaggaggtttgcctacgtgatcccacaatgtgcatcactctgtcatccactcccatccttagttcatgttgggttttgtcctgtagatgctgggacctggacaggatcacaagccaggcgatttctggctcacaaagttacagctcaagctccctgatgttgctgacattcttcccacagaccaattttagacagacacactattgccatgcaggcactgacctgagatacaggtagtctcaggagagggaggaagcagatacacatccccatgatggcctccttgtcccagagtgggtaagaaaggcaaggaggccaggaagccacaggagtggccactgcccaccacctgtgcacctgtccctccctcaggtgagaagcagcctgagggtccagcacctgcaccttttcccagtgcccacacacttccaagtggggcctccttctgctcacctcccaaagctactgctttccgggacatctgtgtcattgctgagagtctacttttcatggggcccttgtcccagtggtctgggatcagtgtcagcctgtttaattcagcactgtctctgtcctttcaggacaccaatctagctattaaagctctaattgaattctcctttttttgccctgaaactttagactctccttctcagtgtctctctagaatattttgtctctatccaataagatcaagttatgtcttcaggcctacagccacttctttccccaaattctgcaccttcttttaagttcttattccctcttatggcttattttccactaactagctaatgatgccaaaacatttatctattttacctccttcaggaataaaaaagaaaagcatttatcaatagcccattgtcacaaagaaaggaacagaggagagatatcttctagaaaaatacaggtgaacaaggaaaaagttttaattcctcataggaactactccatgatccaagaaaataaattccagagattcaagagttcactccttagaaacaacagtgtaaatacaaggtagtaaattttcttggttttctcaatgaataacctcaaaagggttagagtatgattataataaaaagattatacattactttcaaaaatgtaagatgaacatgtcaaaaattttaatcgactcatatttctgaaaagaccagtaaaatggtgaataattttaaagaacattttaaaacacacagagtttctattccacgagggcaggacctgtgaggataatttcctgtgttagagaaacactgtcctaaacaacaatagtagaactctctaagctctgaatttatcttctcctgtaagaaaaaatctacaaagtgacaggatccaatttatataaaatatctagcaaagattttggacattcccatctcacacctcctctccaggctctcctcaagtgaaatctactctccttctgcccgtgttctcacctttctgcacgcttccgcctgctgacacatggcttctcctgctttcctttccagtagccctaacagatcaggccctgccagtaagtaagctcctggcctgagggaaccacatcgcatgttactggatttctgaggcacttgccctgccagggtctctctttctgaatcacaatccctgtattcctgggaattctcttctcctggattctgttattcagctctgtgtttctccctccatatctactttgtgaatttctctacatcttcacctgaatcccaggaagcctaaggacatgctgatgcttcctcagttctcatgtcacaccctgttccctcctcctctatgatcccaccaggtcatcctgcatcagaaccctgagtgcggcagaggcttctctggcctccttacccccagtggcagaagggaggaagggaggtcccctgtggcctcccatccttgtgctcccattagggtcagcatgaagcaggaatgaggctgtctatatcatcatggcattcccaacactaaactctgtgcccaggagaaggtaggcactcaataactatttgacaattgaagaactgcctctcaccacactggccacattgtactggactcaggatggggctgaactggaagagtcagctgtgaacctgctcttgtctctgccctcagcctgagagctgaaggggaacctaacagggagagcacccatgggcagggaaggtacattagtagcctcatcctgtttgtgaggctctgctcagccttgggaatccctgtttattcaaggcagagaagaaggaaaacaattaaccaggcctggccaacaggcagcatctacaaggcgatgagttgagggccagatggtcagagttggttctggcatctctcaggcgcctctctccatgttgcccttttttgcgatccaggggtgaggtttcaccccactgagcccccacccatctagatgggctctgctgagagaaaaacccattttctagatgagcccactgaggctcaaggggcacatgtacttggtgatgcaccttcttcctttagagactggtcagcctagaacaccccctctcgagtggccttctggtccctcatctgcccagccccacccagatctccatgaacctgagctgtgtgagagaagagggaagagtaggaggaagggaggagtccaggccatggtgtggatgttgcaggaacccctgggtcttcaaactgaggctggacaccgcaatgttctttttatctccctcaaattttttggtaaaatgtcagtgcttgtctggtccattattcaaacctgattctttttaccaccatcataggcatacatttctgagtcttcatcccagagaacagctcctctctaaaggggaggtgtagggtggctgtgagttctgagtttgcccctggggaggaagcacctgctccaccatgtgcacaggcctgtaagcaagagtccaactttgttgaaataggaaccatttgagtttgcttcaggccttgctgacctcagaagtttcacattgtcccctggtgacctcttcacaatgatgttagtggtgatggaacaatgcaggacagaaggccttccttactttctttcaacaaaaaaatggtgtattatctagcctgacagtaccctagctggagacagtgaaaataatttacattttaaacaaataatgtttgttattttttcaatctcatgagtgtaagataaaagtaatcctatctcaataccaaaacaaacaaacacgaaaaaccagaatctgaggagactgaagtgtgttgattgagagacagtaagaataacttagtccagctcccctgcctggctgtgaaatccaatgatccagtgtcccactctacagacaaacctacaggtttttcacccaatgcagacagaagacatggtattgaattcatgagtccccgctgagagtcacaataggctggtgtggcacaatgcattatgggaggcacagaatgaagggacaacatgtattcagtggattctgctctcttatcagactgagtcactgcacagactgctcacagggtttctccactgcattctgcctcacataaataaacaccaagagccataggatattagtcaattatattttctccttcagtgtcatacttgagatctctatcatatttgaaattggactcagagagcttcaattattttgttgcaatatatattatctttacaaaaattacctagactactgtgtttctgaaaaataaatcttacaatttattttacttccatgatggtattaaacttgaatggttagcatatcagccagtagtgtgtctggggctggacaacagagagtgtttggggtccattcctgaagggtgtgtgtgtgctcagagctggcatcatccacctattctgactcctgccctctgctaagtcctcacagctgtgaacttccaaacccctgggacaacacagctccactcctgctcattcccctgatccccaaaggcacagggccctgatcctgacccaaacacagagtgggatcaaaaagctgagaggttgtcacttgcataggtggatttttttcctcaaagagtataaagagagggagaaagattgggagaagctctgcggtagctgtaggcacagaaggcaggaatcaggccaatctccaccatggactggtcccctctcctcctcatactcctcactcactgtacaggtgactagacacaggcccaggggaggagccctgggaagcccaagggactctgctttctcatcttgtctctagaacagtatcaccacttctgtgtctcttccacttccagggtcctgggccaagtctgtgctgactcaacctccatcagtggcaggggccccaagatagagggtcactatctcctgcactggaagtgccaccagcactgggggtggttttcatgttaatgagtactagcagctcccaggaatggctccatagctcctcatttgtgaaaacagccattggccttcagggttctgtcctggttcacaggcttcgctgagcatttctgggctccagtctggggataaggctgactatttttctttatcttggcacacaagcattaatgctcacacagaactgtaggccaccggggaaggaagacaaagatatgctgtctttccagtgacagagtttccctgtgcagcccccaacccattcaccaaataagtgcttaactgtgattttttttggtggacaaaatgtggagtatgagaagcactgaagcaaacatggtctaaataatgtttcccagtcctctctcaattctacccccatatccaacccttggcaataataaattgtcatactgtcatatattgaaataaatatctatattagtccattctcacattgctataaagaactacctgagacagggtaatttatgaagaaaggctcacagtctttaattgactcacagttctgcaggctgtacaggaagcatgaattggaggcctcaggaaacttacaatcatggaggaaggacgaggggagcaagtacatcttgatatggcagagcaggagagagagagaaggggaaatactacgcacttttaaacaaccagaactcacaagaactcactcatgatagtgaatcttaagaacagcaagaaagaaatctgcccccacgatccaatcacctcctaccagcccctcctcagcatgagatttgggtggggacacagagccaagccatatcaattcctcaataccagggtcaggcttccctgggaaccaagtccatcatggatcaggacaggaccaggaacacagcacccactgtgtctgaccaaagagcctcaactgccagatgtctgtccatccacaccattcaattagcacctactatgtgccagccttaggtctaggggctcaaaaacagggtggacaagacaggaagtgtccctgtcctcatggaccagacaccatctggtggaagagatgagacaattgagtaataatatcaatacaataagatgtcatcacttagtgaggagaggagaggagagctcagtaatggtggtagaggagccatcagagggttggacaaggaagacagaggatctgagctaagtttgtgaagaaaagtccagatgcctcagacaagatggacaaggaggtgggaagcatgatggctgtgggtccaactagggtcactgggggagactgtttatacccagcatatgtttgtggggaggagggactgaagcctgggtgaggggagagggctcaaggctggccttaggacatggacaggatggtattgagtcacgctgcagaaggagccttcatgggcaagggggctgggggaggccctgagctcattattccaatggaaatatcaaactgcctgttagcctttgtcaaaggtatcaaagagactttttcattcaagatggcaagagaggaatctccctcttagacttctttgagatattctttcttcatgaccgtttcttgcccctggatgaatgctcacatgggagcaaattacctcctcagtcccaggatttcaatttgcacacaatccccccagaatgatcgagacctgccatccctgacccactgatcaggaattctggccttcaggacaacttgaccagatcagtcacaccatgtcccctgacaccatcgtggtgactggggtgaactgtcagactggtttgggtaatacatgtcctgtccctggagttgcagaacctgttcagaaagataatggtgtggatggagggaggctaattccagccacatcagaaagcaagaaagacatggagaccacccttgagctggcacagcatccttgggtctcacatgtgtctctagcgactggaaaaggaactcagatttaactaattctattttctcatctgtcactctccctttcactactgactcctgaagccccaacaaaagcagcactatgggattatggtcatggaatagaggccttgctgctgaacttttcttttttattctaaaaagtacaacacagataatgcatattaactaaaaattataaaaatgtatttaaatgatgtgacaatgaatgtataaggggttaataggagaaaataataaacaatgttaaaaaatacaaaataccaatacactataagagttatactatgtcatggattgtataaatcagtattgtaaagatggcagtgtcctaggattaatccatcaaattaatataagtgtaattaaaatttcagtaatattttaggaaactgcttaacttattttaaaactcaaattgaaaattgagataaaaattacctaagattatttaccaaaaatttgtaatggaagtgataccagatattgagttatttgaccaagcaatattagctaaaatcatgcatgattgagatcttgacatttacataattctcttaaaaattagagtagataggactgatgattttttatgtgaccttggaaatatggctaactctgttcataaaattaagtagagtacctaattcatacttttattaaaaaatccaaacagatttaaaatataatttagaaaagaaaaagtttaaaaactttagtttggaaaaatagaaatattatttttatttcatatgagaaagtacttcttaaataaacccaaaagtcaattcataaaagaaaatttgaagtatttggttgcaattatttgaagctttttttttcccaaagaggaccacagttggtaaaaagagagaaggatatgcaagagtggaaagacattggcaaggacaaagtattgctgtttgcatccagaagacaactttgaaatgagcgaagacagaaaaaaaggaaacccagtaaaaatgttcaaaggacacaaacaagccattcacgggtctcaaaatgagagcagataaatgtgacatcaaaatatgttaaattccaccagagacaaagagaagggaataagatcttcaagtagaaattgtggaatgagccaagcatgtctgtgcatggggagctttccaggccttgcaaaaagcaaagagagtaagaaaagagcaagaagggagtgagaagcccttttgtagagaaaccaagaaaagaaagtttagagtgttagagcctgggccagaaagataaaagagagagaagaggtagataatgtgggatttgagtgacctttgattcctgtgggcatacttctgagtaagacatgaagccactgagggtggaaagctgttaaatgatattgcaaatttaaataaaaaaaaaagatgccagtgaggatgtggggaatcccaaactctcactcacagcaggttgtaaaaacaaattcagctattttgagcaaagtccctcagcacgaagataccttaagagggtgagcatctgtcttgcaccaagtccactctgtacagagacacaaggaaatgtttatgagaaggtccttactaggggaaaagtataaaaaacaagctagttgtcaaacacaaggggaatttataacctgcagttagctgatggaatgctaactagttggaagtaataaaataaaagtattattatgagtttcaaaggcaataaatatataaataaaattaaaaagccaagagctaaagaaataaattattttaaaatatgaacatgcactataattttttttaagtttataccatgagctatttgaaagttagactggaagcacattatatacacttatgtaagagcctctgaaaaagatggaaacacatacgaaggttaaaagataatttaaaacaatagagagttatttcagtagctgaagatatgagtgccaataaaatgaatgcgattcaaccctgtgagcattgctttcataaaaaaattaaaacagaaaatgaatattaatagatgacttaagtgaaatcacaatgtatgtggtgatacagctgaaagacaaacgttttgttagtaagaagggcatcgctaagcctgatgagtgctttgtttagaattcccagctaccctggattcctctccaacctcatgaacagcttcagaaaagaggatcaggacaaccgatgctcctctcattgaaatgcccggatgtggcagagaggcaggaaatattttgggtctgaggacagtgaggatcatcactgagatgatcctgcccaaatgaaaaccactcagggcctccaagggagttcagccatcagctcactggactaggtttgggatgcaacactgacctgccccgacccagagtcataatgagccaggccacctccacccactgggtcagctcatctcctctttatcttttctccttctgacctgtgagtacccagatcagggtggacaagtaagagacacatagcaaggtcttatgtgaatacagtgactctaccttacgacgtttttgggagatacaaaggtacttagaggagctcagtttccaaagcagtgctccaggaagctggaaatctgcactatgctctgggctcctctcctccatctccaccctcactattcaggtgagaaagaaccttatgtcgggggatccacacccagctctgctccataccccctcactctctggctcactgggttgtaaacctgctctcatggccctctctgtccccctgcagtgtctgtggcccaggcagggcagactcagcagctctctgtatccaagggcttgggatagacaaccacactcacctgcactggggacagcaacaatgttggcaaagatggagctgtctggccgcagcagcaccagggccatgcccccaaacacctgatcaacaggaaaaacagccaactctcagggatctcagagagattccctggctcccggttaggaacatggcatctctgaccatctctggcctccagaccaaggacaagcctgcctattactgctcagcctgggacagcagcctcagtgctcacacagcgcctcaggggaagtgagacgaaaactcaggagctcccctagcttcactcggtatgcgggggcgtcatagagcactgtttaaactaaaccaaaaatgacaagggctggtttccacgtgacaaagtgtgtgctattcaaaactattaaaaataatatcataagttaaaataactaaatctgcagtattaatgaatatttataggaaacattgttgtgaatatatttgtggctagatacttacatgaacatacacatgcattaatcagtagtaaaaatgaatgcaagggtaaactaaggaaatatttattttcccagattttccttctcttttatttggagatgctggactaaatgctcagaggttccggtggtctgcctttgagtgtgtgttcagcagggtcacctcaagcttatcccaccttcttatgacctgggcccatgcctgtcctctcattagaatcccctttccctctgtcacagagctctctttattccttctacagacccagacttgttcctcacacttagttgaggcttcctgggccccacgtccctgtttgcccccaacacccacacaagacaatgatcccatgtgtgtgctcttgttgtgccctttccttatcctctgacatacctcaggcagtatctggaaagaacaaatgaagtgggagcgttagcttgtagttgaaaatgatttttgatattttggggaaaatatctggtttaaagatagttttccatcgagataaaaatgcatgtgtgacagcaccacatttctaatggcggaccaaagccccccacatctttgccccccacatggctccagggacattgacttgttaatatacaacccaggagagagcactgtgtcctatgcaactgcaatgcagaggcaggtttctgcccgctcctccaatgaagtgagtagcaaccccaaccccatcttcacccatcatttagatgacccccatacaaccacaacatagaaacacattgatcaaagggcctttttctctttgcagagacccctatttgtttatttggcatgtgagattttagacttttaccaacaattaaaatatactttattagaaaagttacacttcttaagaaactctgattcttactgtgaagttaatacctaatgcatcctataagcatagtaagtggaaaattgttctgtaaggagaagattaatcaatgaaataaaatacaagtatttgagagcaatctaataggtaaaagattagaggacataattgtgaatgccaggtgcaatataaaggaaatgtgggccgggcatggtggctcaaccctgtaatcccagcactttgggaggccgaggtgggcggatcacctgaggtcaggagctcgacaccagcctggccaacatggagaaaccccatctctactaaatatacaaaaattagccaggtgtggtggtgcatgcttgtagtcccagctactcaggaggctaagggaggagaatcacttgaacccaggaggcggaggttgcagtgagccaagatcacactattgcactttggcctgggtgacagagtgaggctcagcctaaaataaaataaaataaaataaaacaaaggaaatgtgaatacctagagttgattaaattgtggcccctcaccttcaacactcgaaaagctcagagtgggtagaaaagcttgttgagttatcttctgatgtcattgacaagataaatcagggacaatagaaggaatatgtggaaagaggtgccagaggctagaggggaaagtgtgaagtagccagcagagaggagcctgctggctgactacttgtgttagtagtagcaggtggtgttgacgccatctcccaggggaaaaccctgggaaacaggaaagctaaaagcaggctcaccatcctcatccctaacagaaccactgaagtgagcacaccagagtgtggggttccctcccggctcttcagatgacattgttatttggcaccaagctgatgttagtatgttctttataaatatatattgcacaaagaattgcataaaaccttcaataatttaatgaggactttctcacttaaaaaggtttttatgtctcttctgtggcccccataggtagccggggatccctcactgcatttcagtctgacaactcatcacatggacagagtccaccgtgtgtgactgtgtgtctgtgataataggtggcaaagcttcactgtcatagccgcacctgcttcattgcctggtgcttgcctttctgaaataggaaaataaactcttaccaatgtgtcataattaggttctatttaaaatctcctaccaaagttaagagcagcctgcacaactggtccacaaaatgagaaacctccaatttatttggactcttttctctaccctacccagtgatccaactggtcaccagccatgtggattctctctccaaaacgcttttaaattcaactctcctgtttactttccattctcatgtcttatgtcaaatattcatgtcacttacctagttctgatcagttctctggctccatggacagctcccccaactctgccttcctgaccatctctgggctgcggattggagatgaggctgacttctcctgtcagtctcatgatgaaagctacaatctcacagtgctgcaggcccattgggcagtgacaggaaaactccccagagcaccctcaccctgagtctgccatcagcctctccccaccagcatgggttgctttttcctgtcccctgtttgaatgtttgaattcaaattttctgtttatgtgtctctctattttctttccaaaatacacaactttttctttcttgtcttcatggatggtttttctggtccctgtgaaattactttatgaagaatatttagtttaaaacatagtttctgaacattgtcattttaacattgtgcactgggtcattcattgtgtgaggggggctgttctgttcatggttggacatttataagattattgggactcacacatcagatgcctatagcaccctaattcccaaattctaacaaacaagcaaaaaatgtagacattgcaaaatatcctagggagacagcactgcagaatcacccttgtctgagaaccactggattaaaaggacatggtttcacgtattgggcagccttttgtgttgaaccctccttatcccattccactgaatataaggctacatgcattatatctcgatggttccaaatttcctcttaaacaaatgtgtgggatacaactccaaaggttatgttgacagatgaataatcctctgaacaccattagttcagaaaacctgctacccaatgtacagcatctcttgctgaccagagtgtggagtgaaacatttgaccaaactgtgtgcataattgctaattcaaatttttaggtaaaacacctaaaacataacacattcttctctacttatcctcttaggggttgcttttcaagcatggtgtacaaaattatgacaaggcctcgtatgtgtggagtttacattttagaatgggtagacgacagtagacaagagcagcctcagaactgagcagtcagtgaagtcctttttttagccctagcgctggatgcaaattttaccagctgccatttgtgtttttgggcttgctccacccagtacagtccccatgaactgcatgttgatatgtatatttcaaagttaattaattaaaactaaataaactttaaaaaatattcctcagccacaccagcttcatttcacctgcctcctggactcatgctctccatccatggctctcatgctggagagttcagacacagggcatctccaccatggcataaagttctactgcagagcacagtctgtgacaatctatttaacacttccttaggccagtttcttcattacctgtaatggggatatagtaacactcaagttctcttcacagtctggaacactattctctgtgggagtattacctcggccccttcttcctacagaacggaggagtgataatgtaactagtattggccaataagatgaacagaaatgagaggtgtaatttctgagcagtagatgtaagattagcctgtgctttgtcaagttctatcatctctgacgtaacacccacagtgttctcacagaattctctcaaccatcctgcatcctgggatgaaggtgaagtgaactgaagccccaagcatttcaatcagagatgggaatggtggaggagtgagaaatatacattcgttgtgagtcaccaagatttctgtcaatttctcactgcatccaagcctagccagtactgagtgctatggaaattataagtgaatgtggggagccacaatgacaaaattaacatctatctataaatatatataatatatattaattacattatatcatatactaatattaatatataataaatatataatatataacacttacatattatataagtatataatatataacacttacatattatataagtatataatatacaataattaatctatattacatataatatattaatataaatatatatacataatttgatttgatgcaatactgtgaacatttagtagactacggagattgcatgatgtttcattttattcactggcaaatatttaattaagctgtcaccataataaacattaaaacacacagaattgacaaaataattctcctgagctgtggatatacaagttagacaactgattagaagcataggttcactcctgtgccatttgtggaatttttacaacttatttactttaagtgatgattttaagcataattggtttttgttcttgctttttatttattcaagcagaagaaagacacaagaatgataacccacatacatacagagtagtagaatggcaagagctaattattctcaaacacaaattcttaaagataaatgtaaaatatttgaattaaacattttgctatccaaaaaaaggtatgccgtttttttcctgagtactccagggcaggaaagtatattcatcaatccccctggtgtccgctttcttaacacattgttcatattggtatatatttttttcttattacttaacttactcatcctatatattgtgtttcctaaatatatttcaaattcattctcagccttgtgatttccctcgccctcattatgtcccatgtcctgctggggctcccccataccacccctctcctcatctgtaatgccccctcccagttcctgccctcctgggaactgctgtgctcttttctgccctgagccttgttacctccttcttgtactacctatttgtctcagtgagctcctcttccattcttcaaaggctccagagccctagagaagagcatcatctcaaaaaatttcccaagaagctgcaagtaatgagagtgtctaagaccactctttctgctttatggcaattttatatttaacgtggtattgagtcttgctgaattttcagtctgaagtcataatgtgctcaaatatacaaattccagagacacagagcagaatggtggctgccaggagctgaggggaggaggaaatggggagttgctggtcaacaggtgtaaagttttagttatgcaagaatatgttataaagatgtgctgtgcaacacttatctaaatattaattattaatcaaacaaaaaattcaaaattattaacacacatttccccctgggtttactggacagatgattttatatttgtctctgctaagtagactaaggtgtaaggatttggcacgaaagttgtaaaccacaaacccagccaaaaacaaaatattctttatacagtttttcaataaataaaattaatttaatattgctagtttaataaaatagctgtgtcttctaagttatagataaattttgcatatttttcactttaaggatcttacttaggtaaacaactgcatataccaactactaatattactaagaaaaaatgatttagagaaataaaaataattttcttgtgtctcagttttcacatataatctaaataaatttttaagtaactaaattagatgaatataaatgaagtaaacacttctatctaaactttttgtataatttaaaatcttaaaaaataaattaaataataggtactcttaaaaaagtgtaggtcatttaaaattaaaaatatatattttggatatagttataaaaatattaaaatagttctcatgtataaaagatgaatttatgagagacaattcaaagtttcttacatcctaggttttgagtaaaaattattgttaaaataattaaaaattctaattaatatataattcaatatataaaataagacaaaaataaaaatactaaatatatgtttttaagttaaaaaagcaaagtcataaaatatatgctttattaaaataattttgccaagttaagatgttatataatggttacttataaagcaatataaaataaattagagagatataaaatattataaatatagatatctttttgtaaaaaacattagaacataattttatattgaacaatcttatataatttttgtcctaaaataagatgatttactattttaagaagacaaatcaaaatgtcccaacaagtcttagtctatgtaaattataataaaatacatttgggaattatgtcccaacatatcttactctatgtaaattatagtaaaatacatttgggaattatttaataaaattaagtataattaacaggactataattttaaaaattatgtcttcctaaatattaaactttaatattgaaaatacacaaatacaaaactgaatattttgattttctatgtccaaacacagttttcttaatattaatttactctaaataaaagatttaaacattgatttttaattttaacatctatttctctttaaaacttctcaaaattacacttcaaaagttcaaattttgttaatattttcacacataatttacagacttttattgtcatacctttcaaaaaaatgtaatttttttacttcactgggacaataactcttttctttaacctttttttaaattattatactttaagttttagggtacatgtgcacaacgtgcaggtttgttacataggtatacatgtgctatgttggtttgctgcacccatcaattcctcatttatattaggtatttctcctaatgctatctctcccccagccccccacccccaaacaagccctggtgtgtgatgttccctgccctgtgtccatgtgttctccttgttcaactcccacttatgagtgagaacatgcggtgtttggttttctgtccttgtgacagtttgcttagaatgatggcttccagcttcatccatgtcactacaaaggacatgaactcatccttttttatggctgcatagtattccatggtgcatatatgccacattttcttaatccagtctatcagtgatggacatttgggttggttccaagtctttgctattgtgaatagtgccataataaacacacatgtgcatgtgtctttatagtagcatgattcataatcctttgggtacatacccagtaatgggatggctgagtcaaatggtatttctagttctagatccttgaggaatcaccacactgtcttccacaatggttgaactagtttacagtcccaccaacagtgtaaaagcgttcctatttctccacatcctctccagcatctgttgtttcctaactttttaatgatcaacattctaactggtgtgaaatggtatctcattgtggttttgatttgtatttatctgatgaccagtgatgatgagcattttttcatgtctgttggctgcataaatgtcttattttgagaagtgtttgttcatatcttttacccacttttcaatggggttgtttgctttttcttgtaaatttgtttaagttctttgtagattctggatattagccctttgtcaggtgggtagattgcaaagattttctcccattctgtaggttgcctgttcactctgataatagcttcttttgctgtgcagaagctctttagtttaattagatcccacttgtcaattttggcttttgttgccattgcttttggtattttagtcatgaagtctttgcccatgccaatgtcctgaatggtattgcctaggttttcttctagggttttttatggtgttaggtctttttttttttttttttctttgagacagagtctcgctctgtagcccaggctggagtacagtggtgtgatctcggctcactgcaagctccgcctcccgggttcctgcattctcttgcctcagcctcccaagtagctgggactacaggcacctgccactgcgcctggctaatttttttttgtattttttaatagagacgtggtttcaccgtgttacccaggatggtctcgatctcctgaccttgtgatctgcccgcctcggcctcccaaagtgctgggattacaggcgtgagccaccgtgcccggccatggtgttaggtcttcattcaagtctttaatccatcttgagttaatttttgtatactgtgtaaggaagacatccagtttcagctttctacatatggctagccagttttcccagcaccatttattaaagggggaatcctttcctcattgctttttttagtcaggtttgtcaaaaatcagatgattgtagatgcgtggtgttatttctgaggcctctgttctgttccattcgtctatatatatgttttggtaccagtaccatgctgttttggttactgtagacttgtagtatagtttgaagtcaggtagcatgatgcctccagctttgttctttttgcttaggattgtcttggctatgcaggctctttttaggttccatatgaactttaaagtagttttttccaattctgtgaagaaagtcagtggtagcttgatggggatagcattgaatctataaattaccttgggcagtatggccattttcatgatattggttattcttatctatgagcatggaatgttcttccatttgtttgtgtccccttttatttcatcgagcagtggtttgtagttctccttgaagaggtccttcacattccttgtaagttggattcctaggtattttattctctttgtattaattgtgagtgggagttcactcatgatttggctctctgttagtctactattggtgtataggaatgcttgtgatttttgcacattgattttgtatcctgtgaccttactgaagttgctaattagcttatggagattttgggctgagatgatggggttttccaaatatacaatcttgtcatctgcaaacggagacaatttgacttcgtcttttcccagttgaataccctttatttctttctcttgcctgattgctctagccagaacttccaacactgtgttgaataggagagggcatccttgtcttgtgctggttttcaaacagaatgcttccagtttttgcccattcagtatgatattggctgtgggtttgtcataaatagctcttattattttgagatatattccatcaatacctagtttattgagagtttttagcatgaagggctgttgaattttgtcgaaggccttttctgcatctattgaggtaatcatgtggtttttgtcgctggttctgtttatgtgatggattacatttattgatttgcatatgttgaaccagccttgcatcctagggatgaagctgacttgatcgtggtggataacctttttgatgtgctgttggatttggtttgccagtattttattgaggattttcgcatcaatgttcatcagggatattggcctaaaattctctttttttgttgtgtctctaccaggctttggtatcaagatgatgctagcctcctaaaatgagttagggaggattccctctttttctattgattgaaatagttttagaaggaatggtaccagctcctctttgtacctctggtagaattcggctgtgagtctgtctggtcctggactttttttggttggtaggctatcaattattgcctcaatttcagaacctgttattggtctattaagagattcagcctcttcctggtttagtcttgggagggtgtatgtgtccaggaatttatccatttcttctagattttctagttttcttgtgtagaggtgcttatagtattctgatggcagtttgtatttctgtgggatgggtggtgatatctcctttatcattttttgttgtgtctatttgattcttctctcttttcttctttattagtgttgctagcggtttatcaattttgttgatcttttcaaaaaaccagctcctggattcattgattttttgaagggttttttgtgtctctatctccttcagttctgctctgatcttagttatgtcttgccttctactagcttttgaatgtgtttgctcttgcttctctaattcttttaattgtgatgttagggtgtcgatttgagatctttcctgctttctcttgttggcatttagtgctataaatttccctctacacactgctttaaacgtgtcccagagattctagtacgttgtgtctttgttctcattggtttcaaataacgtctttatttctgccttcatttcgttatgtacccagtagtcattcaggagcaggtttttcagtttccatgtagttgagtggttttgagtgagtttcttaatcctgagttctagtttgattgcactgtggtccgagagacagttttttgtgatttcttttcttttacatttgctgaggagtgttttactaccaattatgtggtcaattttagaataagtgcgatgtggtgctgagaagaatgcatattctgttgatttggggtgtagagttctgtaggtgtctattaggtctgcatggtccagagctgagctcaagtcctggatatccttgttaaccttctgtctcattgatctgtctaatattgacagtaggatgttaaagccttccattattattgtgtgggagtctaagtctctttgtaggtctctaaggacttgctttatgaatctgggtgctcctgtattgggtgcatatatatttaggatagttagctcttcttgttgaattgatccctttactattatgtagtggctttctttgtctcttttgatctttgttggtttaaagtctgttttatcaaagactaggattgcaacccctgctttttttttgctttccatttgcttggtagatcttcctccatccctttattttgagcctatgtgtgtctttgcacatgagatgggtctcctggatacagcacactgatgggtctgactctttatccaatttgccagtctgtgtcttttaattggggcatttggcccatttacatttaaggttaatattgttgggtttgaatttcatcctgtcattatgatgttagctggttattttgcccgttaatgatgcagtttcttcatagcttcaatggtctttaccatttggcatgtttttgcagtggctggaacctgttgttcctttccatgtttagtacttccttcaggagctcttgtaaggcaggcctagtggtaacaaaatctctcagcatttgcttgcctgtaaaatattttatttctccttcacttattaagcttagtttggctggatatgagattctggtttgaaaattcttttctttaagaatattgaatattggcccccactctcttctggcttgtatggtttctgctgagagatccactgttagtctgatgggcttccatttgtaggtaacctgacctttctctctgggtgcttttaacattttttccttgatttcaaccttggtgaatctgacaattatgtgtcttgggattgctcttcttggggagtatctttgtggtgctctctgtatttcctgaatatgaatgttggcctgccttgctaggttgagtaagttctcctggataatatcctgaagagggttttttttttttgtttttttttttttggttttttttgagacagagtctcccactgtcacccaggttggagtgcagtggtgcgatcttggctcactgcaaactctgcctcctgggttcccaccattctcctgcctcagcctcccgagtagctgggactacaggcacccaccaccattcccggctaatttttcatattttttggtaaagacagggtttcatcatgttagccaggagggtcttgatctcctgacctcatggtctgcccacctcggccttccaaagatctgggattaggaggcatgagccaccgcacctggccctgaagagtgttttctaacttggttccattctccccgtcactctctggtacaacaatcaaacatatatttggtcttttcccgtagtcccatattttttggaggctttgttcatttcttttcactcttttttctctaatcttgtcttctttgtttatttcattaatttgatcttcaatcactgatatcgtttcttccacttgattgaatcggctattgaagcttgtgcatgcgtcacgaagttctcatgccatggttttcagctccatcaggtcatttaaggtcttctctacactgtttgttctagttagccattcgtctaacctttttcaaggtttttagcttccttgcgatgggttagaacatgctcctttagctcagagaagttcgttattaccgaccttctgaagcctacttctgtcaactcgtcaaactcattctctgtccagttttgttcccttgctggcgaggagctgtggtcctttggaggagaagaggcactctgttttttggaattttcagcttgtctgctctggtttctccccatctttatggttttatctacctttggtctttgatgttggtgacctacagatggggttttggtgtagatgtcctttctgttgatgttgatgccattcctttccgtttgttagttttccttctaacagtcagacccctcggctgcaggtctgttggagtttgctggaggtccactccagaccctgattgcctgggtatcaccagcataggctgcagatcagtaaatattgctacctgatacttcctctggaagcttcgtcccagaggggcaccgcctgtttgagacgtctgtcggcccctactgggaggtgtttcccagtcaggttacatgggtgtcagagacccgcttgaggaggcagtctgtccattctcagagctcgaacaccatgttgagagaaccactgctctcttcagagctgtcagacagggacgtttaagtctgcagaagctgtctgctgccttttgttctactatgccctcccccagaggtggaatctacagaggcagtaggccttgctgagctgtggtgggctctgcccagttcatgcttccctgcctctttgtttacactgtgagctactcaagcctcagcaatggcaggtgcccctccccccatcaagctgcagtgtcacaggttgatctcagactgctgcactagtagtgagcaaggctctgtgggcctgggacctgctgagccaggcaacgggagggtatctcctggtctgctggttgctaagactgtgggaaaagcgcagtatttggtcaggagtgtaccatttctcccagtacagtctgtcaggcttcccttggctaggaaaggggaatcccccgaccccttgtgcttcccgggtgaggtgacaccccaccatgcttcagctctttgggttgcacccactgtccaactagtcccaatgagatgaaccaggtacctcagttggaaatgcagaaatcacctgtcttctgcgtcgatctcactgggagctgcagaccagagctgttcctgtttggccatcttggaagagaccttccctgtgtattccgagccttctgcattctgccatcactgcagcctcctcatgttggatggacctgatatttttgcttttctagtaattcagaaatcctcagtggaaaggctgtttattaatatgagttatctccagacagggcaaaggtgtggtctatggatgctgtggattagcaatgaccaggctctcaggtgactccactcatgtgattttcacagaaagactgctgtctggccagtgagcagcacagggcactgtgagtcacactcagtgtctgcacagtgaaaacccaaaacttgccacccccccaaactccccagggctgggtagatggagtctgcactcactgacacagatttagcagctagatatggtcccagcacccccaccttcttccaagtcctgcgtgccagacaccccgacaacagctcccagatactgataaatccatggggagagttgggggtaggcagtgggagcaacacacttgcatccataacccctcctttgtgaggccactgaaggggataagagaggcctggagaagccactccagttctggacctcaggagggctgtgtccactgtgacctgggcacctattctcctgtgatattctatcatttctcaggtagggacaggtctcacgtcctggggaagccccctagcctgagttcttgccctgtgtttcactctcaccctttgtcctgattcctcacccacgatcatctttgcttgcaggttccctctctcagcctttgcttattcagctgccctccctctctgcacatctgagaaatgctataagacttccctgtaccccaagtagtggctgcattgttggaggctgtcacatattcttgtaccagcagaagtcacggagccttccccagtatctcctgagatactactcagactcaagtaagcaccaggactctggggtccccagtcacttctgtgaatccaaagatccctcgggcaatgtgcagggattctgcacatttctgagcagcctgagatcaagtccgactattactattttacatatcacagcaacagtggcactttcactgtgctccagacttacggggaagtgagattagaacctcccctgcattctctctgccttgtgcaggcaacaatacactgtctgggaccgagtgtggctcatcagtagcagctttgttgtttgtatttttcattcttcagtacagggtgggacctttctactggcctccattaatagtgagagtcaaacaagacagtctgtgggtgactccaaagtctaactcagggtttccttatgttagttagcttggactactcttggctcctccccagagatctcaacttctctggaattctccaggtgccacaagcactgatttcagtcttggccttgcacctcccctgagcagcttctgactctcctctcattacatctccatttatggcctgtcacccactcaatgtgttaaaaggtaaagcattttgcaaagtacttatcctgaactttagccccaaatccacccagcttccctagcccaggccagctctgcttcttatgaggctgatgagaggtacaagggctgcgacccttgctgagtccattcctgaaaatgcccccaataaagcctgattagcgccaatgccacaggacattgttctgtttcctttgcaggtggtgcccagtgaggaaagttcttcctcctgaatatgaatattttggagcatgaaacagctgagctgatctggggaggggaggcaaccccttgtgatggtggtcagattgcttggttgggattgtcacagaccatgtgataatgggattatattgcatatcacagatgcgctggaccctcaagtgtgctggggaactctggttaaagaatagaagtgatccctttgttcatattcactatgctggatgcccttttgagatccctgcaggacgctaaccctctgactgcggcagccttgccctttgatctgaagcttttatcatacattgtcctgctcaggggatttgggtggggcgttactcctatatatcatcacaagaaagggattctctggagactaaatgcaaactggaatatcccctggaggctgtccccctgattgggaaatatgaagagactaggggtgctcagtgtttaaaataaaacttcagagagtagagtctgagtgtaaacccttcaattccatttaatctctacaaatgtatataatgtcaaaacatagttatgtcatatatttacacatgtgcacacaaatctattaatacatgttcataagttcacatatatgctttatgttatacatatatgcatttatacatcaactgatgttattataatcatagttttacagactcaattttcctttgggtttttccacatttccccactttctttaacacttatttcttgaaaattttggtggctgcttactgagattttactaaaaaagagcttcagaatttcatttagagtagatcttgtggcaaattctattttttttgtctgaaaaaatggtattttttctcttttttatttttaaaacttatcttgaagcataatatgtaaagtgaaatttgcagatcttaattgtaaatttcagtgtgctttttatgaacacatatactcatgtgccccatgcgtactcacaacatttccattactgcagaattaaaacattttgttctagtcaatgaaattattccattacagaatagatatgtgtaccacatagaatgtgtacctgagacacacttcccctggggactccttataaagtgcggtgaattgtgtgtcttttttcccattgaggaggccaatgtggaaaactaaagactgagatgatgtagaaaactgccctgagagggaacctcactctgccctgaggtagggagccagcactggtcaaggccccggtggaggatggcacctctgttgggtccacctggcctctggtcacaggcacgatggacctgggcctgggcagcagggggcgctgtggggctggcacttagagtctgtggggctcttagctgggaaatgatacctggccctggcctctgcctagggctcactggggccagcagctgggtcctctctgggccctttgggagcctcagtccaggtacatcccaggcctactcttcccagaaatgacccagccactgggactgcacacgggcccagggaggggcacgcttgggcaggggaagaggagcacatttgcatgaaaggcccatctctctcctctaaggctagagggtgaacacgagagacctgccgcgtggcttcctctgcagagatccggggagtctgcaccatggccttgaccccactcctcctcctcattgtcctccttcactgcacagtccaggacggcacaaagcatcctgatcccccagctcactgacaccacctcccaactcatgccagaactgtccttccctgttctgctttattcagtgtataatggctgtctgtgttttcgggatccctctggcagcccgtgccgactcagtcgacctctgcatctgcctccctgggagccctggccaagctcgcccacactcagcagtcagcatagcagctatgccattgaatgctttcggcagcagccagggaaggcccatcagtacctgatggagcttaagagtgatggaagccacaccaagggggctgggattcccagtcactagttctcagtctccaggactggagctgaccactatagtgtcatttctacaatcccgtctgaggatggagctgactatatctgtggtacagattgtagcattggtgtgccgtttgggtaaagcacagataaatggggaaatgaggcaaaaactgtttttctactctgctaccaaggttgaaaaatggctctcagaaccagtgtctgctgacctgcatactcaaatatgttatgtgtgtgtgtgtgtgtgaatgcgtgtgtgtgtgtactttaattttacgagtagagagccagatattttctgattcctgcttccagttcccttggaaacagctttttaggccaggccttctagggagtgcactctgatctgtaactattgtgcaaatattacaacagagcctgtctcctcctgctggtctggtgtattgtggctatataggggggtgcaaagaaattctccttttcatattcagacactgggactcagctgcatacctcagtcctgtcttattgagatcatttaaatgatcaatcttagaagaaaacttctgacttaaataaattttagaagtctatcaacatgctagaaagcatattccagataaataaaaatagaataaagatttatagagattgagatgaaaagctttaaaccctttgggggtttctgaaggtattctcaggtgttcagtgcctgggatttgggagtaagggataaggaggagaacttatttccaacacactgaagatgacaacagataagcagaaagttaccaaagaaggaggaatagaaatagccatgaatatcatcctggtaaccctgatctggaatgaaggatttcatttatttacttatttatgtatttattttcaaaataagtacatctcatggagtccttggcaaaagctgaaggaagtattgcttcaggaaatatctgtccagtaattaggaaactactaatgtgattgagcagagacttcattaacttcacatgcaaagaatacagacttgcagaaccctcctggaaaaccatgaaacaatacatcatcaacaataacaactatagcaaaaacagcaacaacatcaaccaaaacgctttacaaaaaagttctaatttccagaactgtcacattatattatttaaaatttccatttgtcaaagcaaaataatgaggtaggttcaagacacaggaacatattgccatatataacggaaaataacaaagaaaaaaacattaaaaaaacaaaaaaattaaaagttgacaaaaactattttcaaagaggcagaaacactggtcttattcgaccaatacttcaactccattatttctccatttgctcaaagaaattttaaaaatgtaaaaatgttcaaaaaagcatgaaaagaatgtatctccaaataaagaatattaataaaagatataaaagaaagagtcattgaaataaacatagattaattgatattatcctattacaggaatagaatgaaataagggtggaaaaatacgcaggacctaaagaccctcttgacaccatcaagtgtaccaatatacacataatgaaaggcccagaagggtaagagtgaggaaaagaaacagaataatgtaattgaaaaatggtaaccaaaactttcccaaatttgacaaaaagaaacatactcaatccctaaaaagttcaataaaccttaatcagcattaatcggaactcatagatataaaacttatggaaagcgtcatggtgggataaagcttactaagttctaaaaagtcaaatagacaaagacggttacaccaaaagtgtgtcaatttctgtttcctgccatgatgcaatagatggagttcttacaccataaacaacactttaagacataatcgagtgcatgtaatgactatttccagacagtgaatattggccaacagggataacttgattatgtaacctcagagaaaggaccctaacacgcaaatgagcactgcagtggacacggatttctttttcttcactttttttttttcgagttagggtcctgctctgtcgcccaggctggagtacagtgatgtgatctccgctcactgcaaactctgcctcccaggttcaagcaattctcctgactcagcctcccgaatagctgagattataggcactcaccaccatgcccagctaatttttttgtccttttagtagagagggggtttcgccatgttggtcaggctggtcttaaactcctgactgatctgcccacctcggcctcccaaagtgctgggattacaggtgtgagccactgcacccagccaacacagattttttttttttaattatactttaagttttagggtacatgtgcacaacgtgcaggtctattacatatgtatacatgtgccatgttggtgtgctgcacccattaactcgtcatttaagtatatcttttttttttttttttagacggagtctcgctctgttgcccaggctggagtgcactggctctatctcggctcactgcaagctccgcctcccgggttcacgtcattctcccgcctcagcctcccgagtagctgggactacaggagcccgccaccacacctggctgattttttgtatttttttagtagagacggggtttcactgtgttaaccaggatggtctcaatttcctgacctcgtgatccgcccgcctcggcctcccaaagtgctgggattacaggcgtgagccaccgcgcctggaccacagatttttttttggagacaatttttggcccagaaggaggtggtgaccaagataatcgtgagctttttacacagctcagaacacacagatgagaagtcagaaaaacatagatggctgagactttcagagcaagacactgaaaagcaggcagctacacagagcaaggtccctgcgctctgcatgaggcccctttggatttggttgggcaaaacatgacaccttgcagggggctctaatttaatgaataggccttcccctactgggaactaagattcatattttttctctctgtcctgttttttcaccactgtatctacaaaccctaggactcagcctagcgcaaagagccaattaataccatgtttgttgaacgaatatgtgaattcacctaaatagaattctcagtaagagaaaaagatctgaggaaaataaagtgatttttactgctttatgtgtattttgagtttgggttgtgaattgattcaaggggatatattaaattagaatgttgacctccgtgtttagagaacaagagaggaatatgaacttgagtgctggaaaggtgaccagcaggatggactgggtcccatgggtttgtgcagagaccatggaaaaggatgagcctccagttactaagtaattgaacaagatatattttaggtaaacacttattttataatcacctgttggaatgggtgataactgtagatgtgactgttattcattgactctctgaaaaaattatttattcaaggcaagaaagattggagaatagttttatcttgaaacacttttcataaacatgacatattcttgctaaagcagataccatattcatctccaagctggaagggttatctcatcttcccaaacatgcaccccttatagtatattttatctgcttttatggcatgtccactttcttggtcacagacattgtaagcctcagagtttaatttgtttctctactgtatacgtatggcacctccagttggtcactgaagctggagattgaaatcctctacatcccccagatctgtcctctggctctatggcgctgtcctgttccatcagacctacattgcccttccttgtgtgaaccctaacctaagtccaatctctactccatgaaagctgtctgtaacagaagcctggcacctctttctcctttttatgaaataaatatctatttctatagatagatctagatctagacattaatagctccaaatctgtagaggacaaagtgcctagttctcaggtgataaccaacccacatcttctgtcctggaatatccagccccagatatcaccccattttctcctccctgtctcgctaaatatatattcacccaccaagccactgggtttgtagtaatttgtcacaacaagaacagaaaaatatgtggaaaagaatggaagaggagtgttgctgttaaaaaaaatacttaaaatatggaaatagttttggaagcagacaagagatagagtttggcagaattttggaaagcatgttagaaaaatcctagattgctttgagcatggtgttaatgcagatatggttgctaaagacttggctgggatgggctcagtaggaagtcagaagcatggtagcgaaaaagctacattttctttcttttttttctttctttttttttttttgagacagggtcttgctgtgttgcccaggctgcattgcagtggtacaatcttggctcactgcagcctccacctcctgggttcaagcgatttttgtgcctcagcctcccaagtagctgggactacaggtgtgcgccaccatgcccggctaaggttcgtaattttagtagagatggggtttcaccatgttgtccaggctagtctccaactcctgacttcaaatgatctgcctgcctcagcctcccaaagtgctgggattacaggcatcagccactgtgcctggtctagttacatttttcttagcaaatacctaattatacatctacagactggaagtagaaatacagccagtaccagcactttgggagaccaaggagggcagatcataaggtcaggagatcgagaccatcctggccaacatggtgaaaacttgtctctaccaaaatacaaaaaaatttagccaggtgtggtggtgcatgcctgcagtccaagctactcaggaggctgaggcaggggaatcacttgaacctgggaggtggaggttgcagtaagcccagacagatcacaccactgccctccagcctggtgacagagtgagactccatctcaaaaaaaaaaaaaaaaaaaaaaagaaagaaagaaaagaagataaaagaaatacatccagtaaaggagctcctggtgcactgatgggagttcacagggaattaagagcgctcttttgacttttgtgggaaaaccggaggaaaggggatcattgttttttggtggaaaacaggttggctggattgtttcatgcaattgtatggaaagcagaacaggtgagcagcaaacttggatatttagctgagaatatttccaagcaaagtattaaaagtataacctcattcattcttgctgcttacagtaaaattttgtgataaaaaatgtgaagtaagggaggaagtcttaaatggaaagaaactagggcatgataattgaggagattactagcatatttcgccaattacttgctcattccctcttttctgggagaccctaaaagtaactcatcatttactgttttccatccgcttccttccttgtctagaatatgggcctggaccctccacaagatgcgtagagaagtcagaaggccttgtcctgtgcaagcattcaagcatccactcctcgcactaatatttctagacagcaaactggtgatccttgctcacctgaaacatacatacgggttggaggaagacagaacctaacacaccttacctgtgtgatgttcagggctggcctctaacttctgagagcttcatttcactccacttcctacaaggattgctcatgccctccttcacttgtggtgaagttcaaacaatacattagatttgacatctttgccaagagctgtagagtgcaaggtgctcacccagagctacatcttccagcagatgaggctcacagttaaatcactgctatggtgtccgtcaactcaggcactgttgtgccttttcacagagcatcgcctgttaactgcttcacccacccactgtgggagtccaggtaggaggacaatgcctccccactagctggctcctctctggttgtacctgtgggtcacacatgcaggtgacggtttgtactacctcctacctggctgtactccccaaagccagggctgacacccctcactgcacttccattccatcccatcagtcacaggaggcagctattggctcattaccctttgcaaggagttcaagggtagaagtggcccatttataagaatatttatatggactatcttgtatatcctgtgaatcatgatactgttaaatcaactctaatacatcatgtttatgtccactgaaatgatgatgataaaaggaaaagtgatatctggacacgcagactgaaaaagatcccaaagattctgcacacaaggcccctattctctggggacatgtgggaattcaatggtcttgctgacatatagagtttgcttcactctgtgtcaatctgaggcatttgtgacctcagagttgtgttttctaagaatttaccatgtgtggcagctggacttcaagttatacctaaatatctctgtctcctagcactcacatccctgtacatattgaaaagggatcactagtacaattgataggatattgagaaaatgactgatgccaggccataatacactttgagttttgcgttctgctctctcagatcacttgctttggggaaagccagttgccatttgtgaggacactcaagtagtcccacagggagtttcatgcagcaagaagctgaggcctcctgccaccagctttgtggctcagtgaaactgtaagttgattctattgccttggtaaagtcttctcatggctttagttccccccactgaaatcctattttcaacctcatgagcctatctgagccagagccaccttgctaaactgctcccaggtttctgacccacagaaactgtgggattgcacatctttgcagttgctaagttttgtagtatttgatgtgaagtaattgaaactggatgcatcgagagaggggaatggaggtggcagagtgggtggaattaggcctggaggtctgctttcagtgagatgtgatgggaccatggcagacacctccctgtttctgattccagtggattgcttactgggcctggcctttttcttatactccatgacttcattgttaataccctacaggaattctgtatgcgctatgtcttatccatcttccttgggtaaatatttaaatataaatgaatcaaaacacatgggccactttctaatcttgattgttcaaaactgaattcctcaaattgaggggtatgattttctttattgtccttggtgctcgtctgccagtgtctatcaatggtagaatcatgtaaacagtcccctcccctattttgtttcactctctgaggacgagagagaagtcttggccttcaacagaaaatggtcaaactagaaagagtaacacttttgagctcctcagtgaatgtggccttggaaaaccccttcacctgggcagcaaaggaagagggagaaagacagagcctgaactggtaggaagtcctacctcaaaaacatcagtcagtcctcacatggatggccagggcattaaggagaactaattaagttaatttcacattctccatgacaaatgctgttgtcatcagtagggacctctcctctctttttccatcctcctacctgttctcactgtccctgacttacccacagtgaactttatgttttcaccttttatatccctatgcctggtcctctgctggcctgtgctgatcttttcataaatatttttgaaatgagaagacgcattttcttaagtaccatgaaagtcgacatcacatccatctttcagggtcctgctcccagactcttctgacttatctgttcactgtgctgggttggcagggaaaagtcatctgcagcagaaaaagtgacaaaatggagatacatagtgtgtcttggccaaaaatcagccaacagatgagagagatctaggattgtgagaagttctgccgttccccagcacctcacactatttgatgtctcaatgtttgtacatatcactatattttctagaagatgcactacatctagaaatagtgtttgctttgtttgtccccaagcaggaccccactctccactcagagccagttcacagttgccttcttccctggcccctgtggaaggagctgctcaggtgtttgctcccagagccctccgcattttccccttactgcggcctcctcacaatgaacaattgtcatgtttttcatttctcctgttcctgttattctagaaatccctcaatcaaaaaggatggttatgaatataagttacctgagacagagcaggggtgtggtccatggatgctgtgacctgacagggacccagcactcaggccaactccactcacatgattctgactgaaagactgaagtgtgcagcagggggaaatctgggtctttccaagctctgaacagtggtgcccacatatctgttatccctgggcaatggagcctgcactcactgaggaagataccacagctgtgtcttctctgggctgggtagagtctcctactcacaggtctgtggaaggtgcaggagctgcttcctcacttactcctcccgtgggacaaacgctgagtctcacccaccaacccaccatatctaaagaatcatgctcagacttcagctcttcctagggtggaacaaagattaccaggaggatacacaaatttgtgtggacagatcctcccttttcaggccactggagaagataaaagaggcctgagttaagcagcttcctctgtggggccacaggaggcggtgtccaccatggcctggacccctctgctcctcatgttcctctctcattgctcaggtgagaactggttttaggtgtctagggttagctccttagcttgcgtcagcctctctggctcagatccccaagacatgtatctctagttcctgccccagcccccatgagtgtctgtgcttgcaggttccctctcccagcctgtgctgactcagatgacctcactctctgcatctccgggagcatgagccagacttacctgcaccctgagcagtggcttcagagttggtaactttgcaatatagtggtcagctgaagccaggcagccgtcccaggtgtctcctgagatactactcagactcaaatatcactcagcaccctggggttcccatccacttctctggatccaatgatacattagccaatgcagggattctgtacattcctgggctgaagcctgagggtgaggctattactgttgtacgtgtcacagcagctccaagtcagcactccagacccactgggaggttacaaaaacctcttctctgatctcctggcctggtgtagtcactcctgctggtggctctaataaagtctatctcactgggtgacttatattttagatcttcaaccagcacctgattctttttttcagacaagtagatctgaaaatgtgactttattttcttcaattccactttcatattgattcatgctcataccttctcatttctttctggttttcacaggcagaaatcccttgctcagagacaaaaattctctaaattgagactttggaggagaccaaaagagagtggttcgggccatgcccggctcagagtctaggagtgactcagagatgcttctggtcccagagcttcaatctaggcattggatacaataccagcattcacaatggaattgtattctctatattagcaacaaaccatcacagattttgaaataaaaagaatataatttataataacatcaatataaaatatttaagggtaaatattaaaaaatggaaagtcttaaactgaaaactataaaacgttgagagtcattacaaaaaaaccttaaaataactgatattccttgtttgtagttggaaaactcaatgtgattataatttttataatgacaattctttccaaagttatctaaggaatcattgtaaggtcttcagtaaaaataggtttgcagggaatgaggagataaaaaaatctcaacaaagaaatgaaaactgtaacagaaaacatcaatgaaacaacagacctgggataatccttctcagctgccatgggatctaactgtatttaagaaaggggtgagtaggaaggcggctgccaaatccaggaacacagatgtcattttgagtgaccaaggtgagccaagggaggacagctttagtcagaagagcatagaccaggagcagaactcacatatctgaagctgatgggcagagtgtgggtgcaataggcctggcattgggtgctgctgagctgaaattatgctgtcacctgaggtgcgcccctggggtgacatggttctggttgttcttcaccccagggaaggacactgtgacctgttatctgttggaggatgaggactcagaaagctctttataagagagggcaccagtgtgatatgagggtccctgattgtctttccaaaggttggaaattgaacccgcatctttcatttttgtgtagagaacccaagatccttttctacataatcaagggttatttccaatagctgccttggcctgtctcagaaagagtgtgggtttgtcttacagcaatggtgcccactatttatgggaacgtcttgtataccctgatctatgctttcaggtctttgacatctcaggtttttggcctacctaatactagccatacgtctgggtactgtgatctacctcctactacacatataaatgcccatctcagcctcatctctccttgggatataaatgtgtgcaagggatttgaagcagctctgccttctttttgggtcctaaggatcagggttatgggtgtctccatccttccctgggtcttctcctcctcactgtcctgaaacatgacccagacacaggctcctgaggctcctgcaggccttcttccctgcttttgccaactgcaggtggaccctgccctgtgctcacaggtctttgtatctctccctgctggtcaattgccctgcaggggcttttcttatttctccattatgagaattcctttgtttttggaggaaataatttttatctaatttttgatttacttatcataatcctagaatttgtataaaaactcctgtttttgcataatgaaacagttgctatctcatgccattttattcaaagtcatgtgcttctgttcacttactggttagaactattgtttaatcattgacaaatatttatcgaacacccactctgcgccatgttctcctatgtcaggtgctgggtatacattgatgaatgaaacagactctatccttatggaacttgtgtctagtgagcttagaagtaaattttgtgagtgctaggatggagagtcaagctaaggactcttagttctgccagcatttaacatgttgttcttatacattttaagaataaattactccagaagaatctttttgttttgttttgttttgttttgttttggtgaagagtatccacatagacacacatagcaaagaccttatagaatgcatcagagataaacaaaataaaatgtaatgtttcccagagctggatgtagtttctggtttgatttattttaatgacacacagaagaaatcactttataatgaagtaaaattccacactacagaaacagagtaaaaatactttcttgaaaaaaatgccaaacctacctttaatcccaaggaaagagaattgcttgaatagatctgttagtatgaaacacataatagacaacctgctgtgtaaaattacttggaagtcatattttagaaggttttaaacattcttaatatactctgtttttgatattacgtcttatatttttctctgtggtggaaatttatttctaagaaataagaaaggatattagaatggcaaaaaatatttgtataaatgtgttaacattttaatggtaactatatatgaataaaataaaaacattgttaaaaatttattggaatgaataataaaattatcaagtttataattaataaaatcaagtatatttcttcttatgcaatttaaaaatagtgcagaatgtttattattctggtatcactaaaaatgacaaacttcattcatatctatagaaaaataattataaaattcagcaagtaatacaggagataatttgaacaaatattgaaacattttcttacttaaagacactaggtaaaaatttcagcaatgagtagagaggttatcaaggcgcattttattattgatgattgatatatgttttttctctcgagaaagtgcacaggtgggtatcagcagaggagacagtataggctccccagatgtcaaagcagggatgcgccaatacccatcagtcatcatcataaaagacagactgtgccttcctgtgtcaggctctgtgccaggagctgtgtgccccacgttcccttccagggtcctgcctgaagtctgtgctcactcagccagccccatcatctggaagtaacagtcccctcctcctgcactggaataagcagaagatttgggtggacagtgtggcctggccccatcagctcccaggagaagctctctgtctctctctcatcctgcatgccagttaatgacgataaaacccacctaaccaacccatctacaacactcagcttcatccctatctctctctcacactccatcaagggacacagtcatcccatgggttttttcccctggcatctctcactttcttcctcttccagatccctgggatcagctatcaccccacccgacaccccttctcctgcttggctgccttcaggctctttgttgagcctgacaccaaaggatgtctttctaaagtgtcagtttcatctattctgcccccagttcacaacctgaaacaacctccgatagtgaatcaagccaagcccctcactctaaagcacagagacatgccatgaattcctaaggggatgacagaatacatcattgatgagaagattgaacaagtgaagtgtgagtggcaagtcaggtgaggacatttgaatccaatctggcatttaaaatgtctcttcatttccaaagtcctatctctccctagtaatgttgtttgactgctagtcccagagcaggaccccacatcccagtgacagccaagtcacagtcgcctccttccctggcccctgtggaaagagctgctcagggctttgctcccagagccctctgcattcccaacttcctgcagcctcctttcattggatgggggtgatagtttgcacatgcctttctagtaatccaagaaaaacttactgaaaaagtctgtttgttcatgtcagtaatcaggggcatgaccagggcatggcccataaatgcctctggactgatactcaccaggctcccaggccaacaccacatacatgatttccactgagagaatgcagtctggacagagagcagcagggtacactgtaggtctgcccagtgggcatccacagctgtgccaacccctcccaccccacaaattcctcagggctgggcagtggaccctgccctcactgagcctgactcagcagctctgtcctccctgggtgtggtcccagcacccacttcctcccaggtctggcctgccagactcccccctccaccagaccctaggacttgaataaatacatagggtaaggtagaggcaggcaatgtgggggacacatttgggtccataactcctcctctgtgaggtcagtggaggggataagaggcctgaggcagcccactatggctgtggacctcaggaggactgtgttgaccatggcctgggcccctctcctgctgtttctctctcaattctcaggtaggcacaggcctcccatgtccagggcatgtccctcaggcttcaccagtcccctctggctaaaatcttacagcaactttatgctggtaggtggcccaactcccatgtgcatctgtgtctgcaggttccctctcccagcctgtgctgactcagccgccctccctctctgcacctccggatcagccagactctcctgcaccctgagcagtggcttcagtgctgatttctgctggatatactggtaccagcataaaccagggagcctccccagtatctcctgagccactaccaaaattcacttcatgaccagggctccggggtccccaggcacttctctggattaatggaaggccggtccaataaagggctcttgctcatatctgatctccagtctgaggatgaggcttactattactgtatgatcgagcacagcagagcttctcatgctgacacacacaggtggggaagtgggacaaaatctcagcctgctcagagtcttgttctctgatgaaatttagatcttaaaataacttatatcacttgtgtgggatgagtgagatatcccgagctcacaggaactgtcgatgaaaagagtcgagctctgtaaaatattgaagacatttattccaagccaaatatcagtgaccaatggcccacaacgcagccctcaggagatcctgagaacatgtaccccaggtggtcaggctgcaacttggttttatacattttaaggagacatgagacatcaatcaacacatgcgagatgtacgttggttgagtccaggaaggcagcacaactcaaagtagtggggctccaaagatcgtctttttgataattggttaaaagagttaaattattgtctaaagacttagaaccaaaggaatgcctgggttaaattaaggcattgtagtgaccaaggttttgttgctcagaggaagcctccaggtagcaggctgcagagaaaatagattgtaaatctttcttatcagatgtaaaaagtctgttctctcagaaattccaaaaatgaggaggcatatctggctccccgttcccatgatgacctgaactctctttcagattaactttggaatgcccttggccaaaaggaggggtctgttcagatggatgggagtcttagaattttatttttggtttacaatcctgtaacacgtcctgtaatttgctgcccagaggtcattaatggcctggaagaaataatgtgccagctgcagtgttgtccacagaaagacttactcattctgctgccctgagtagtgatatcagaaagatccatctgccaacagtcagaatacccttccaggagggttgcacagtaccaggggtgctggaagacctgggatctgaggcaagcagggggcactgttggatggatcccaagatgacaggattaccaggccacacaaggattaaacaagagacagtaacagtccactggctcttacacacttggataagcagtgacctccctgaagaatgactttcctgcacctgggctgaaggacccacatgagcactgggttttggataaaatagagcaatttcatttatgaacatagatgtgaaaattcctcagcatattcacaagtagaacccatgctggacctctgacctctaggatttaggctgagaacaggacatttgtgaggtcggtggggaataagcatgaactttggagggacagcaggtatgaggggtgctgagccgtatgttagatgccccaatcagggaaagagcctcgaggcttccagtgcagcttccctgataccctgtgggagagaaagatagatactggatatgctgcaatagagctcactaatgctctagtaaagagcaggcagcttgcattagcacagtccttcaggagagaaaacgcagccccaggaaagctgtcagaggccaagatgactcattagtcacattgaattcataatgcatttatgatgaaatatatgataaatgtcttatccttttgttcttttttattttttattatcgtgggtacataataggtgtatatatttatggggttatgagatgttttgatacaggcatgcaatgtgaaataattatatcatgaagaatggggtatccatcctctcaagcatttatcatttgtgttacaaatgatccaattacactctttacataattcaaaaaagtacaattaaattattatgaccataggtatcctgttgtgctatgaaatagtaggtactattcattctttctaactactttttgtacccattaaccatccccacatcacctcctactccctgctaccttcccagcctctggtaaccattattctactttctatgtacatgagtttcaaatgttttgatttttagattccataaaaaagtgagaatatgtgatgtttgcctttctgggcctggcttattacacttaatataatgatctccagttccatccctgttgttgcaaatgacagactcttattctattttatggctgaatagtactccatcgtgtgtatttaccacattttttatgcattcatctgttgatggacacttagattgcttccaaatcttagctaaacagtgctgcagcaaacataggagtgcagctatttctctgatatactgattttctttattttggatatgtatccagcagtgaaattgctggatcatatggtagccctatttttaggttttttgaggaacctccaatcgttctccatagtggctgtactaaatccaagaacattcaaaatcatatttatatcagtgctaaaaagtgtgacttgacttcaaacaatagccagtagttggtaggaatacaagtataagtttgctaaaaatatgatttgtcatttatatgaatatttctgttcccagaacaatctcatgtagactggcttctggaatctctcctacctcctactgagctgactctcctggagcctggccgtaacggtgcagggctggaagctatatactacaagcacatgctgtatggcatccagcactaacctgggcagatgacggcgaaacaatgtgtgatatttccatttgatttattttccttctttctctatagaaagtgttattataaaactgttatgttgaaggaacacaaaatttgaaggaaaggaatcaaacataaatgttaaatgtttatgtgtgtttatactgttgatctatgatatctcttgtagttactgttcaacatttctattttatatgcttttgtaaaataaacaacatattttatacaaaaactctcatgtgtgctagttgaaagtaatgccacctaaatgcaataacagaatttgaggagactaaaatgtgttgatttgagagacagtaagagtaatttagaacaagtccccatctggctctgaaatctaatcctttgctggtatccctacacctgaaaacctgcaggctttgcacctctgcagacagatgacattgggttaaattcatgggtctccactgagggtcacaataggctggtgtggcacagtgcattctgggagatacagaactgagggacagtaggctgggcgcggtggctcacacctgtaatcccagcactttggcaggccgaggcgggcagaacacgaggtcaggagatcgagaccatcctggctaacacggtgagaccctgtctctactaaaaatacaaaaaattagcctgacgtggttggggggcacctgtagtcccagctacttgggaggctgaggcaggagaatagcatgaacctgggaggaagaggttgcagtgagccgagattgtgccactgcacttcagcctgggcgacagagcaagactctgtctcaaaaaaacaaaaacagacaaacaaacaaagaactgagggacagtatatccccagtggacaccgatccataatcagccccagtcactgcacagactgggtgtatggtgtcctcagtgcctgctgcttccgtgtaaatgaacagcaggagatcctagggtattagtgaattatatattcatttccaacgtcacactcaagatgaagtctctacagtatttgaaattgaacttggacagcttcaactatttttgtttcaaaaaatattatatatacaaaaataccctatttctgaaggtaattggagtttattttacttccacaataatactaaacataaatggttagcgtattataaagtggtgtgtctaggcatggacagcagaaggcacttggagcctgttcctgaggggtctgggggtgttcggagctgagaccagccacttcccctgtctggtgctctctgttcagggctcacagctgtgatctcctcacccctgaacggctcacagcactactcatacttatccctatggcgccctcaggcagaagagtctgatccagggctcagggtgggatcagaaaagttcccatttgcatgaggagatcctccctgcctcagagtataaagagagaaaaggagagagttgggaaaagctttacttcaactgtggggcaaaaaggcaggactcaggacaatctcaagaatggcctggtcccatttcctgctcaccccctttattcactgcacaggtgactggacatggggccacggaaggggccctggggagcccatggagagctgctttctcctcttatttatagacccagaatcaccatgtctgtgtctttcccactttcagggccttgggtcccatctgcgctgattcagtcaccctcagtccctggggctctgggccagagggtcaccatctcctgcactggaagcagctccactttggttattggtgtgatatacactggttccagcagctccaaggaatgacccccaaactcctcatctataaaaacaattggtgacacctgtgggtccctgacaattctctggcttcaagtctggcaactccattttcgtgaccatcactgtgctacagcctgaagatgaggctgattatcactgccaattctacaaaaacagcctgagtgctttcacagtgctccgggttgaagtaagtcagaccaaaacacacagtgtgcccagccatgaagctctcccatgcaccccctactctgcagctaagtcaatgtgttctctcacttgtttgtcctaaaactggggcctgagaacttcttcagggtaatttttctagggaatgtgtcctcaccctctcaatatctgccccaaattcactctttggcaacaataccatgtgctcttttctcagaggtagcagctggtactgaatgccagaggccagctgccctgtggtggagtacagatgggtgaatcagtcggctggggcttccacaacaacacaccacagactggagtcttcaccaacagatatgtattgtcttactgttctggagtctgaaaggaccagatgaaggtgccaccccgtttggttttctctttgccctctttcctttgcttccagatggctcttttctcactgtgtcctcacatggccacccccaggtctgcatgtggtttttgtacacatttcttatgaagtctttagtccttttggattagagactcattcctatgacttcattgaatcttaataatcttagtgtccagatctcccaatacagacaaattggtaacttagttataacataaaaaatcagggggccaggctcggtggctcacttctgttaatcccagcactttgggaggctgaggtgggtggatcacgaggtcaggagattgagaccatcctggctaacacggtgaaactccatctttactaaaaatacaaaaaattagctgagcatggtggtacatgcctgtagtcccagctactcaggaggctgaggcaggagaatcactggaaccaggaggtagaggctgcagtgagccaagatcacccactgcactccagcctgtgtgacagagcaagactccatctcaaaaaaaaaaaaaaaaattcggggtggatgcaatataatttgtaacaaaggatcaggggtccagggacccagagtccatctgtgtctgacccaggagaggtgatgctgcagaggccacctggtcactccattcctctgagctcctactatgtgcagattctggatgtgttcttggtgctcagggtacagcgtggataagacaggatggtccctgtcctccaggaactgatgctatttaggggaaaacagaacacatcagtaaatgtatcaataagaatatgacatgttttaggaaaatgaagagaggtgtgttttggtgaggtggggtgagcagacttagaggagttgatgacaaagatgcagcgactgattaaggttgtaaaattcacctgctgcaacataaagtgaactaagaggaagtgagggtccaggcagggccatatgaggctctggttttgacacaaacattaggctgtggagtcctggacatgggcggaacacgcaaacggtgaaaggtcatgtctgcatggttcagaagtgggaggtgctgaggaatggagtgtggggagacagggaccacagctgggatctcaggacctgtgaggggtataggtgagctgcagctaagtgagaaaacattaaggaccctgtgtagttgacacaagattattgacatcttaagtcttcaataaatacaatcagcgctgacaaatgtggccgtgcctcagaagagctagaaatgtttatgtctaggtaactctcatgttctgtagaacttcacttgtatttttttggttttaaaggattattataagagcagacgtttatgaatatactccattcttttatcctcaatattgcccatctcttaaaatcctttggctttacacacacctacaacaaactgatcttcaaaaattgataaaaataaacgatgtgtaaaggataccctattcaataaatgatgctgagaaaactggcctacaatgcagaaaagtaaaactggacccctacctcttaccatataaaaaattaattccagatgaatgaagacttaaatgtaagacctccaactattaaaatcttagaagaaaagttggaaaatactcttgtggacattggtgtgggcaaataatgtatgtctaatcatcaaaagaaattgcaacaaaaaacttgacaatcaggaccaaataaaactaaggagctcctgcatggcaaaagaaactctcatcagagtaaacagacagcctacgcaatgggaaaaatatttgcaaactatgcatctaacaaaggactaatatccagaatctataagaaagctaagtcaacaaaaaaatttaactccattaaaaagtggacaaaggacatggtcacttctcaaaagaagacaaaaaagcagccagcaaacatgaaaacatgcagaacttcacttatcagagaggtgcaaatcaaaaccacatgggatatcatctcataccagtgagaatgggtattattaaaaagtctaaaaataacagatgctggcaagaatacagaaaaaaaggaatgcttatacattgttggtggggatgtaaattagtacagcttctgtggaaagcagtttggagatttctcaaaaaaaaaaaaaaaaaaaaaaaactaccactggacccaggaatctaggtgtgtacacagaagaatataaataattctaccaaaaagatatctgaactcattcgtttgttgcagcagtattcacaatagcaataacatggaatcaactcaagtgctcattagtagtggatcgagtaaaaataaaatgtgtgatacgcattcaccatggaatactatgcagccattgtgaacaacaaaaccatgttctttgcaaaatatggatgtagctgaaagctactttgcttccagatggctctcttctcactgtgtcctcacgtggtcactctcaggtctgtgtgttgtttttgtacagattgcttatgaagtcattagtcctcttggattagagactcattcttatgacctcattgtatcttaattatcttagtgtccagatctcccaatacagataaattgttaattcagttataacgtgaaaattcagggtgaacacaatataatttgtaacaaaggatcagggatctctttggcttctcgatggatcacctgccaaggggcaagggtgtaatttttacaatgataggcgcatagctcttaacacaagacagaattaccctgttgaatgcttcattcaaatgatatgttagggaggaggccagttggatgataaagctttgggaatgaacatttaacagcacaggatctaaaatgcagaagaaaagaacctctgatgcaaactttctgagtggagataaactgtctgatatcctgcagattaataaaaccagaaacttcatctgccccctctaatagaaatctacacattaacacaatttcactatatgaagtttccagaagatgatgtggagcttgcaggtgagcttcattttacactttccgcctattcatttctgtgggaggacttactttccctctttcaattttctcatgtgctgttcatgtcacaccctctaattcaaggctccagcccacctttcctgccaacaccaacactctctgtagatgaaaacccaccagtcagcagcctccttggcctgagagaggtcatcttcctgggtttctaagactctggtcctgccgagattctccttcctcaatcctaatcccgtggtctctggcagccccttcacatggacctcatcgctcgtctctgtgttcctccagctatatccacgtcagaaactgctcttcatctgcactagaaataaagaattatcctctcaactcttaaatgtttgctctgattctctcctcttctttgagctcaggcacaccaccccctctcagattcctgagtgtggcagtgtcccctctccagtctccctaccacctccaatggtgaaggcgaagaaaggatgtccctgcatgtatcacatcctcatccttcccttcagggtcagctccctgggtagggaaaacactgttcccttgaggctcacatacccactgtcaaaaagcacccagcacatggtaggcactcaataaacctttaccaaatgcagacctgcctctcaccacactggacacattgtagtgagctcaggatggggctaaactgggagtattagctgtaaacttgctcctctctctgtccccagcctgagagctgagggggcacccacgagggagagcacctaggggcagggaggggtcacaggcagcctcatcctctgtgtgagacactgctcagactgggggatccctcttcattcagatgggaagaaaagggaaacaaaattcggtaggaacttctatgcatccacacagaggaggcaatgacaagaaaacacaggatgcaagcacagtggtaataatgtatttctacctaatattgaataaaactcaatattgcctgtattctgtaaacaataactatttacaaaactgactgtaaattatgattttaaaaaccacagcttatgaagaagagaaacctcaaacaatgacacccctgaattgcaaatctaagacatggcacacatttattttcagttccatatgtggcctggatttatttacaagacaatattatgatattatatgtcactattccattttagatggtgtatttaaaatctcacagtactgcaactacctagtaatctactcatcagtataaacatcaatgtgacaatcctgctatccttctctacccctgcataaccccagcaaaaattcattatgaattcacagaatgtaatatcagaactgttgtagccacatacacagtttgtttcattttatgttttgataaagtaatcttttttgtttaagcttattgttttttaaaaaatatattacatactagatgtcattacaaatcagagattaataatttctcttatgcttatactactcccacagcactcattactgaatgtaaaccatatttatattttctttctttttttttttttgagacagggactcactctatcacccaggctggagtgcagtcgcacaatctcggctcattgtaacctccacctcccaagtttaattgattctcctgcctcagcattctgagtagctggcattacaggcacccgccaccatgcccagctaatttttgtatttttagtagcgatggggtttcaccatgttggccaggctggtctcgaactcctgacctcaagtgatctgcctgcctcagcctcccaaagtgctgagattacaggcttgagccacctgcctggctccatatttatattttctaaacatcctacttggagtggctgatcctaccagctaccatgtttccacctcacctgggatcaaacactgacaattggtaattttatctcttgcagtcttcaaatattgagcaaatttgccatttttgctattcaataaaaatgctggaaagttatttgccatgccactgactctgttcagtgcttggaggacagactcctaggagtgagaagttgaccacagcatctgaatagctattaccccaagtctgtggaaattagagaacaaaattttaccagaaatgccccccagagcttctccccataacctcaccacccttagagaagagagctcctgttctcctcagcgctgcagggtccacagaggaggaagagctctggccagcagggaggagccacagaagaaaggacctggtgtctcccgtgaccagggtagtgagtcatgggaaccagtcactgctctggacttgacctgacctaagaggacttggtatagagtcaccacttcagtcctcaccaaggaacatccaaaaagccctggacagattcacccttaaggagaccagtaaagcatgaactgccctgagttaatgagaaggtcacaaaaagggtctgtctggcctggtgctgagcctgggggcagtgatcagagcagggggaatgcacagctggctctggggacatctggtcatcatgtcacaggagagtgtgtctggatgtggacacctggggacatgaagggctcattaccaagtgatctaggggagatcagagctgcgatcagctaactgcctgcatggtgccctctgctcagtgatcacagtggtgagctcctgatgccccggaacacacagtttcacccttgcctgtatccctgatatccacgagaggggcctgacccaaggccagcgtgtcatcagaaggctggggggctctaatttgcatggatggaccctcattctcagagaatgaagaggggaagggagagatttggggaagctctgtctcagctgtgggcacagaaggaaggcaggactcaggacaatctccagcatggtctggtttcctctcctcctcactctccttgcacactgcacaggtgactagatataaggccatggctaaagccctaggaagcccatgggccctgctttctccttttgtctctcaacccagaatcaccatgactgtttctctcccacttccaggatcctgggctcagtctgtgctgactcagccaccctcagtgtcttgggccacaaggcagaggctcactgtctcctgcactggaagcagctccaacactgggactggctataacgtaaactgttggcagtagctcccaagaactgaccccaaactcctcaggcatggtgataagaattgggcctcctgggtatctgaccaattctctggttccaagtctggcagcttggcctccctgggcaccactgggctctgggctgaggacaagactgattatcactgccagtcccgtgacatctgctgagtgcttgtacagtgctccaggcttgcaggggagtgagacaagaacccccttcctcctttcccaggagggtgagtgcccagcagctactgcacaggcctggcctgtggcttctgcagttgctgtttccccagtgggcctgggagcatccagggccccacctgggagtagatgcttctcctcccctccgtcctcagagtcacccacagcagtccctttctaggaaaagggcctccagaaaacagaatgtcctgtaccctgcaacttgggacacagggtctctgctctaaagtccaggggctggagtgacaaatccagcagtgaaatctcagatctacatctgatggggaacctgcatctccatcatccttttgctatttccaggagttttcaaagcagtgtcttcctctcactggtcctcagtgtgttttcctgttctttttgtttcagcctatttttttttttttttttgagatggagtctcgctctgtcgcccaggctggagcgcagtggcgcgatcttggctcactgcaaactccgcctcccgggttcacgccattctcctgcctcagcctcccgagtagctgggactacaggcgcccgccaccatgcccggctaattttttgtatttttagtagggatggggtttcaccattcacaggattgtctcgatctcctgaccttaagtgatccgcccacctcggcctcccaaagtgctgggattacaggcgtgagccaccatgccgggtctgtttcagcctattttttatgtgtctttttattgaggaataattaacaaaataaacccctgatatttaaagtgcccaattttgtgtgttttaagatatttatacacccttggataatcaccacaatgaatcagtgattccatcagaagaaatcggtgactggttctggcagaatccagggaaccctatctaatatctcgtgaacttctacttggactcaagtaagaaacagggctctgaggctcccagccacatcttgggatctaaagatgcgtcggcctgtgcaaggattttgcacgttgctgtgctgcagcctgagaatgggtctgtctcggggtctgcacaggggcagtggatttcacagtggctctgaggcttacacagggctccaggcccatgggaaagtgagacacaaatcttccctctgctctctaggcctggtgcagtgatcctggctggaggctctgataaatctagctcagaatgtaacttctgttgtgaacatctgattttccttggacaaatagttctgacaatatcttatttcagttcgactagtatatcgatccattgctcatacttctcattccattcttgctttcgcaatcggtggaccctgtcctgtgcccacagttctctgcatctctccctgctagtccagcctcctgcaaaggttcagctcccagaagagactcctacatccactgccctggaagaagcaacactatgagtagaatggcaagattttgtcacatcagcactggggataactcatcactactctgggcccattgaagcaatcacatactctctgaacctcagttttcatttttggcagcatgtaaccctacctcagcagctcttgctttcaacatggggatgagctgaagaagaggcttgtaaatgacaagtatcagtcactgttcaccgtgcaggggtgtctgtgtccttctgtgtcaggctttgtgccagcagggctgtgccccgcaaactcttccaaggtcctccatgcagtctgtgttccctcatctggccacattgtctggaagttaaggtcacctcctcatgcactggaacaagcagcagagtcgagtggacagcgtggcctggcaccgccagctcctacgggagccccagatggtaatgcctgctggtctccagcttgcagggttctgattttgggctcttgctctaggtctggccacttgggcttctgcaatactctgggatcctgtatgaggatgagggtgatgatcagtgttcaggatgtggaaagagccccaggttaacccaggacacctgtctcatggggacatgaggcacaagcctcccatctgatcccacagcctggcctatagactcactttaattttgtgtgactgtcacctgactcaggacattcctgcagtcattttttcctccaggactgatggaatgaggccattccctgggtctgtcgcctcatatgcagtcgacctatatactgggctttcaggataaaacattcccagcctgggcattgcaatacagacaggcaggtagctcagacagaaaatactcttgttgattccagatttctgggcacatggacttggtgtgtgtttgtgtccatgactaaggtcaggtttggggttgggagtgagagtggtcaccacatggtccaggaagaatgtgttgtcaaagataaaattcgtacaccttcctgcccttccctgtacctgaggcagcttcctgaagcctgcaggtttctgagattctccataaatggagaggaaacatcccatagaatggatgggttttttttgtcccagacaaaaagacaagacaggacgagggtacagatgtcagcaagggttaaacagcaagtatgcacttgatcatgccaaagaatactgaaatagctttgagggtaattcagtgtccttgagaattaaaaacaaattggagattgagggcttcaaacccccattaggtccttgtgcaaacagatgctgaattccaacccacattaagaaagaggctaaaaagatgagacaaaatctctgaaagacaggtggaggggatttctgcagtttcttggtgcttaagagacagggacctgccaggcactcacctgagaaatcctgcagggtcacagcacagggaagggaatgtgtcgggtacataagatgactttgatgttgaaaacaccacctctaccactgataatggttttcatcattcatacttaggtgcatgtacaacctctagcaaccataattaccacaaaggacaggcattgtgtaaacttttatgaggttctgtgttataaaataattacacaaaatgtataaataatgtgggcactaataaggtgaggttatatgttgcaatatctggggttcctattgaatttatagactgtaaaactaaataggtgctaatgtaaaatgatacagttagaaatacttgattcatgaaaaataaaaagtgagcgaaaagaaataaagcaaaaagcccaaataaaataaagagaaaggtaaactcacacacaatatcagcaattatattcaatgtaaatgtgttgatgaaccagataaaaataatttccttaaaataaagttacttgtgtgttatattttaaaggatgctaaaaatacactatgcaaacatttacctgcagaaagctcttgtggttatctcggtatcagaccagataatttcaatgaaaattatttacatcaggaaatgtgggacattttatgtatataaaatgaaatatttgacaagaacacataacaattataaaatacacatcagtccatgcatggtggctcacgcctgtaatcccagccctttgggaggccaaggtgggtggattgcttgagctcaggagttctagaccagcctgggcagcatggcaaaatttcatctctaaaaagtacagaaaaaaaaattagccaggcacggtggcatatgtgtctgtagtcccagatacttgggagcctgaggtaggaggatcccttgagcctgagaggtggaggttgcagtgagccaagatagcgccactgcactcctgccagggtgacagagtgagatcccatctcaaacaacaacaaacaaacaaacgaacaaaacaaaccaaaaaagcacacacaaataaacaaaccaaaaaacatgtccctaataatataatctatataaaatataaattagcaggactaaggaagagaaaagaatcaattcccaattatagttataaataatagcacacacttctattaactgagtgaatcagcagaaaaaaaattgcacataacaatatgtgaacaacctgaaaaaccaaattcacccactgacgccaggagcccaaacctgaggagtagttggctaatgaatatgtattactgaaacgattgaataagtgctagaagaaataaatgaggcattcattatttttacccgatttgatgcttctcctctctgtcctgtgagcagggggcactcccatgtctattcctagtcccattcttatcccctcgtctctctccccaagactgagctgcattctgcagggtggctcccgtccccctggagtaaatgactgacgtgaggagccctgccttccagtgctgctgttttcatcgtgctctggtttgaatgtctcccttccaaaaggatttatacttaattgccagtgtgatagtactaagaggtaggccttcaaaaggtgatatagtcttgaacacggagacctcacggttgggatcaggtctcttatataaaggctggaggtagcggtgtgctctgtctctcttcttgccatgtgaggacacagaaaaaaggcacttatcagatgacagtgccttgatcctgaacttcccagcctcaaaaactgtgagaaggccaggtgcggtggctcatgcctgtaatccaagcactttgggaggccaaagcaggtgaatcccttgagtccaggagttcgagaccagcctgagcaacatggtaaaaccccatttctataaaaaatacaaaaattagccagatgcagtgacaggcacttgtagtcctacctaatcaggaggctgaggtgggaggatcacctgagcctgggaggtcgaggctgcagtgagttgtgattgtgccactgtactccagcctggatgacagagcgggagactgtctcaaaaaattaaaaaataaataaataaaaaataaaacagtgggcgagataaagaaaatgtgttacttatataccacggaacactatgcagccataaaagaaagttatgttcttggcagcaacgtggatggagctggaggccattatcataagtgaactaagccccgaacagaaaaccaaatgctgcatgatctcacttataagtgggagctaaactatgaatatacccgaacatacggaaaggaacaacagacactgggaatgactaccagaccaaaaaaaaaaaaaaaaaaaaagaggatccaccctgtggatcctctgcccactgcctgggtcatgaggttgttgggaccccaagcctccgtgtcatgcaatcaacagatgtaactaacctgcatgtgtaccctttaaactagaatagtaagagtaaagagcattgaaagaaaaagtcaagatcagaagcgaagaaaataataaatgaaaaaacacaatctatagttatccaaacaatccatgactgtcacaaacacagaacaaggacccagtggacagaatgaggcagccaaatactcaacccaacatgatacatagggaacacatttttcaaaacaccaaaaagacacaatgggaaagggagagtctggttcaagaagtgattttgagaaaactgaatatgcacatgcaaaacactgaaataagacctttgcattgcacgatacacaaaatcaacacaaaataaattaaagacctaaactcaatcttgaaactgcaaaggtcttataagaaaacataggttgggtgtatattttaggaagcctgtatctatgcacacaggctgcaaaaggtgaaaaataatcataacactaaagggaaaattaggggaactacatgcacagacaatgcaatggcttggctatatatgtgtgtgtgtatgtgtgtgtgttttgtagggtggaggtttggatacaaaaattacagctaacatgcaaatataaacaaagacactagtgacactttagaacttctacagggggaaagaaacaatgaaataaacaaacaaacaaaatgcatcctaaagactaggagagaattatggaaagtcctacctctgaaagagattgttatctaacacctacaataaactcactctactaaatgaaaaacaacaaaaacaacaacaacaaatacccaagctaagaggatctgaatagacatgtgtgtaaagaagacaggaaattgactcacaggttaacagtttctcaatatcactaatcctcacaaaaaagtgaatcaaaaccatactcaggtaccatataattccagttaaaatgaatattgcaaaagataaaaataaaaattgttggaggtgatggctggtgtagaattgcaggaaggaaaactgttgtacgctctttgtgggaatgtaaattagtatacacactatgcaaaactgttggaggttccttaaaaaagtaaaaggtcaaagtacaaccaccactccaggttaacaatcccaccactgggtacacatttagaggaaacaaaatccctgcattgaagaggtatctgccttcccatgtgtcctgaagcactagtcacaatagtcaagatatggaatcaacctaactgtccatccacagatgaagagataaaggaactggatatatacatgatggaaagcatttcagccataacagtttgggaaatcattgatctgcagccatgtggagaaacctggaagacaattaggggaaatgaaatgagcctgttagagagagacccatactgcatgacattaggcaaatggaatccaaaaaacactgtcttctagaagcagaactttcaataggggttactagaagctggagagaggagggggcctgggcagggattggtaatgggtacagagtaacactcagaggagaggaatccattctgatgttctattccacagcagggtgaccagggtcaacaatgtctaggggaatttttcaaaaacagctggaaaggatggttctgaatgttctctccacagggaaataataagaagccagacaccatgatttgatcatgacactacgtatacatatatcaaaatgtcccttgcaccctctggttatatacatacactctatagtaatgaaactgccatcaaatgttggtagtattcattctaactggagtgacatagaatctgagtgtggttttcaatcatgttttggtgtgaatcggccatgttgataatcttatcttttacctgtgcatcaacctcatgtcttcaggtcctctgcccacttttacacatcaaattcaaaacaaattaacaataacatggcaaatataactaatcacacacacacagaaaatgaaaaccaccactcagattccatctcactctagatggaatggatactacaaaaaaaaagttgaaaaatattaaaagacaaaaaaacgatggtgtggatttccagagggggaacttgtctccgcagttcgtaggaacataaactagtacacacactaaagaaaccacttggaggtccctccaaaccttaaaaccacaactaccatttcatccagcaatctactactagtcgtatatacagagtacatgaaatcaagccatggaagagattatctgcgttcccaggtggaatccagcactatgcagaatggccaagatgagaaatcagccgacctgtccatctgcagatgaagggataaggaaactgtcccatgcgtagacactggaatactcttcagccagaaaaatacaatgaattcccatcacgggagccacacggttgcacctggaggacatgatggtaaatgaaatgagccaggcagagacagacaaactttgcatcctctcactcatgcagaagctgagaaactttatctcaaagacctagaaagcataatcatggttaccagaggttggggggaagaaggggaaggggcaaggattggaaaggggtagaaagttccacacagatgagaggaaggaaattctgtttttctattccacagcagggtgactagggttaatagcatcattacatcttcaaaacagcttgaaaggaggatactgaagcttctcgccacaaaagaataaacagtggtacgaaataacagaaaaaataaataccctgatttcgtcattccacaatgtatgcaaagaccaaaatgtcgcactctaccctctcattgcattcctttactattcagcaaatttgtttaaagaaatataaatacatgatgctagaattcacatgggaccatgaatcaccctgaatttcttccaaagcaatcctgagacattcagactacatcagatgcatctcacccaccgatttcaaatttcatggaaaaactgggtacctgcttccacacagagcagtggaacacaagagagggcccagaagtaaactcacacaccaaaaaccatctgatccttgacagaatccacaacaataagcaagggggaaaggatgccctattcaaacaatggtgctgggataagtggttagccatatgcggaagagtaacactgggccccgacctctaaccagacacaaaaagaaactccagatgaatgaaagatttaaatggaagacctcaaactattaaaatcctgcaagaaaacatacaaaatacctttctccacacaggttttggcaaagaatctatttggctatgtccccaaaggaaatgacaacaaaaatggacaagccatgcttaatactctaaagagccaccacacagcaaaataaattagcaacagagtaagagacagcatacagagtgggagaacatgttcccaaactgcatctgatcaaggtctaatatccagaatcttcaaggatcttatgccaatcattcaacaaaaaacaacaaaaaaatcccattagtgtatgggcaagggatgtgaacacacacttctcataggacaatgtgcaagtgaccaacaaagagggaaacatgctcaaactcactcatcaacagagaaatgccaatcaagagcaggtcgagataccatcccacaccactcagagcggcgatgactatgcagacaaagaaagaaagaaagatactggcgaggcagctgaggagaggaaaggctgatatggtcttggtgggggaagcaagctagtacagacactgtggaaagaagtttggagatttctcaaagaacttagaactaccatccaaccccacaatccctctcctgaagatctacccaaggaaaatatatccttctatccaaaagacacaggcacttgtatgctcacggccgtgttattcacaatggtaaagaaacggaatcaacctaggcatccatcaacagtggataagataaagaaaatatggtatgtatacaccacaaaacactacacagcccccaaaaatcacatttttggcagcaacatggatggagctgcaggtcattatcctaagtgaactcaaggccagaacagaaatccaaatgccacacattctcacttataagtgggaactaaactatgaatgcacctgaacgtaaagaagggaatgattacattaggaataactaccagaccaaaaagaaaatgcaaatgggagggagggggcgttgcgtcctgaagacccaccttgtgcgtcctctgctcactgcccgggtcatggagttgttgggagcccaagcctcagtattatgcaaccaacagatataattaacctgtgtgtgtactctttcatctataataaaagtagaaactattacacacacacacacacacacacacacacacacgaagaagcttaagagctacataaacaaaaaaataagtaaaatctatagttatccaaacaatccctcactggcaaacacacagaaacactaacctatggacaaaatgagaaagccaaaaatgcagcccaaaattacatatggtgaatgcatttttcaagagaacaccaaatatcacaacagtgaagagagaagtctgctaattgtctttgagtaaaatgaatttctacctgcaaaacactgaaatggatcctcatgttacataagacaaaaaaatcaatgcaaaatacagtaaagatctccacccaaaactgaaaacacagggtgttttcacaccctagaagaaaacacagggtgagcgtttacttcagtgaaactttaatctatgtacacagattgccaaaaggaaagaaaacaaaagggaaaagtaggaggaagaaacccacagacaatgcgatcttttttcctttttttttgtgacgggacaccaaagtcaccacatgcacatgcaaatagaaacacgcaggactatggaaagctttagagatgttccacaggaatgaaaccaatgaaccgaaagagaaggtgtcctacagatttggagacagatctgaaaaactgtatctctgaaagcggttgttatctaacatgtccaagaaactaacaccactgtgtttggaagcaacaacaacaacaaaaaagacaaaacaaaacaaaaacacaacaacacatatgctgaagcaaaactgggcaaaggcccttaatagacatttctgaaaagatgacatgaattgactaatgagtcaaaaagaagttgctcaactttatcatttctcccgcaaaggtaagtccaaaccacagattctctgggattctggagaatgtgaattctgactcagtaggtctggagtgagcctgagattctgcgtttctaaaaggttcatttccccacaaatccacattatgtgtattaatattaccaagtaaataagaaaggtcaaaaataaaatggcaagccattagtagataaccttagtcttcctcctcatcctcctcctccactgcatgggttaggatggtccccagcatcctgatcccccaggtcactgacatcagctcccaaactcatgccaggaatgtccttccctcttcttccttcaggccataatgggtatctatttttccagcatctttctcccaatctgtgctgatttagccaccctctgtatctgcctccctgggacaaagggtcaaactcaccagcactctgagcaagagctacagcagctgccacatagactatccccagcagagctcagtgatggacaccaggttcacaatgccagtgggcagtggtgctgtttactgcatccagtggggatggagtggttgtccaggcacagacagatggacaatcacacagcaggaacaaatgtacattctgaaatttaacaaagacagaataagggactcttggggaatagaggtctcaattgcagacatagtgagtgcctcaaaaattagagaactggggccatctctgtcatggcccggattcctctctccttcatcctcctcagtcatcaaagagattccattagggggcaatcaaaggatgctggggcctgctactagctcccaaaaaacaccacaagcatttcagcagggagaaaagaaaatgctcacaaggatggggttagatttagttataaaccagattgtgtggcaggagggaggacatatcccccatcctttggccactccaaaattgggagagctaatctggggaaaggcaccaacacctattcattagtgtctcggtcctgtgtgatcatgggtctgtgtgagttctcagcagctgcctctctcaaggtctccccacaggacagcagggtgaaacctggggcaggaagagaggggaagctgatttgcataaagaactttttttatcctattgggtctggggaggcatgaaaaggccctgaggaaaacaaaccccagctgggaagcctgagaacacttagccttcatgagtgtccccaccatggcctggatgatgcttctcctcggactccttgcttatggatcaggtcaggggaagggactctatccctgggggaccacagaaaacagggtccaggttactctcatcctcatgatcataactgtgtctctcctgttcgttttaggagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttccacagtgatttaaacctatgaggaagtgcaactaaaacctctttatatactgagaacagttcagcccttacagacaggagggaaagtgagagggtggaaatggtcaacacggtgagtgaggagtctcctcgccccagtctctgacgcaggggttcactgccaggtgcctcacccagtctctccccgggtgtgtccaccttcccagtgtggcttttccatggctgtgcttcgtctccactgagaataatgtggagggagaattatctacaaaatatataagctcacagtgagtcacagacaccccagtgctccaggaagacgcttcttattcaaagagaattaacaggcatatgctcactcattaatttgaccatggaggctgactgaatattttatttatcactgaagtgggagcattttcaaggggcttgttaaaaatgtaattctctaacctaaacctactaagtcagaaacttgtgttggtgacagatagcctgtatttaacaagctgtacatgagatttttattagcgttaatgtttgggaagaacctacttttattatcataaaattattcataaggatctccatttataatgatgtcaggttaatattccataatcctactctcctaaattcccattcaaagcccccaaatactcagaaacagattttaaatctcaagccatagcaaaaattataacttgatttatgcagacagagtagggaggaatttctaaaaccgtaagttcctaggtgccaggtgtgctgactcatgcttataatcacaatactttgggaggttgagacaagaggactgcttcaagccaggagattgagaccagtgtcttccacatagcgagagtctatcaccacgaaagaaaaaaaaaagatataagtcccttcaggaatttccaaaaacttgtttccttagggtatatttagtggtccatatgaacatctgttactgaaaaccatcccgtagaggactggcttccagaatcccttctccctcccactgagctcacctacctgtggctctggctctcagggtctttataggacacagggctcagcctcttatcaccgattgttccacaggatcatggttccactgagatcctctcagcatagatacgtacctgtcctgaacagtgtcttttaacataatgttggcaagatgggaaggactaaggggtgacggagccttggagccaccagaagatggcagtaacctcactgctgagctttgctaggccagactcaggctcccaccctcctcccttcctctgactctttcttctggccacccggggtccaggagctttttccactcaatctgggctcaggggtcacctcagagaacctctcaagacaaaggaggtgcttcaggggatctaacacaagtgagggcagattttaagactgtccatgcacagaaaatcctgtgaaaagaaacaaaccagccctacttgtgtctgcgcacctgagtccttaggactgttttctcctgatctcctggctgagtaaagattgcaaatgtgcggttcattatccagatccagagaaatccatgagagtttatgaagacaaagacgacaactaccctatctacttgtcacacaatgaagacactggccttagatctgtcagtgccctggaacattctggaagaagagggtgaaggttacttggcatacgttgggactcaaacatgaggatctcatgatgacccagagggataaaggtgggatcagttgtgagggtggaaaatgtggatttcttaaggccattttgttaatccttttctcattgcaaaggatttaaactgaaatgaacacgatttttctaataaatgcttatgaggctttccattaaatttaatcatatttcctgcctttatgaaaataaatatagaaataaaatatacttccataatgcattactgattgtgtatctttaaactagagggaaccattacttctaaagaaaaattactaggattgtttgcattttaatctgggatcctacatgatggctacagatacagctgttgttcaaggttttagcctggaatctctgccaattcaataacggaggcaataaaaatagacactagtattataaagacagaattcatttattttgaaagttttgaaagctatgaatatctaccaagaataaaataaattgtactgaaaatatattagaatgaattaaaaaatgccaaattcacaactaataaaatttattataaagttaaaaattcttatatttttctgtctcagtataaaaaataaacatttaatgtatctattagaaaataattagcaattttgtaaatgatatcaaagaaaatttgaacaaatggtgaaatattttcttatctgcggacaccaaattaaaaaaattcaggccaggtgcagtggctcacacctgtaatcccaactactttgggaggccaaggcaggaggatctcttgatccaaggagtttaagaccagcctgggcagggacgggtgcagtggctcatgcctgtaatcccagcattttgggaggctgagacggcagatcatgaggtcaagagatcaagaccatcctggccaacatggtgaaaccctgtctctactaaaaatacaaaaattagctgtacatggtgacgcatgcactcctgtagtcccagctacttgggaggctgaggcaggagaatcacttgaaccggggaggcggaggttgcagtgagccagatcgcaccactgcactccagcctggtgacagagcgagaccccatctcaaaaaaaaattagccaggcatggcttcatgtgcctatagtcctagctactagggaggctgaggtcggaggattgcttgagcctgggaggtcgaggctgctgtgaaccgagattgtgctactggactccagcctgggtgacaaagtgagaccctgtctcaaacaaacaaacaaacaaaaaaccaaaaaaaccccaaaataaaacaaaaattcaacagcatgtagattagtaatgttagtgctttatttttaaaaattattgttaacttatatgggttttcctctgagaaggtgcactggaaggtgtcagcagagcagatagcacaaactcctcagatttcagaagcaggggtttatggtaaatgaaaaatgccagtcacttgtcagcatgcacaggtggctatgcccgccctgtgtcaggctctgtgtcagtagtagggtgctccatgcgtccttttcagagtcctacatgccatctatgctcactcagccaggcctgtcacctggaagtaacaggcaactcctcctgcactggaattagcagcagagtcaggtgaataatgtggcctggccacaccacctctcagcaaatgtccccagtggtgatgcccgatagttcccaatcctccttaagtaattaattcacttcaattgaattaaaaaaatcaatcacttccctatgacacacaaggacattcactctctggctttaactatccttgcctgccttgttattatcattccatgtgcccaatactgtcaaaagatgtatttttgccataccctccacatgcatttcatatgtgtgatttttattttcaaattctatatctcttctaggaatatggtgtgttttatttgtcctgctgcaggactcccctctccactcagattaaattattaaattccagataaaaaattaacttggaatactgttgaatcaatagtagaagtaaccaaaataataaagatatttcaaaatgaagattgatttttaaaagtaaaaatgtcacatactccacctagaagataagagactgtactacaaattcattagaacatccccttcatgtcatgggccagtcatgtccctgaacttaacctctgtcttctcgggtgatgttacaggccaatgcagcatcagctgcccacactcctagtggtggaatctgggagcacaggcaggagtctgcgcctgtggccttggctgggtgaaagatgacatttccaagacttcttgcttggcagccatcctcacgtgcaggtggtctggcagcagcactgcaaaacccaggcaagggatgccccactgcaaggcccagtggtaactgtggtggccattggcattgggggcagatgcagccatgtgagttggtgggctgtggcagccaccctaatgatggtttccacccctcccagctggtggtggctaaaaccacccggtaggagtttcaaaagcagtggcaccattaagcggagctcctggaggaggactggaagcaactgcttgcattgaaggaatgtagctatagtggaattattgaaccacatcatatttgcaaagatgcagaatgtattacagattacgagatatggaagttgaggttaatctggtagagagcagtgaatatgaggaggaagctctctattgggcgggtgctatcatagctgcagaaggtgatggtgcaatgcttctgccagtgagtaaagtcttgtacaaacttaaaccagttacggggtaaaatctgatccaggactacctgagggtcacttatgttggcctgttcaatacacacatttctttccaggagccttaccaaaggtctatagtagtgagttcagtatggaggcagtaatcagatcatatctggaaggaactggcataaactccaatcctgtgggacatcatggacagcaactaaattcgaatcaacagagtagagcccttgacattggacaagttcgtggtgaaagatctgaggctttaggactccgacatttgtgaatgacagcactaaatgaagtctttactggtgaacgtctatccagaataccttatgcttgggctgtggcagtggataatttaagtagacccactctatttatttatttattttgagacggagtcttgctctgttgcccaggctggagtgcagtggcgtgatctaggttcactgcaagctccgcctcccaggttcacgccattctcctgcctcagcctcccaagtaggtgggactataggcacccatcaccacacctggctaattttttgtatttttagtagagacagggtttcaccgtgttagccaggatggtctcgatctcctgacctggtgatccatccgccttggtctcccaaagtgctgggattacaggtgtgagcctctgcgcctggctaagtagacccactctaaaagactggtttcttactgtgagatttcagttggtaatggtccatgggaaaaatggaagacttcagggctcaatttgtgaactggagcaagatcaaaggcaacagggttgcaagtcaggctgtggagcatgattaaaatattgcaaatgacaaggacgttggagtcttgcattcaactgtaaaatgacagaataacaaataaatataatgaatcattgttctagagtccaaaaagggccaaaagtaattttcagtattcaagaactaaaaagcaagcagttttctcgagcacccatgagcattgtttctcctgagagatttgtcctcgttttcattgctggaacacctgcatggttgtagatggaggaatgtcttttgatgttcctatttttatatcagacaagctttaaagcaacaacagttataaaagacaaagaaggaaattttataatgataaaaggatcggtccaacagaacaatatcacaatcctaaatatatatgcacctaatactggagctcccaaatttataaaacaattattactagacctaagaaatgggatagatggcaccacaataatagtaggggacttcaatactccatggacagcactagacaggacatcaaggcagaaagtcaataaagaaaaaattgactttaattatatcctagaacaaatagatttagcagatatttacctaacattctacccaacaacttcagaatataccatattttaatcagcacatagaacgttctccaagataaatcataagataggccacaaaacaagtctcaacaaatttaagaaaattgaaattatgtcaagtaccttttcagaccacaatggaataaaactggaaattaactccaaaaagaacccttaaaactatacaaatacatgaaaattaaataatctgctcctgaatgacctttgggttaacaatgaaatcaagaaggaaatttaaaaattgcttgaactgaacaataatagtgacacaacctattaaaacctctgagatacagcaaaactaagaggacagttcatagcattaaatagtctgaaacagcatgaacagacaatctaaggtgacacctcaaggaactcaagaaacaagaaccaaccaaactcaaacccagaagaaaagaaataacaaagatcagagcagaactaaataaaattgaaacaaaaaatacaaaagataaatgaaacaaaaactggttatttgaagagataaacaaaattgacagaccgttagtgagattaaccaagaaaaaaagggagacgatccaaataagctcaattagaaatgaaatgggaaatattacaaccaataccacagaaatatgaaagatattcaaggctactatgaacacccttatgcacacagactagaaaatctagaagagatggataaattcctggaaaataagttattatttgaaaaagacacttgtatggccgggcacggtggctcatgcctgtaatcccagcactttgggaggataagcgggcggatcatctgaggttaggagttcaagaccagcctggccaacatgttgaaactccatctctactaaaaatacaaaattagctggacatggtggtgcatgcctgtaatccccgctactctggaggctgaggcaggagaatcgcttgaacccaggaggtggaggttgcagtgagccaagattgcaccattgcactccagcctgggcaacaagagcgaaattctgtctcaaaaaaaaaaaaaaaaaaaaaaagaagaaaagaaaaagacacttgcacacatgtttatagcagtacaatttgcaattgcaaaaatatgcaaacagtataaatatacatcaaccaatgagtgaataaagaaaacgttatttttttatttttagacggaatttcgcttttgttgcccaggctggagtgcaatggtatgatctaggtttaccgcaacctctgcctcctgggttcaagtgattctcttgcctcagcctcccgagtagctgggattacaggcatgtaccaccacgtccagctaattttgtatttttagtagagacagggtttctccatgttggtcaggctggtctcgaactcctgacctcagatgatctgcctaccttggcctcccaaagtgctgggattatgggcatcagccactgcacccagccaaaaatgtgattttatatatatatatataatatacaccatgaaatactactcagacctaaaaaggaataaaataatggaatttgcagcaacctggatggagttggcctcgtttactactctgggtttctgtctgaggatgagggtgatgattgctgatcaggatgcggaaggaacccagtgctaacccacagcatctgccccacagggaaataaggcacaagtctcttgtttgatcccacgctatgacctctagacctactcttccctcttgtcaccaaaaccacaatcaggaaaaatttctgcaggcatttcaccatcctggaacaaggatctgagactcttcactgaatttgtgaccttctatccagccaatatttatactgagctattaagattaacatcttagcctggtcattgccacacaggcaggcaaggcagctcaggtggaaaatacttttggtcatcccatgtgtctgggcatatggccttgatgtgagtttatgttcatgctcaggacaagttatgggtcaggggactagtcagcttatgggccaggaaaaggtgctaaggtttgtggagtcaaagagggaattcacacatattaatgctccttgtttccacctaaggcagtttgtgaagtctgtgggttctgtgactgtccacaaatggagcaggaacattccttagaacggatgattgggaccccacaaaggaaaagacaagaggaagcacaggctacacaatgaaaatacacttggtcatgccaaaggctaggtcatgccaaaggctaatgaaagagctttgagtataattcagtgcctttggggttgagtggaaaatacaaaaaccatctttgccctgctctcacaccacaacaatcaacacgtttccatgaccaaatgtgtaggatttctccccaccccctagaaagcaagccattggttttgcagcggacaccacacaggtgccctctcattgaatgcaattctgacactatccacatggagacagggtcagatcttacagtttgagggctacttccccaagactgtgccccactacttacgccaatcccaagcctcagattgctttacctgtgcttctgtccaaatagctgtaagttgaagatttcacaacatctccttggcttctattaatttgctagaatggctcacagagctcagtagacacttacaggtttattaaaaaggatacaaccaagcatatagatgaagacatgcatagcacaaggtatgggaagtggtgcaccaccgtccagtaatcttcatgtgttcagccttccagaagttctcccagcctagctccatttgggttattttatggacgcttcctcaccgaggctttatggagtaaaccactgcccattggtgaataatcggcagcccctctcccctccacagaggttgggagatgaggctgaaagtcccatccctctaacactgccttggtctttcttgtgacctgcccccatcctgaagttacctagggactgtcagccaacagtcatctcattagcatacaaaaagactctggtgattttaagtattttaggagttgtataacaagaaatggggtcaaagaccaaaaccataatttataataacacagggatgaaaaagaaagtagaggttgatgatttcaagcccacactagtcctcattatgacagatgtggatttccaacccataagaggcaggaggctgaagagctgagacgaaacctgtgaaaagcagggacaggggacatttctcaatttcttgttactgaagtgatagagctccaccaggcctcacttggattgacaaactaaattaaaagatacactctttaaataaaaagcacttctgagcatacatccaaaagaatgaaaatcaggatattgcagaaatatttgcacatttttattcatgcagcattaatcacaatttcaaagacatggagacagcataaggtccactaatcattgaatgtttacagaaaatgtggtgtatagctgcaatggatgctgttcaaattcaagaagaattaggccgggcacggtggctcccgcctgtaatcccggcactttgggaggccaaggcgggcggatcacaaggtcaggagttcaagaccagcctgaccaatatggtgaaaccccgcccctactaaaaataccaaaattaactgggtgtggtggcagaagcctgtaattctagatactcaggaggctgaggcaggagaatctcttgaatccgggaggcagaggttgcagtgagctgagattgcgccactgcactccagcctgggtgacagagtgagactctgtctctcaaaaaaaaaagaataattaaattttgccatatgcagcaacagggaaaaccctggaggatattacactgagtgaaataagccaatcttagaaggggaaatgctgcacggcctcatttatatgaggtatctaatttttttttttcgagacagagttttgctcttgtcacccaggttggagtgcaatggcgcgatctcagctcattgcaacctccgcctcccgggttcaagcgattctcctgcctcagcctcctgagtagctggtattacaagtgcctgccaccacacctggctaatttttgtatttttagtagagacacagtttcaccatgttggccaagctggtctcgaactcctgacctcaggtgatccgcctgcctcgacctcccaaagtgctgggattacaggcatgagccaccacgtccggcctataggaggtgtctaatatactcaaccgagcagaaatggagtagaatgctggttgccaggggtagggagagaaggaaatggggagtcactgctcaagggctatgaagctttaggtttgcaaaatgaacaagttctagagatgtgctgtacaacactgtgcttacagctgacaacactgtattatgtacttaaaattttattcagagggtatatcacacattaaacgttcttattaacatgaaaaagggatagaaaataccatgaaaccacttacagaaagcaagtatggcaatcctctgtcctttgtcttgggagaaagttttggccaagagacaatttaggcaaaaaagagaatttactgaagaaaaacagagagcaaatagtttatttagagagacagtgtactctggaagataaggcagagcgggctgctgatagagaatgagccagcggcccgagaaatgtgcactgagtttttatgatattgcactttttcttggagttcccacctctgttttaagtctccacctttttttctttctctagtttttctgcttcagccttaagtccctgccttttccccacatagtttccagcccaggctgtgggaccctcccttaacacacacatgggcccagtgtttgataggaattctacctaatggctgcattgctcattactgccaccccaggaaggttgtatggtggtcaaatctatacttactgtacctgcatctctcttagaaatttctcctttgctctcacccctattatcagcatgcagctagctacattctgacaggttaacttcagagtgagtgaatactgggtgtcttaaggggctttgttctggcataggtatttaccctaatctctgttcgtatctagcatgtgtgctttgggtggtctctggggtgtgagattttccagaactcccttttctcaggggctgcccctcctgcttctgtctagctatctgcctactctaaagttagtattagtatgaaagcttttatgaaaaacatttttttccaagaaaagggaggcattttatactggtgaaataaggtgttcaatgacaacacataacaactgtaaattgtatgcacctaataaaatagctttaaagtatttgaagcaaaactgtctcttttagcagaattaaaaagagaaataatcaatccataatcatatacacagatattaatacaactctcttattaactgagtgaatgacatggagaaaaaagagtatacatacaaatacgtgaaaaccatgattaacaaaatcaatccagtgacaccaggaacccaagcctgaagggtagttgcttgagtatgcattcatggatgaacgcatccaatgaatcatcacaggaacaaacaattgaggccttcgtttatgtatttctaactgatgttaagtttttccttcctattctgtgagtagaggtggatccctgtggaaggagctgcccgggtctttgctccagaagctgtctgcattctcccctcactgtagcctcgtcacattaggccattgttatatttcccatatgtccttcttctagtaatccaggagccctcaatgaaaaggctgtttattaataccagtagctcaggacagagcaggggcatggctcatggatggtttggaccaggcccttagatgactgcactcacatgattcccactgagactgcagtctggccagtgagcagcaggggcactgtgggtctgtctcacggtctgcacagtggctattcatagctgtgccaacccctaaattccccagggctgggcagtggagcctgcactcactgaagccgactcagctgctgcatcttctctgggtgtggttccagcacccacttcctcccaggtcctgccagactctctcatccaccagtccccaggtcttgaataaatgcatagagtggggtgggggcaggcagtgggtgggacacatttgcatccataacccttcctctgtgaggccagtggaggggataagagaggcctagggcagccactccagctctggacctcgggagggctgtgtccaccatggccggggcccctgctcctccctgctgctcccctctcacttatcaggtagggacaggcctcagattcctgggaaagcctcccagtctgagttcttgccccgtgttccactctcacatttcatccctgcttactcacccatgagcatttgtgtttgcaggttccccccacctcggcctgttctgactcagccaccctccctctctgcatctctgggaaattctgaggctcacatttaccctgagctgtggcttcactgctggtggctagcacatatcctgctaccagtagcatctagggagtgctctctagtatctcctgagagatgatatatctccagtgggatagatatctcaagagtgggctcctgataaaaggataaagttcaaccctatttactcattttcacactcttctttgccctttttctctgagataatgcagcagaaagacccttgccagatttcagcatctgcttgtggacttctaaggtcacagaaatctcaaccaaataaacttttagtctcagtaagttacccaatatatggtattctattgtatcagaagaaaatggagaaaatggactaggacagcacgtgtagaacagtctgctaatctgactcaagtaagcaccatggctccagggtccccggtcacttttctaaatctaaagatgcctcagccaatgcagtaattctgcacatctctgggctgcagccagaggatgaggctactacatatctcagcagccatggcacttccacagtgctccagacccccagggaagtgagactaggacctcccctgtgttctctctgcctggtgcaatcaccactgtcctgcctgggaccaactctggctcagggattgattcctgttgttactttttcagccagtgtctaattttcctaggatatatagatgtaaaatgtgtttttttcttaaaatgttaatttgatatatttttcatatcttttccccttatgatgcctacagtggagtaggtcagttcttagagctaagtttccctccaggaagattacagaagaggaaggagatgaataacctacacgtgctgtcctagtccatttcccccattttcttctgatataatagaatatcatatgttgggtaacttactgagactaaaagtttatttggttgagatttccgtggccttagaagtccacaagcagatgctgaaatttggcaagggtctttctgctgcattatctcagggaaaaagggcaaagaagagtgtgaaaatgagtaaatagggttgaactttatccttttatcaggagcccactcttgagatatctatcccattgccaggataagggcactaatccattcatgatggtggaaccctcatgacctaatcacctcttaaaggtcctgcctccaattacttttaccatgataattaaattctaccatgagttttggaggggatattcaaaccatacacatgtcccaaactagggcctagacctgacttagagatgtgtgtggtctgagaacttctgatcagctggttggtccagcatgccccaaccccagctccactgaccagctccaggagtgagtgaggtcaccttcctcacaactgctcattccagcctgtctctgaactgttcactcctcttgaggttcagaggatgcaggtctttgtggttccagggatgttgggcaaacagtcttttccacagtggaatatgactgtgcttgtgacttcgcagtgtgcagaggacactcagcacctgcctctcccccccgactttgtcaggcccatgattatcaccctctccttcatcccaagttcatctgatacgcatgccaagatttcagtgaggctggggacacataaggatgatgatactaaaatgaacaagttccatttcataatagtggcagaagatcagagatctgtaggggagttgtgcccccactctgagtatttaggaagcaactctagggacatcttgctctgcttctcccttctctgcacaggtgaaagaaggagcctgtgcagacaatcgttcattagaagctcctgccttcttcctcttttccaccccctaggactggatggggcctttgtaatggcttcaaattatagtgagagtcaaacaagacaattggtcaatgactccaacatccctctcagggctgcctgacatgagacaggatggattgcatctgatacacccccacccttctttcttatcggtatattaggtttttcttattgatgtgaacacactctatattacacaaaataagttatatttatatttcaaacctgtgatggtgatttttaaattatagtaaaaatatacatataaaatttaccatcttaatcattttaggtgtacagatcataagtattaactatattcacattgctgtgcaacagatctgcagaaattatccatcttgcaaaactgtagctattgaataacagctccccattttcctgcctcttgtggtggttttaaatacaatgcaatacatactagctgaaaatggaaaaaagaagtatatgaaaatgttaaatgcatagcacaaaaaatgaataatagggtcactttggttataactttaaatgagaaaactcaaagtaaaacaacaatctatgatatatcatataaaatgcacaatttaaaatttttaaaatttaatattaacaaaaatatatgtaatacaccacataagtattcaataaaactgaatacaattatgtttaatttttttaaactgtgaaaaagatcctattaacttttgaatatttacgcaaggaaaccaagtacatctcttcttgaaaaagtttgattccaattttttttttctttttttttttttgagacagagtcttgctctatcacccaggctggagtacagtggcgtgatatcagctcactgcaagctccgcctcccgggttcacgccattctcctgcctcagcctcccgagtagctgggactataggcgcccgccactgtgcccagctaattttcttttgtatttttagtagagacggggtttcaccgtggtcttgatctcttgacctcgtgatctgcccgcctcggcctcccaaagtgccaggattacaggcgtgagccaccacgcccagccagtttgattccaattttaacagacaggtgtttttgacaaccagtttattttcttactgaaattttctttttctttttttaaaaaattttaaatctttaatttccgttttcacttattttcttcttgcttccaaaaggaaaggagtgcgtagctctgttgcctgtacatcgtccacagcccctggctcggggcagggtcccctaggccgcccgggggtccacatgcagcccctggggggccggcgcggggtgaggtccggccggttggggccgccgctaggcgcgctggctgggcagctcctgggagatgaagcgacgcaggcgctccaggtactggctgtagagctcgatgtcgttgtgtccggcgccctccacccacagcggctccaccgccttggggcagcgctcgtagagcgccagcccgtgtgagaagtcgatcacctcgtcctctatgccgtggatgatgagcacgggcgacgtgatcttggacaccttctcgatgttagggaaggcgtcgaagcagtaggtcttggtgtcggggaaggcgacgcgcatgcccgaggtgagcggcgagtgcagcaccaccgcggcacactcgtagcgcgaggccaggtccacggtgggcaccgtgccgatgctctgcccgtacaggatgatgctgtccgggctgatgccgtacctggcggcgccggagcagggtcagccgcggcctccgaggcgcgcgcacccttcccaccagcgggcgtccccgggcccagctccggatgcgaccctctagtctccccactcagccaagtcagtgggtcaggcccaggctccacaccagtcccgagggccacccccagcccccaacaccgcggcggtgggcgaggccagcggccccgccccgttccctggcgctgccgttcactggcgtttcctagcaaggatctgcagggatcccgcctacggagtgcccctggggcaggggtaggggaggccctggcgcctgttctcctcctggtcacccctaggtgcacactgggaactgtgtgccccccacatcctgaatgcttcaggcctccctgcccgggttagaaagccgttcctggtgcactggccaggacagcggacactcttccttcctgcagcccttgcccacccccttggccatgaggaattcaggcagctgtgtccccagatgtctccacccaattttggactctcggagtccccacgcccaatgagatgccagtgcaacccaggtcagcatcgaaggtggtggctgcggaggtggcaccccctcccaccagcaccttcccttgggagtggacaagtcctcggccacctcagcaccaccagctcccacccagggccacccccacccccaggtcattggtgtgcggcccttgacccagctgatccagcaccagttacaaggcctcctcgtacccagtcccaaccacgcgggacccacctgccaccctgcccatgccaggaccccacaactctcctcccacacgctccaggctctgatcccaggcagacaccctcttgcaaggcaggagcatgggcaggtgtgcgtcccctctgcctggcattcggactccaccagcagggctgtccccgtccctggcctggaatcccagcctcctggcagcactccacagctcgccactcacccatgccccaaaggatgctgcctggctggtacctgtggccccagctctgcctcggcctccctggcctgctccctggcagccatggtcagtagtgtgctgagccagcccagccctgtcacctgctacaggcaggagcccccagctgccacctggatgtccccactcaaatgaacgggacacatccccagtggaggccctgggcacgctctggcctccccctcacagctctgggcctaggttcctgcaggacaaagtggcagcaggacagatggccgagcagacgagctcagagctggccatggcgggtgtgactctgccagtggcccaggcagtagagacaggaggggccgaggaagtcgcatgaagtggtacttggtgtcagcgccccacactgctgggaggcccccagagccagggtggtgccaggggaccagctcccaggcccacagcagggaccgcctgcaatatcaccaaggcaacgaggaccccacctccccagggcctctgacttctcagagttgtgcctggtcccctgtgggagcaggtcagaccagtgggctgggcagggccaggatgagacagccccagtggatggcgagcaggaaaggccgccagaggcccacccgggtctcctcgtccaaagcagcactggcccgggcggtgctcaaacaccggtgaagggcccaggcaagcgcagggctggggacctggatgactaggagggctggatctggaatcgaggctggcccagacctcgggtgtgtgctgggggtctgcaccttaccctgcaggccctgccccaggatggccaagctccgcagccacagggcctcatgggccaggcctcgggacctggatgcagcagcctcgcctcacttggccccaagtgctgccttggcagatgggctcccagccacacgtgcacagacccccagaccaccacccactccctcccaccgggtggcatccacgcccctgtgacaagctcagccccttcccgtcctcaggccaggggttccagggagcctggctccacaggccagggtgtgggaggaccgcctggccacacctcagccatgtggaggtggcacctgcacacccaagctcgcctgtccggctctctggccctgtgcatccactgtggctcccctcctgcagggccgcccaacttcctcccagggaagcccgccccccggcccccggcttggtcccctcttgggtgtgcccaggctgagctgcccccagggtcgccctcacctggtgtgcagggcctgccaggcggcgtcgatgtcggcatagaggttcctctcggaaggcctgcccgcgctggcaccgtagccggagtagtcgtagaagatgttgcaatggaggcgggagcccaggccaatgtagaagctgctcatctggctcaggtccacggcgttgccgtgcgagaagaagaccgtgtacctggcaccaggcacgcagcgaacatacatgcaggagacgcggttgccgcgggcgctcttggtggggaagacctcgatggtgtccagctcgcgctggctgtactggaagtcggcgcgctccgtcaggtgcagcttccagcgcccaggtgcgcccgaggaggcccgcagggtccccgagggggcggccccggccccaccaggccccggctcaggctcaggcaccaggaaggcgagcttggcagcgatgcggccggggcagggcgggcagcaaaggcagcagagctcactcagcgacagcccattcatggcgggcgccgcccgggccgggcctccaccggggcccccgccaacaacgccgcctggcctggcccggcaggggaagcgtgggggtgctccgagtcgcgggcaggggggagagcgcccccccagctaccgccccagacggcagccccgttaggaggccagggcccagccccatcgcggtccaagccgagccccagggagcctcgcaaccacaggtctccatgtcgtgccctgggaagcccatcccggcccgcgcccccgggccccagggccgcgctccatggctcccggccgcccgcccgtgcatccgtcggtccctctgcgccccggcccggcctcctgcaccgccaccgccgcagctcccccacggacggaagtgagtttactgaaattttcaagccacagaaagaacaaaagaagtaatatccattatattgtccaaaacaatagtacctggaagatctggaggcaaaaatgaagcctgagaatagcaggacatagacatatttcataacatagactcacagcagaataatggttatgttggttcattagggaagaaaacactaaacagctcttgcagatacactcaatatacagtaagatagcttgtgattttaacgagttagcaaagcagaacaatgaggcaaaagcaaacagaaacactaaaagaaatccattccctagaatcatttttaaagactttgctagatttaccaaagaattcagtattgacttattctgtctccattttatttcataatggaacccgtctaattttatgctaaatgtatgctgtaaggacaccttgctactctgaaaaaataagggatcagtggataaaagaccatattttattaaaaaaagagtgtgttttgatgcatgattttgtgactctacatttttaagtaaggatgaagaacttggtgattaattaaatgattcctcagttgctcatcaatgccatcagatgccttgaatatactgtgaggacagcatctggaagaaatggaggagatctgagtaataattcagatggagccaatttccacaatcttattttcccattacctgcagctctgaatttaactaagtctctgtgttaacaacttgtattgtttatctgggtgaatgacctcagaagacaccaggcagctggatgcctgcacttctttcgtgctaatggttcatatagtctcctcacccccaacactttgatacttccttgaaactggattacatatgagatagaaacaaagaatgcaggtggcataatgactctcaggagtcactgaatctgtgttcatgatgcattactgtgccagctgcctccctcttcttgtgaaggcccttctttattccttgagatgtgctcatcatgaaatagctacaagcatatcatctgcttgccttgcccgttatagcaaccatgaaaataaatttgcagcatcatatatagcccaaatattctcgaaagatgatcctaatagctctaataacaaaataagttttctacagagtagctatatgtacatgctctcagcttatgtaaacttgtgtttttattgctcttaaagcaaaatttttcctaaaattgagaaaagaactaaagttctttgtcattatatgaagaaagatacagcatctaatattgtgaacttctctattttgagatgttttcagacatcaagactggataataggctgggcacggtggctcacgcctgtaatcccagcactttgggaggccgaggcaggcggatcacgacgtcaggagattgagaccatcctggttaacatggtgaaaccccgtctctactaaaaatacaaaaaaattagccgggtgtagtggtgggtgcctgtagtcccagctacttgggaggctgaggcaggagaatggcgtcaactcgggaggtggaggttgcagtgagccgagatcacgccactgctctccagcctgggcgacagagcaagactccgtctcaaaaaaaaaaaaaaagactggataataaaattatttaacaattcggaacataaatttagaattgaaaaaagctttatactatactatactatactatactatactatactatactatactactaacacattttgtttgagcatggttgccttataagtttttggtagttcaatgaaaataatggctacttgtgagaaaactgaaatagactaggacatagtagatagagatagaaagaacaggtaaattaactgtctatgccacatggcaaagaaagtttacagtacgtagtcattaaacgtacatgcttataaatatataaccaatgatgaataattttaaatgcaatttagcagaattcagaccgttttatattaaacatatatttctgaatgaaatataaaatctattgaatgagggagacactttatatgtgtaattaatctcataaatagagaagacttttacaatagtttgtacactttagctataaactgtaattcaagagattcagtaagagtagctttttgtaacttaaatattctatattttccctgcatacatttttgcctttgatcatgtattttatttagcctgctaagatggtagagaaggtacagacagtaagcttttcaacctgacacataaattcaggttatttgaaaatggaatggtaaagtgttactgaagaacttttactatggttcgcatttggtaatatttcctaattattctataaacaaaatccaaaaaaaccttgatttcataacataaacttctgaggtctaaattaatcaataaaataaatttgttttaattaattattagattaaattatttatttaaataattatttaaataattatttaaataattaaattaattattagattaaatactagctgaggctcattagaggtaaactagagaattatcatcccattaagataaattttgattcagggaagtaacatcttggaagtttactaaatttaaatttaggaggaatttactaaatcaagtaccaagattttatttctgcaccaaatggaagacatatgtaaaatttaaatacattccattacttaatttactctttactatcatgagaattagtatagacagcatattttacacagagcatacaaagccttatcttcattgaattacaagtaaaatatatgtatgtacatataattatatatgtaatttagatattaaatgacagaatttacttatttacctgtgtgtgatggaatttgattctagtaattattccaggtacagtaactggttgaaaatgggacatgaagtaaactgatatgcttacaagtaattacagcaagcgaattcattgtaatgtctccaagcaaagcaagactacccacatgagataagaaatgagaggctacttattttgaccaagttagctcggtgacttggggaccaaggactacatgcacatggatgcttcttttgtacccctacccctgccaaaaaatatgtttccatggcaatatttgggaacccattatttcccaattgatgcttttactttcatataagacaacagttgatactccaaaatcaacttacattttaattaaccaaatacaatgttcctaaagacaaagagaaacatttcataacaataagagttaagccaacagaaagatagggagtatgaaaaaacagagaaaatcaataaaccaaaattaaatgcttgaaaagacaacacaattggcaaatgtttatttaggctaagcaagaaaaaagcagaagagactcaagtttctaaaatcagcaataaaagagaatccatcactgctagtaatacaaaataaaaataaaagacaatgcaatgaaaatcttatgctaaaaaaattagatagcctagatagaatgaagtcctagaaagacacaaactaaaacagactaaaggactaaggagcaatagaaaatctaaatagacctacaaaaggtaaaaagattggattgtaattttaagaacttataataaaattcccatctcaggtagctatcactctgagaaattaatatcaattgttcaccaactcttgcagaaaataaaaggggagagaacacttcccaattcatcttataaagccaggattactctgacaccaaagctatatcacaaaacaatatataacagtatctttcttttttttttttttcagatggagtctcactctgtcgccaaagctggaatgcagtggcccaatctcggctcactgcaacctgtttcctgggttcaagtgattctcctgcctcagcctcccaagtagctgggattacaggtgtctgccaccacgtccggctaatttttgtatttttagtagagatggggtttcatgttggccagactggtcttgaactcctgacctcaggtgatctgccaatctctgccttccaaagtgcgatataagtgtcagccttatatcacggtgagccactgtgcctggcccattgtttaaataaaattaaaaatcttcaacaaaatactggacaaactgaatccagcaacatataaaatagattatacactatatgcagatgtgatttaccccagcaatgcaacattgatttaatatttgaaaatcaatgcatacaaaaatcgcattaatagaataaaacacaaaaatacatgagcatctcaacagaaagtatttgagaaaatattacacattttcatcataaaacactccagagttatggacaagaagataacttcctgaaactagtggtagttatctatgaaacccacagctatcattatacttaccaaggagagagtgaatgactaatcagaatgaccactcttgcaaattctccctttttcaccttcctgctctcatcaccctcttttgctcctccatcttcccaaaaacattttcccccatcttttcccaaagccttctcccctctcctgctgctcaccaccattttatccccctccacctaccccaaaacttttttctcacacccccaccatcttttcacaatgccttctctccactcctgcttaccaacctcttttccccactcctgcccctctcccatatgccactcttttttcaccctccatctaccccaaaactatttgtcttcccaaccctcctccccctcatgctcgccaccatcttttcctcctccatctacccaaaaacttttctccccactgtctttttgcaaatccttccctccctcccgcttgcccattttccccacctttaccaacctctctttactcctcccacttgccaccctcttttccccctccatctgcccaaaaactttttacccaccatcttttccccaccctgttttcacaaaaccttttctccctcctgctcagccccccgtttttccctctcctatttgccaacctcatttccccctccatctacccaaaaacgtttttttttcccaccgtctttttcctattgcctttttgcaatgccttctcctgcttgccatcctcttttcccgttggtactcaccaccctgttttcctcctccatcgaccccaaaactattttccccctcttaccactccggtcgcactgcagtcgccatctcggccaccacccacagtgaggcgagccgcggtgccgcaggctgcagcctccagcatttggcaggtgtcttccttccccttctcctctgcctttaagttgggcacagaagagctgtgtaggcaaacaggaaagaacccgggatggtctgactcccccacctcagcatactttatatgcggagttatgcaaatgagttctgggactacatgttctgattggatgagagaaaaacctctaggcatacttagattggactttgttatcatgttctgactggatgagagcaagtcttaaaacgaccaatcagaacatgataataaagtccaatcagagtaggcctagaggtttttctctcatccaatcagaacatgcagttcaggaattcatttgcataccctccctgtataaagcatgttgagtgggcagagtcagggtcttccgtatattctccccgcaccatccgtgctcggcttagtgcaggaagaggagaagaacgggaagacaaccgcggcacagcagcttacgtgctgatgttggctgtggtgatggagcctgctaccggagccacagtggcccacagcgggagcatggccagagtggtggaaagacagtggggcaggtatgctatcagagctgcgctgcccgcggtgagggcagattgggggcgctatctggggttgcattgcctaggtgggttctgtgcagtatcggggactacgttacttgcggaggtggaacaggggaagggggtggggtgggggggacactattgaggatgggattaggtgtgctatcgggggccgtgctgatcatcaaggcagcttaggtgtgctatcggggcaggggacacgctgctccgagttgggggatgttacaggggctacactgcctgtggctggcaggggttaggggcactatctggggctgcacagccggtagtgggtggcgtgttagggacgctataagctactgtgttgtctgtgccccagggagggttaggtgtggggttgggtgtgctatcggaggctacagtgctagcagacaggttaggggcactgttgggtgttgcaccgcttgtgccaaggggtatgtttggtgtgctatttggggctacaaggggcaggttgggagcactgtcgggtgctgcactgcccatggcaaggggtgggttgggtgcactatcaggggctacactgcccagggcggggcgggcggggggggcgtgctatcctgggcttcactgcccatggcggggggctggttggggacgctgtcataggttgcattggggtggtagggggcgggttcggtgtggtattgggggctgcattgccagcagtgtgggggggggggtggttgggggcactgtcaggagcttgcgctgtcaagctagtagcaggttaggtgtgctattgggggctgcactgcccgaggtaggggggcggattaggtgcgctattgggggctaaactgcccacagctggcggggtttgggggctctgttggggggttgcagtgtcagaggcgggttaggggcattatcagctgctgcactacccgtggcaggaatcaggttgggggcactatcgggtgctgcaatgcctgtggtggggacgggttgtgggcattatcgggtgctacactgctggcggtggagtggttgggggtgctatcggggtcacactgtcagcggcgggggacaggttaggggtgctatcggatgctacactgtggtggagggcagggggtggggtgttgagagcgctatttgaggactacattgctggcagcggggggcggattaggggcactctcagggctgcactgccggcagcaggcagcagaggtggcagtgacagcagtggtctccacggaaaggacagtccttccctccctggactccaggctttacaaagcgattttctcctgcttaagtacagaggacatacagtgtttccgcaggaatactgagcacggcagggccccccacatctgctgtggtttcctgggttacaccctctcgctctgtgttgtggatactgcctgggacccccaggcaccgagtaacgtgcaccacgtgggggacggtgctctctgggtggaggctcaggaatgagagcccgcacttgggtggggagagctggctgggtctgactttttgctgcttccgttcccctaggaccgcagctctggtgggcccagtggttcctgcggagtggggagccgggcactgtggtgtctccagtccccaccacaggctccgattcatggccagcttgggccgaaaggggagggtgggtgtcagtgccttcgctgaaactggcacctgccacccagtggccagcatgaccaaggtgaggctttaatgctaccactccctgcatctgttctaggtttttctggctttgcctgcccagcagtctgtgcccacctagaggagtaggaggggccaccatgccgcatgctggaggctggagcccgcagcctgcagatggcacagtactacagctcgccttgctgcggttggtggcagtgatggagactgcagctcgaccccagcgatggaggctggaggtaggagggtacctggtggtggccacgtggtaggagccttgtagggtggggctggtgcattgagagcaacagcagcagtggttgtattggcatgggcattagtggtggcagcagcagcaagtctgtgagccgggaagggggtagtaggagccctgcaaggcccagctggcctggggtgggtaagaagcagtgggtgctgcagcatgggcctcggtggcagcagtggaagtgcagccagggcaaggagtcctcccccacctttctgcagtctctggagggcgcccacctcctgctggctcctgagccaggcatgagtggcagcattgtctcattcttaacaaaatttagggaatgactatttgtgtatctttttgcttgttttttgttgtgttaatcttggacttttcgaatttcatgaatcagggagtggataaaaggtatcataataggccttctaactctatcacctgatttttttcctttcttccagtctgttttttcttatcaccatcatcttgttctttattttcttatgctgctgcctatatttctggtttctattcttgtttctctttctggtcctcctgctttttgttttctttatcccaagcaatggccttaacaaactgaaactgagttaaaagtaaactacttgctagtgtgttgtatttttaaaataattggtccattactgtgttttagagatgagaaagtagttgcataatgatttagttacttgaatagctttgctttcgtgatcctgttaatgcgttgtaagtagttatgcaaggaatgaaaaaatgaagcatcaaataaaatactgatagcaaacagtcatttcatctctctcccatatagtctggagataaatgcaagtcagggggttaataagttccaaaaatttatgagatcattaagtgaaccacattcccttcattttatttttctgccacagttttcaagagcgttgtcatttgcatgagcaaaccttgttcaccacatctttgcaacagggaagggaaggggaggatcatatgtacaatgttttaaggcaaaaaaactcacaaccaaaagcaaggctttattaactttcaccttcgagaagctgcagtgttgagccctgttttattcctagtattactgcctttgatacgaactcttaagtgatcactttagaagttaatgcattttattgactgctttcaagaaacagtctatattgtatcatgcatgtttttcaagcccgcagaattgtataaggcctatatatacatagggcctataattttgacactttttaatgatttataaggttacgatcatgtaaaatcctgttgacacgtgagaatatgcctaagtaccgctagatagcttattttgaagagatagttattttgaagagatagaaattggttgcagtttgttaggtgtatttgtcaatgcattgcctcaatgctttaaagcatatagaagtttgaatatgctttaatctcatgtagtcctttgtttatagggtgtttaatatttttaaagactaaagatgtcacagccccctttaaggttcagtaatattaagattggagatttatagggttagaatccaacaaattcagaggaaaattgttaaattatatagctgtagagcaggaaatgaaacccaggttctaagctctaaggggaccatgagctgccataccaagtgcatcagtgactgggcatagagttggcagaattacaggatggttaagagagtgagctgtagagcctcactctatgtgaacatgaattttatataagtatgtatgtatttatttattttgagatggagtctcactctgtcgcccaggctggagtgcagtggtgtgatcttggctcactgcaacctctgtctcccagattcaagcaattctcctacctcagcgtccccagtagctgggaatacaggtgcacaccaccatgtctggctaatttttgtgtttttagtagagttggggtttcaccatgttggccaggctgttctcgaattcctgacctcgtgatccacccacttcagcctcccaaagtgctgggattacaggcagccactatgcccggctgtgaacatgaatttttaaactgcatggtgctttgggtcccagcttctccatctgtacaatggggacagtactaaggttttctttttcttctcagttgactgaattatttccatagtctgtctgtcttgccactcttgttacccacacgaaaggacctaaggtaatttctgacagcctgggactccttgtgcaaaacagaaggtgccacagacctcattttaggagaaacctttgttttcctcttggaaccccaagaactgtaagcagacaggtccatctcaaaatccaaggctctgctctgttttgctttgctttacctgactttttttttgatttgggtgggcatcaaaaattagtaggggagagctaaagaaagttgtggatatgaacatgtatttatggtaaggtaagttatgaaggagagaaatcttaggatcttgtatggcaaattcttgcactaaagtagataatgactaattaggaaagcaggaaatataggacaagtcagaaagtcataagatgggagagaaaagcttacgcctggtagatcctctcctgtctagaagtgtcgtatgtgtgatgtttatatgaaggagctctaattaattggattaaaagataatgaaagctctaaaattgtcagaaaaatagaagctctaatgccttttatttcacgtgacttcagcaatctttgggaaatgagagttttaaaattattggtggtaaaaagtcttcaaaaagtagacatttggtctaaattaagtcagaggttaaattggctaagtgctttaatgtcataaactgcttctttgactttggaaaattgttcagtttacctaatttggaactgttagatttctaggtaaggcctggggagaggtggagttagccatgtctcctagctatgctggaagagttagactttatctgcagttctgtcatgtatcctggactctgcacctggtatgtaattgaaactgcttacattgaaaagaaaaattatgtgtttttggttttaaaaggggtgggaatatggttttttccaaaaagtgagttttggcaaatttagaaagtttaagaattatttttagttgtaggaaaataaagtttaagcaagttatagaaggtttatgaaaattaactttgtaaagaattgtgtgtgtgagcaagttgactaaagggacagtaatgttagatgtaataaatgcaggtacccttccactttatcttctgtttcttaggttataaatattcactacctacgtttctaaaaactctttcactataatattaacacataactccattctccttgtattgcctgctttttcatagtatcctgaaattgcattagtagatttagattcagaagatggtggggaagcatcttatgagtgttttaagtaaatttaaggcaaagggttttctgtacatgggtggttatcacagcatcacttgttgcagcaaaacactgggtaacaacaatgtttatcaatgagaaattgttcggataaatgatgatttgtgccttgcgaggctcaactattcaaaagcaccctcttttcctcacttgctttacctttggttctgggcctggagcctttcagaggttactcaggaaatggactcctgtttcctgtgactaatctggacagcggcttcctatttcattcttcagcatcttccaaaaatttctgaagataatttcttcctttgtgaccacccatactcttggtttactttgcagttaacaatttcatgccttcactagattatctgtgtgaaggtgtggggtgtatgtgttcatactctggagggagcagaggaaaatagccacagccaaaggagtaatcttgcactaaatactcattataagaatgttgatacgttcatagatggtaaatctgtcagtaatttttacttgtatgattcttggttaagactgcactcactggtgataagcgtgctgaagggatcataggtgctatacttatgtgtgggaattgcattcaaaccaccaatgcctgtctactcaagttttgttgccttttgattaaaaactcttgggaatgtttccctggcatgcaaatatgggaactgcagtttgattctaggtagaaactctttggtagttgaaatgccataataagagacacagctgtcaatgggcaacaattcactgttggtaaggaatttacagtgctacttgccatattcttctttatccagactttgtgccaagaaaatgaaattctttttaaaaatttttttctagagtaatcctacaatattgctgttatcaagcctgatgctgtaattagtagaaaatgtctagaaattaaaagaaaagtagtattttccaactatggttaaattaattgcaaaataacttcctcttaattgtcagattggagacaagcttattaagagtgaaataaaacataatgtgttgctggtgctaggtacctctaaagcctttgagcactttcttctttataaaggctcaatctactcatgtgtcctgtaaataatcctgctctaccagcatcctatgtaaattttaaaaattatagttcatatattagattgtaacaaatgttgttcttctttaattatatgcaatgcaatcttgttatagactcacattagcttgccttattccctgtatgtttgctgtaaaatgtatagtccttttcaatatatgatagcttaaagatggacttaatattttgttttagaaccaaaatcttttatcttatatacaggaaaattacattggaattcagagatcagcaaacatttcctgtaaaggatgaaatagtaactattttcaggtttgctcagcatgtggtctctgacaactaaactctgaagtcataccaaggcagcatcagtaatgtttaaatgagtgaatggcgctgtgttccaataaactttatttacagaaacaagtggtgggccacattttgactgcagggtatagtttgtggacccctgaacaatggctttttctgaaacaacacaattgaattgagatttgaaagaatgttgaggcagcattgtttgtctggggtaatacctgaggtttgtcatctcacaccagggaaatcagggatgtggacacacaagaagtgagttcaagagtggatgattaataggtgaaagaaagagaaaagagaacagctctctctcctgcagaaagagagaggggcacctgagtgggtcttccggttttgtggtgaaaagcacaaggttttataaaggagcttgaggaggtggtgtcttgatttacacagggctctagagactggttggaccaggtgtgaacgtttgcatagcacagggagaagctggccattgcaccctaatcttttattatgcagatgggttctttaccttaccaggaccatattgtctgttccttactgtacctgtggttgacagagaaaagggaagatggagccaccatgttgaacatgcctggcccacaggtagccttttcctattggcacagctgctggcattcctatgagagcttatcaatgtctgcagcccaattttacaagatgctctttgttagaaaataaatgatatgggttttttttttcattagtaggaaaactttacactaggacttccttactttcagtatctgcctaaataatttctttttaattcctacatcaatgttgcatgtgcaatagagaaggtgacatgtagggagctgtgtcagcaggggttgcatatttcttgatgagcatcccatgatgcattcttcttcacttgtggcaacattagcattaactaatctacagtaaagtagatgggtccacaggtcatgggacatacactagctctgccaattacatgttgatttaaataatatcattctctaaggacagctttttttcccccagatcctggtatgtatgtggagttggggagagacaccaaactgtaccccatttcctcatacattgcttatacttttagaagtgtttgaaagataatatcacatactagtagtttactgtttcttattcaagttagttttaatagtcgctagggtgaatgttttcaaaattgtatagatattcgggttgaggcaatactataaattatgagttcatctcagtttttttgtgctagcgtaatgacatttcggagacataatgcatatgtgcaaaatacttcacctctctggaaaacagtaaagggctacataataggacagacaaaaataaaggcttggcgtaatggctcacacctatgatcccagcactttgggaggacaaggcgggtggattgcttgagctcaacagttcaagaccagcatgggcaacatggcgaaacccatgtttacaaaaacgataaaaataagccgggcgtggtggcatgtgtttgcagtctgagatacttgggggactgaggcaggagaatcgcttgagcctgggaggtcaagggtatagtgagccgagatcgtgccactgcactccatccagcctggataacagagtgagaccctgtctcaaaataagtaaaaatttataaaacaaagaatgtttctaactgtaataaaggagaagtgatcaagcttaagtgtagcttagatttaatctttgatttccgggtactatattacttaaaaatatgatttggatatttagaagttgttcaaattagaaactcaggagtggggtcactggtcactaaggtgctgaatatttttaataccttagtggatatgtaatcaacaaagccaacggaaccaatagagcatttgctttcataagaatttaagtgttgctgggtactcttaaatcgagctcacattattggtgtcatttaatataattactgaatttctttgaacccagtttccactttttaaaaattatttagctcattaggctgaaaacttctctttgttacattttattacacttcagtgtaatatgtgtaagatgtacattgcttctctctagaaaggtgagacaagttgaagcagggttgggggtgggtgcttccagttcataggtaaataggagacaaacggttgcattcttttgagtttctgattatcctttcactgaatacacaatttacatgcaagatgccatagaggaatagtcacttatgcctgagtctggcttagtgaatctgcatttttacataaaaaactgggcagagaaagccaatcagatacacatttgtctcaggtgaggagagggatgactttgggttctgtcctttgtcccccacctgtaaagataatctatcaattgccaatttatattgccagggtcaaattcaacagaactgttttagtgtaaagatcttgaggcccacaagaaatttcctttctgacaaattatgagggaggtatatagctttcgaaatctttgtagttatttttttattttattatttgggttttttttttctttattgacaaataattgtatatactcacagggacatagtgatgtttcaatacagaaaagttatagtgagcagagcaggataatttcatatcctttgttaaaggaaaataaatctccgggacaccccactaagccaaataatagttatcttatttagaaataaaatgggaggcaggtttgtttgatggagttcctagctgaggtgggagaattgcttgaacctgggaggccgaggttgcagtgagccgagatcgcgccattgcactccagcctgggcaacaagagcgaaactctgtctcaaacaaacaaagactatagaaaagctatttgtgaaaatgctttttgatgtgctgttttatgtcacagaatgcaacctgtgttttgattcagcaagttcaaaacactctttttgtggaatctaagaattgattattttgatcctattgagctttcataagaaaatatgaatatccagttgtaaaaactagaaataagctataagctatctgtggaatgctttgtgaggtgctgttttatatcataaaattgaacttgtgttttgattgaacaagttgaaattactcattttgtagaatctaagaagtaacgttttggaacttcttgagcccttattaaaaaatagaaatattcagtcctaaaaactagaaacaagccatccgtgcaaatgcattgtgatgttctgttttgtatcataaagttgaacctgtgtgttgattaaacaggttctgaacacttttttttgtagaatttatgaagtggcatttctgagcctattgagcccttatacaaacatacagttttaaaagctagaaacaagctatctgtcaaaatgctttgggatgtgctattttatgtcacggaatgaaacctgtgttttaattcaataggttcaacacattcttttggtagaatctgagaagtgacattcccaaacctctgaggcctttaaaagaaaatacgaatattttcctctaaaaactagaaacaagcaatgcgtggaaacgctttctgatctgttagtgtcacagattggaaactttgttttgattgagcaagttcaacgcactctttgtaggatctaagtagtgacatttccaaacctattgagcccttataagaaaatatgaatatttagtcctaacatgctatctgtgaaaatgctttttttttttttttttggcacagagtcttgctgtgttgccaagctggagtgcagtggtgtgatctcggctcactgcaacttctgcctcctgggttcaagcaagtctcctacgttagcctccctagcagctgggactacaggcgtgcaccaccacgcccagctaatttttgtatttttagtagagatgtggtttcaccatgttggccaggatggtcttgatctgttgacctcgtgatccgcctgcctcagcctcccaaagtgctgggattacagacgtgagccaccatgcctgactgaaaatactttttgctatgctgtttcataacacagaattaaacctgtgtttttgtgagacaggttccaaacactctttttgtagaatctaaaaaagtgatgtatccaaaccttttgagccataataagaaaacatgaatatttagccctaactgctggaaacaagctatctgtcaacacactttgtgatgtgatgctttatatcacagaaatgaacttatgttttgatgaaacagattcaaaacactattgtagaatcttaagaagtgacatttctgagcctattgtgaccttataggaacatacaaacatccagtcctaaagtctacaaacaagctatcttggaaaacactttttgacgtgcagttttataacacagaattgaacctgcattttgataaaaacacgttcccaactctctttttgtagaatctaagaagtgacatttcgaatctattgagcatttacagtaacgtatgaatatcttgtaataaaaactagaaacaagctatctgtaaaaacactttgtgatgtgctattttatgtcacagaatggaacctgtgttttgtttcagcaagttctgaactctttgtagaatctaagaagtgacgtttttgaccttattgagcccttataagaaaatacaaatatccagctataaaaactagaaacaagctatcagcgaaaacactttttgctgtttcatatcacaaaattgaacctgtatactgattaaacagtttccaaacactttttttgtagactcttaagaagtgatgtttctaaggcagtgaggccttatgggaacatatacataatccagtcctaaaaactagaaacaagctatctgtgataaccatttgtgatatgctgttttatgtcagagaatggtacctgtgttttgattcaacaactgtgagacactctttttgtataatctaagaagtgatgtcaccaaacctattgagttttataaaaaatatgaataaccctaaaaacgagaaacaagctatctgtcgaaaatgctttgtgatgtatttttttatatcaaataatggaaccagagttttgatgaaacagcttccaaacactctttctgtagaatctaagaagtgacatttccaagtcaattgagttcttacaaaaaaaatgcaaaatccagtcccaaaaaactagaaacaagctacctgtaaaaatgctttgggacatgcagttttatgtcacagaacggttcctgtgttgattcaacaagttcaaaacactcttgatgtagaatctaagaagtgctgtttccaaacctattgaacttttattaaaaaagtaaaaatatccatccccaaaaactagaaacaagttatctctgaagatgctttgtgacgtgatgttttatgtcacaaaatggaaactacgttttgatttagcaagttctaaacactttttctagaatataaaaagtgacatttctgagcttattgagctcttagacgaacatacaagtatccactcctaaaaatgagaagaaaaacctatctctgaaaatgcaatgttatgtgctattttacatcacagaatgaattttcaaacactctttctgtagaatctaagaagtgaaatttccaaacctgttaagcccttataggaacatatggatattcagtcttaaaaactagaaacaagctatatgtgaaaatgcattgtgaagtgctgttttatgtcacagactggtccctgtgttttgattcaccaaagttgaaacactcttttggtagaatgtaagaagtgatgtttccaaacctattgagcttctataagaaaatatgaatatccagccctaaaaactagaaataagatatctgtgaaaacactttgtgatgtgctgttttatgtcacagaatggaacctgtgttttgagttgacaagttccaaacactctttttgtagaatctaacaaagtgacatttccaatcttactgagcccttataggaagatgtgaatatccagtcctaaaaatgagaaaaaaagctatgaaattgcattgtgacatgttgctttatgtcacaaaatggaatctttgtttttattcaacactttcaaaactttttgtagaatgtaagaagtgacattttcaaacctattgagcccttataagaaaatgcaaatatttagtcataaatattagaagctctctgtgaaaatgctttgtgatgtgctgttttatatcacagaattgaacctgcattttgatgaaacagcttccactcacttttttatacaatctaaaaggtgacatttcctagcctcttgagcccttattggagcatatggatatcctgtcttaagaactagaaacaagctagctgagaacatgctttatgacatgctgttttatgtaacagaatggaacctgtgtttttagtcaacaagttccagacactctttttgtagaatcttaggaagtgacattttctatttttattgagcccttataataaaatattaatatttagtcctaaatattaggaaaaaacctacctgtgaaaacgctttgtgatgtggtttcatatcacagaattgaacctgtgttttgacaaagcaactttcaaacactgtagaatctaagaagtgacattactgagcctattgagcttttataggaacatacaaatatccagttccaaaaactagaaacaagctcttggtgaaaacgctttgtgacatgctgttttatgtcataaaaatggaacctgccttttgatgaaacagcttccaaacaggtttttttttagaatctaatagttgacatttctggccctattgagcccttatagaaacatatgaatatccagttctaaaaactagaagcaagccatctgtgaaaatgctttgtgatgtgctgctttttgtcacggaataatacatatgttttgattcaacaagttcaagacactctgtagaatctaaaaagtgaagtttttgaacctattgagacttgattaaaaaatacgaatattcagccctaaaagctagaagcaagcaatctgtgaaaacactttgtggtatgctgttgtatgttatggaatggaacctgcattttgatgaaacagcttccaaaacacttttttgtagaatctaagaagtgacattttggagcctattgaacccttacaggaaaatacgaatatccaatcctaaaaactacaaacaagctatctggtaaaacgctttctgatatgctgttttatgtctcagaatggtactggggtttcaattcagcaagtttgaaactttctttttatggaatctaaaaagtgacatttgagaacctattgagccgttataaaaaattcaaatattagccataaaaattagaaacaagctagctgtgaaaacgctttgtggtgtgctgttttatgtcaaagaataatacctgtgttttgatttggcaagttcaaagcacttttttttctagaacctacgtagtgacatttacaaatctgttgatcttttataagaaaatatgaatatccagccacaaaaactaggaaaaatctgtgaaaatactttgttatttgcattttatgtcacagaatgaaacctgtgttttgatgaaacaacttccaaaccctctttttgtaaaatctaacagtgacacttatgagcctatggagcccttatagaagcactcaaatacccagttttaaaactggaaactgtctcaaaaacactttgtgaggtgcttttttatgtcacagaatgaaacgtgtgttttgagttgaacaacacacaagtttccaacactcttgaatctaagaagtgacattttcaaacttgagcccttatagaaacatacaaatatccagtcctaaaaacaagcaaaggctatctgtgaaaatgctttgtgatatgctgctttgtgtcatggaatggaatctgtgttttgattcaagtttgaaacactctgtagaatctaacaagtgatgttttgaacctattgagtcattataagaaaatgcaaatatttagccataaaaatgagaaacaagctttttgtgaaaatcctttgtgatgtgttttctatcacagaattgaacctttgttttgttgaaatagtttctaaacatacttattgcagaatctatgaagttatatttctgagcatttgagcccttataggtacacatgaatatcagattctaaaaactagaaaggagctatctttgaaaactatttgtgatgtgctgttttatgtcacaaaatgataaccatgttttgattcaaaaagtttgaaacactctgtagaatctaagaagtgacatttctgagcctattgagcccttagtaaaaaaacaaacaaaaaacgaatatccactcctaaaaaccagaaaaaagctatctggtaaaatgctttgtgttgtgctgtttcatgtgacagaatggtgcctgtgttttgattaaacaagtttgaaacactttttttttgtagaatataagtagtgatgttttagaatgaattgagcccttataagaaaatgcaaatatttaaccataaaaataagaaacaaacaacctgtgaaatcactttgtgatatcctttttttatgtcacagaatggtacctgtgttttgatttaacaaatttgaaacacactttttgtagaatctgagatgtgacatttacaaaccaatcttaagccagttagatactctgatgagccagctgtgtgtgtatgtgtgtatgtgtgtgtgatctttgattattaaaactgaaaaaataatcgtatattcatgactagtagacacagtgttttaaaactgattctgaaagatttgagggttaggcttgttttaaaaacaattgcataggtcctggaaacaccaagaattagtggcttctcattcctagtcacatgaaaaatattttactactcttgtgaatggccataaataatatgcagaattttttctgtgtcctaaccttttatataattggttctacagtgtacatcactgtgtgcaactttgttttgtgtgctcagacttacattttccagttttctccactttgatacaattggtctgtgtttcatacattttgtattttctatagcgttcctttatatgactctaccacattttattgagtctcctcatgctgacaggtaagtagatgaattaataaatgaatgaataaataaaaatgagagcaaatttcaaacaggtgattaatttagtgattgtaaccatggactcagcaggttagaaataaaaactgaaagatttagaatgcaagcaggcacatcataccttctaatagccattggaactatgacccacaaaccattagcctagaatgatgggacatatcttgtctctaaaaaaaggtcactgttcagttctcaaagaatggatataaaaatggcagataccattccacattattctacttcctttaacctctacgcataaaacttgagctgcagggaatgttacctcctgttcttaaaaagacttgtagttcagtgaggaactcactcctttcttcattcatgtgttcaaataatatagggaaatgaatggaaaagtgaagagaagttgaagactattatggggatagcacaggattagtcagcctcatggtattattgatctgccttattccacaaatatttaccaagcacctgctacatgcaatttgtatactaggtgctggggatacaggagataacaaagtccctgctgtcaatgaaaggggtcagtcctttgattcatctttagttaattttaagcacacaacaactatctcaaactttcttcacactttccaagctcccgatccttcatgcactcttggtagatgcctgaccttacctcttaccttactagaacctaagaccacctggtataaaatcccttaagcacactcagatttgcgtgattttacaatgatgtctgttcccaaagcatcctcacttctcttggagctgagggtgaagagctcctctttcttcccatccgtgatcttggaacatgtacgactacacttgtgacagtaaatgcttaatacaggcagaaggtttgttccttatttcctccctggggcctccctccagtgaatatctcttctagcattgtcagttgtatccaacagaaaagcagagatctctccattggtccaaaaacctaagatggactctcactgctaaacttctcaaatgaaaattcctccactttagtcctgattaccactcaaacactgttagactgggcaggtcactacccctgcctagttctgtttccccatctacataacagagaaataattgcgccttatctatcctacagaagtgtgaagaggtttgatgtgacagcagtgaaagcaatttaaaaagcacagagtgctatacataagaagacattttcataattattccgctctaacatgatatctgtattcatacgatctcaaagtacttacccaagcatggattctaactcttgtgtatgtaagcaaaggtgtaagtctgtcaccctccatgcaaatagaatctcccctcccttggcccctgcatctcaccatatacaggaattaactcaagatgaatcaaagttttaaatgcaagaccgcaaactatgaaaatcctttaagataacctaggccatacccttcttgacaaaggctttggcaaagcatgtgtatgtctaagtccctaaaagcaatagaaataaaaacaattattgacaagtgagacctaatacatgaaagagtggctgcacagtagaagatattaccaacagagtaaacagacagccttcacaatggaagcaaatgttcccaaactacatctgacaaaggtctaatatgtacgatctaccttaagtccttaaatcagatcaaaaagtccaattaatggttagagacatgaatacacactgctgaaaagatgtaacagccaccagtaaacatgaaaacatgctcaacctcgttaatagagaaatgcaaatcaaaagcacactggtcaaaatggtgattataacacagtccacaagaacagataccagcaggacagaggagggcactggggcaattgatcatgattcttatggatagtcatttagtgttattaatgaatttcataacaaaatgatcaccatacaaaaaatacaaaatgtgttttcttccctgagaaaggaaaataaaaacttggaatgccgattcactatgccaaaaggaaaagttaagctgaaagctgagtcatgcaagaaactgcctttctttttttttcctgagcagacagctactgataaatagttaaatttctccacaggtagctactctatgttcatctcatcttacttaaagtgctgatttactgagcaggagaaaaatatataactgactattcctttacctgtttgttttctcttgcaacatgtggattcagcaacgtgaccatactctccctcttttccccgcagcctgcttttctcttctaaacactgaaaccctaaaatatttttggagaaaggcacagacctctgtcgcccagccatgtctttaaccttggaagaagaaacttctaaattgataagagatctgtctcagacactttttcgtttacatcccgttatctcagaaagcaaaacaggctttgttccaacccaaagtaatttgtgaatattcaagcggtatcattctgatgtaaaatttacataaattcttgggtttaccaaaatgcaaatgggcaagcagatcactatttacagataatggcctaaaaaatggtaagagtaaatgctgtggagctaaatgtttctgagtctgccatttcctagttttgtagtttctctcgggcaagttacccaaagttgctgtatgttattatcttgacatttaaaatagaagtaataactttattataaataatagttaataccatagggtcattaggaaagtgtctggcatatatagtcacaacccagtgaatgccattattgtttttgctattatcagtataataattgatactaattttgatgctgaggtaaaataatatctggcagcttttaatttgctaatgttaaataactgaaaatagctttaaaaagtgaaaatatccaaatcaatgacaatatttgatttatataaaataagcttcattttttttagtttttttgctcctaattattacttcactcatcacactgatatctgagcactttttaaaacatatccacccttctcagttgtactacttattcccttttcttgtaatcccagccttcaaagatcctttctcatttttctaactcatttcacgactccctcaccttgacccccagttatatctctcttgaagtcaattccattgaattgactacttggcccaaacttcaccccaactcagtctctcttcaggaaggaaagtccccacacaaaaaggaatgtgtctttcaactcatgcgccctttttgaagaagctttccagacagcttccttacagtgatctccgttatccatcctttagatcgctgtggagtcctacaggggcgcaatgtggacagtcattcaaatgaagcacacctaagtgcttgcattttctaaaggcccattgattcatgtaactcccgtacttgcacagataagatgttcctgcctgaatgcagcagatggaaatgaaaattgtattctctgtcaaggctgattgtattacagcttaatgatttgcattttaaaacttggaagttctcataaatattaaagtgaaagaacaattggctacattattaggtaggttcggctgttcgtataacctggtgctaactatctaacctgcctgagtgagcctcagtcttcattactgcagcatttgtaagatatcaatgcctgcttgaactcatgtcttactaagattatggccaggattgagtaacatatggatataaaagcacttgacaaatcagagtatttcataaatgtaataataatatgctacatttataacatctatactcttttcctgtgtctatcttcatttaaaccttgcagtttctatcataatcaaagattttgtaatcaggttacaatgagtaggatttaacccataagcaattttcaaatttcctagatatgttttcagttttcacatttatgttggtgacaaaattctgttttcagttttggtgtttgcatcttctaaaacagtgtcttgggtacttgctctttgatgagacactgtgcagacataaagagtgtaagaaaacagaacagtttatctcagctttttgtggtctagataacctgcacactgctttcttggctcactgcaacctcctcttcctgggttcaagtgattctcctgccttggcctcccgagtagctgagactacaggcatgtgccaccacgcccagctaatttttgtatttttagtagagatggggtttcaccatgttggcccggatggtctcgatctcttgaccttgtgatccccctgccttggcctcccaaagtgctgggattacaggtgtgagccaccgtgcccggcctgcacactgctttttaataagctgatctgtcttcttgtttacataggctgtgctatagtcatttaaagttcaaaattactgctaaaaagtaattaatcctttactgaaatattcctgctatttcatgagctgtcttacaatttggaggaatctatttgtcactgatgtttaaaaaagaaagtcacagcagggaggctttagcttcattgaggaacattattataaaataaaatgatcgagggtaatttttttttgtccttgtggtactgtttctgcagatctacattaatctgagcatttaaagtaataataaatttgttatatcctctttattattcacttcaccatggtagcccctagtggtaaaaggagatgtaaattgctcagtgctcacattgcagggaattttttcctcagttgaataaaaaggagttaagcctctttggaaatgagggctatagcctgtcaataactacatatattcctgtttttaagaaatcagaattctggtgtccagtaaatgtagatgccagcattattaaaaagtgattgagcagagaaatgaattgaatttttgacccactctggcttccagctttcatgggagcctatacagggggatgatgaagagggatataagagaataaatgattgctctattaatctactttaattgatactaaaatctgacagcgaattacaagttccaggcagtaaggcttaccaattcattggtaatttcaaggttctactttgctttctttttgccttcagctccttgcaaaggacacctttttttttttttttttttttgagatggagtattgctcttgttgcccaaattggagtgtaatggcccttaacatccgcctcctgggttcaaatgattctcctgcctcagcctcctaagaagctgggattacaggcatacatcaccacgcctggctaattttgtatttttagtagagatggggtttctctatgttggtcaggctggtcttgaactcctgaccccaggtgatttgcctgcctcagcatcccccgcccaaagtgctgggattacaggtaggagccaccacacctggccaaggacagccttttatagttcagtttctcagtttatctttgactattcttaattaagcttgacctggttctccaccactgacgctattggagttgcaaagcattttgctgttataatgatagctcccttgatggctgttcattattaactggttttcaaaagtgctgcttttaactttcattttataaatatttaactcaatttttataaaatgtgcatagactatagaggttctgcttacctgtttaatacagtaaaaaaatcccttttgtaatcttatataatattaagaatgtgtccttaattcatgcttaacataaattcttacacaactagcagtatctcaaaaaataaatgatttaatagtttatgacccttatacatataattaattgtagtaaaatatcttagaaaatagaatgagtattttttataaagataaaaaatcctgatttttttttctggtcttaatataaaattaaatgtgttaaagggaacttataaattacatagtagttcattgctcaggaaaagaaatgacaaagtaattaagagtgtaaaattaaaaggattaatttttcttaaaggccgatgagttaacaacacgcatcaatctctcttccttctccaaacttcagacaaatgatggcaaagtaatttttaagaagtcaatttatagaggcaaaaaacctgaagtacagagagtaggaaagacagtaatagaattgagagcagttgacatccataacattcctattattacctccattttctggataagaatatggagaagaggaatcgttaagcaatttgctgattgtcacatattcagtaagtggcaaagttagtattgaaacccaagtagtcttgttttaaagtcatacactcaatcactgtgccataattcaataaattgtgaaggatgggaagcagatggagaagtgattgatgaagcaggactgagaaagtgctgcctatgtgcccacagtgtgaagaccctacaagacatcagaacatcatccagtgaagctgtgagcagctcaccacttggaaaaactgagtgttttggaaggcagggataaagtgcagttctgaaaagagaaaaatccatcaagttctaaacggtcgcgctctcttaccccacagtgggcaatggtctctccattcatcattttcttttccctgagtcccttgaatcttaaatatactattctgtgaattaaacatggtaaacattagactttgaccagcgctattatcagaagttcacatacctaatcaaaggacctgtaaccttcttcccctccttagtttctacaccaccagtagccaattatactatcccagctcccatcctaaaatccccttctaaaatagaaggcaaaagatcatcagtcatttgagcaaaatttcagcatgacagcatgagtagttgagacctatagtaacaactaaaatggactgggataaaacaaataatgtttggaatcaaagaacaggaaaaatacaaccgatattggagcaagaaaaaataaaaaagaatatgaaaaatagataagaaatagctattggaaaggtacaagaaatacaattttaaaaccagtggaacataagacaaaccacaaaatgagaaaattctattaataaaaggtcgggggtcggggaactgtattctttttttttttttttttttttttaagacagagtttcgttcttgttgcccaggctggagttgcaatggcgcaatctcggctcactgggcaacctccaccttctgggtttaagctattctcctgcctcagcctcccaaatagctgggattacaggcatgcgccaccacgcctggctaatttttgtatttttagtagagattgggtttcaccatgttgatcaggctggatggtcttgaacccctgacctcgggtgatcccaaagtgcagggattatgggtgtgagccaccgtgcccggccactgtatcttttaaaaatgtaattgtcatggaaggcaagaaaggtttaggaggctttccatattgaagaggactgaggagacatggcaactaattgcaatacatgattctagactgcatgcaatactggaggaaaatcatgctataaagaattgactcaattgataaaatcagaatactagcagtagattacatcaaagtatcgtatcaatgttacatttactgaatctgactaccatactatagttaagtaagagaatattcctatttttaggaaatacagaagtgtttagaggtaaagggtcatgatatatacaacttaacaaaagacttagacaaatatggggtatttaaataaaggagaatgacgtgcaatctgagaacaagaagtccaacagagaaaagcaaaaatagggagtcagcgagcaaccagtgagatgggagcagaaggatggaagggtggaggagtgacatctaaacatattaagaactcaaatatgttgattattttgtatatctgaagtttgaaattatcactgacaatcttctaaacttcaggaaaaatgaggatactgtgctacaaatgtaaacttaagaacaatatttacatagtcatcataatgtaattatgaaatactgatttcaccaaaaccaatttgatttaacacatcgagagaacagtgggaatagagtcctgtaattggtgcacctgtcctaattcctatgtaggtattataatagaaagttaataggtaatgtttaaaattgataaatcaagataacaatatcagcatgttaggttaaaaacaaggtaattaccaaaagcaccagataaaagagccaaacattgctttctctattgaacgggactacagcatagagaagtgttaagcaagctgccattattcttttgctcttattataagcctcttaatactatttgattactagctcatgagctcctatttataaaaataaaagcaaattttcgaagtcagaacaattcatgctgctacaaaatccctaaagtcatttcaacaatacagcacactgatgattatatagacatttttcttgtctgagttctttgtctagaaactttttaaaagaaacgtggtcctgtattacatgtagcatgctttggaagaaaaactatctccaatcaaaaagtttttaaaagagcccagatgttatcgtcctttgtatctctaaaagcaattgcttttataaaattaggatctactcttttttgaaatttgaatgctgaagttttgtgggtttcagcaaaagataggcataacatacatctctacattttattaaatatgatggtgcagatgttaaaaatatgtttgaaatgcagtaccttctgttcttgctttcaactcctaccctagagtaaatgaaatgctaatcacctcttgtgttagtgatagaatttgtgagtttccacagataaaatatgtttactgtaatttccaaatagttgatagccagtagcaatatcttgacttcagcaactggtatgtaagggtctatattaaagtgtttatattatgactagtataacagatggtattatttgttacagcaggtcataacactaaaaaataaaactattacacatctacaatttgatcacaaattttagtggcagtgatcacttattttatgaaagagaggcagtaattgccgaagtactgcctaaaaatgtaagacaattctcattacagggtaaggtaaaattattgacttattaaccagaaattcacatctatcccgctacaggaaaaaaagtgtacatttaatatctactacagtcagttgagttttcaaagtaatctgtcatctctaccatgaatatggggaacaggagaataactgctggatttttggcatttgacacctaatatatagaactttaaaggaggttatctattatataaataatctttgaagaagagcaatttatgtttttggacaaccaaaaaattacttgtttagcttcacaggaattttaaagcatgttttcacttattattaaacagtaacattgaatatactgctcttttatcagttctcatttttttcaacattcagtagatgactttaaagaactctcaccttcctggttttctttctaaactgagattatttcttctctcacttatgcacctattttctaatggccatgtctcaaaaaatttttattctagcgtcttttttccttttatcttggttttgctgtagtgctagatagatggttacttgtgagactttcaaatctatataccaggctccaacttctctccctctccctctctttttgagtaagggtttggctccatcacccaggctggaaggtcatggctgattgcagctttggactcctgggctcaagggatcctcccacctcagcttcctgattagctgggactccaggtgtacagcatcatgactagcaattccattgtttttagaaatggggtcttgctctgtcgaccaggctggtctagaactcccagcctcaagcaatcctcctgcctcagcctcctaacgtgctaagattacaggcgtgagccaccacacctggccaacttctaagtttcagtgctgtagttttaaattgtttctcatacttatctaatattttttcccaccatgtcaaacccttaaaaactcagtatggacaaaataaatattaacttttttgagattgataattgtatgatagtgcttattacctcaaaagaattactggggcagcagtataatccagtagatgggggaaatagtggatattaagaccgaaatgggatcataactttttagttgtatttgcccacattaattgttttaaagggggtaaaggcctggaatatgaaaacaggaggatataaaatatatggaggttgtgaaagatgactcagaacttgaaacaattgtttcactgcagtaaatacatgttgaatgcatagaacagagaaaaacagaagaaaagaagaaggaaaaacaaactccatgatttaaaatattgatgaatgtgacaataattgtatctttaaaataactgagaaatggtagaaataaaaattataagcttcaactgtatattacttattcttgacaaagatgatagttgcaagctgaagccaaaatttctaactaggactaatgcaaagatttcaagagaaactttaataaagaattattgatgcaagcgctttcagaaagcaaaggtagggactaaccattagctcttgtttagaaagataaaggtcacaaataaaatttgtgttttaatctatacattttcagcattatgtcatcataaatttgcatgttgtttattacaaatgggaaaaggtttcctgtaatatatcaagatgagttttaatagtttcaaggaccattgatttgtaaacttaagactattatagtgttgtggaaaattaaatataattggtgttttaggaaaagttgttcattgaagtttccattttatgtgccttaacagattaattttgcttattaattctgtgatatttaagcactgctgtaagcttcacagatttggcaatagccactatatacttaatgagtacaaactatggagtatttccatattaaggtagaagaaatatttaaaagcacttctacttgtgatgtcattgggggtgcaacacaatataaagtacgcacattgctggaggagaagcataaaataaagaactcacggggcagaaacttaagacacacctaaatcaaatctttgttttcagcattatctttcattactattctttgttacaaaaaaacattgctatctgtccttttctatatgttctctacattaaaacttattatttgtatacatactgttccctacatctgcagtgccattcccagctcacatatctgccctcttaaatttatatcaaattcaactcccttcaaaaagccttctcagttgctttaacccaagccagtagtctgtcttctagaaaacagttgatgccgatgcctccttttcctttagcaactgaaaataatattatagttatttaatgtgtgtgtgtgtgtgtgtgtgtgcataacatcatactatttagtagtatctatatctatcaagtatctgctacagtggatgatagatgacttaaagacagaaatatgttattcatatctacttctcacaggtctagtgctgttgcaggatattttttaaggaatcagagagactgatggggttcaggaggatatttattatttaggtgcaccagcccagtcggattaacatccaaaggactgagccctgaacaaagagttaagttaccttttaagcattttgtagggtgggaggagatctgtgcagggggaagcatgttagagaagtgagaaacaaagacagttattcaattaattgagaaatgcgttacatcatttcttacttttcaaggaaaaacatgttttgcgacttttgtttatgtgtctagtgactttgcagctgcccagctagggaatcagggtcttcacaatgcctgggaatggaggggagagaaagctcattagccacagaaaaataggccgttagttttttaaaggactctagctctttctctttctcagggggaattggattttcttacatacaactgaggttctgcttacacattctttaatttcttttaattcctgttccagtgcagtgcaatgttcatagtagatgcttaatattttttgaattattgtatctttagtcattgcgagccatcattttgagagtcagtctcattcttttagccctagattatttttattttcttgagatacgtgaataaagggcacaggaaaaaaacacagttgagagttttggataatagtaacctaattcacccagattttacttcatattggttggaactctaagttgggtgcaactaacatgagacttgttttgatttattgtaaacatattcttgaatgactaatgaacagtgcttcatgtgaacaaattttcaccttctgataatttccaatattacactttgaaaaacattcccattgtagtgctctagaaaatataatttcaattgttaaaattcaatattactgtaattgaggatattaaataacttgttgttacatgatgctagctgcagcttaaatttcagatcatgagtgttgttaatattatatagttggaattagttctgagatcaatgaatcaatgctgtcttactgttttgtctttaatttttataccacatttattttgtgagtggatttcataaaaggaagttgctttatgttgccaagctcattatcttgggtttttgtccagagctgaattccctttttcatcaaaggacagagagagcccattataaactattgagtaatgctgatttgatgggtaggccacttacctttaagtggaaaggaggccaggcgcggtggctcacgcctgtaatcccagcactttgggatgctgaggagggcggatcatgaggtcaggagatcgagaccagtctggccaacttggagaaaccctgtctctactaaaaatacaaaaattagccgggcgtggtggcgggtgcctgtagtcccagctactcgggaggccgaggcaggagaatggcgtgaacctgggaggcggagcttgcaatgagtcaagatcacaccgctgaactccagcctgggtgacagagcgagactccttctcaaaaaaaaattacacaaaaatgttagactaataaatattaataaacactaaaggaagaaatttagtggaacatttatcagaggcaacagaccaggaagttatagttaccctgtgaaaaggcatcatctaggattcatagaaaacatttgcaaattggcaacaaccaccaccacaacaaactaaaacaaatgaaagaaatagacatttatacagggaaaatataaatagataataagtgtaataaattttgtgactttccacttgaaaacaaagaaatggaaataaaacctatgtaaagaagtggtggagtgagccgagctggggtgggaggggtgggggcatcccaggcagagggaacagcagatgcaaaggtctggaggctggagcaggctgtgaggggtgagagcagcaagtacatgaagtctagaccacaaatcgatgcttcaccctcaaaaatagcctctcactggccaccactcaggcccagatacatgtgtaaggtgggcagccttcaggaaaagtgaccgcaaaagtgcaccacattgggaattctgaggtgtttgagaaagttatggatgaagggtgaggtagactctagtggggaatgtcctcttgccacttggacttctctgtctatttcatgggctattatcaacttctaaagagccagtggtttgggtgcacatttaggtgtaagtacctcttgcctcaagccttaactctctttccaatgagtcaagtgagctgttgtgtttaagtaacttctctttattgtgaaatctttcctatcactttaagaaccttcttcttcagacccaagtaatcccaaggcacctataatgtccctcctggagaagacaaaagggtgtcttctatttctgtgtggcccgatatttcagggcccctaaccaggttagttcaaggtgctcagcataaccatgaatctgctacccatgtttctcaggtgggtcataggccctggagggattgtggctgtggaccaagcagggggtgctgtgggctgttctgagaaggagggttttggagtgtccaagctgagaacatagaggccccagatgttgtatgagtaaattttcatctgacagaattatattttcctaactgaaaacatgaaacagagatgtaacaactgtgcctctttggctctgtctttgcatgctgtcatcagccactgaacaggagctgagagggaagacataaagaacagaaaacccatgagggggatggtccatgtgggtgtggaagtgagggtgagtggggatttggccaaagaggcctaatccacaggagtagagtctcatgtgtgactttcagaatgagcaggagtgagataggtggagggggagtgttggaacatctcatcagaggtgagaatccatagaaggagacactggtcattacagtcagtgagaaaagtgactttagcctgagcctaaggtcattggatcaaggaaggggccaggaggagctccttgaagggaagctgtgagcttgagaggcaggctgaggcagatcagtagaatgagcccccgagaagggctcacagagtcactgaaggactgtgaggtggcagggacaagctcacatggcctttggtcagtgagtctccagctgtaatgagaatgaaatggggaagatctgggacaggaagacaagctgggggcgctggtaccatcatggggagatgatggtgggtggctctaggttagttagagttggaatgaagagcagaaagcagcttcgtgatacctttatgtcataaaatacatttggcatggagaggacttggactttgtgcatgaaggatatggatgtttctaggctgactcccaaatgtttctaggctgactcccagaaactaggatgtttctaggctgttcctggctgagaatttggatggtaactatagtccaaagaaacaaagaacactgaaatcatatcttattttttttaactcacaaaatagaggcaggtagatatttatatgtgttttgttggctcaatgattttttttagtaataaacatatttacttagaaactactgggtgtctgtatgctctgggatttttttctcctgtcctgatgacatctctttcctttctctgggttcaggagttacttcccaggttgtggtgacacaggaacattcactttccacaactcctggaggggcagtcaccttcacctatggctccaaaattggggctgtcatcagagcatctcgacagctgggcccaacagaacatctggcaatgtccccagggcaatggtgggcacaagcagtcaggtcctgggacccctgcacaatcccctggttctcttcatgaagaaaaagccactctggttataatgaggactagaccaagaatgaggcccagtgttacatgctcggtgtggtgatctgaaatatcaccacagggacaaatacaaaaatacaagtgggaaactacactcaaacccttggatcaagcctcagtcctatgcttctgaagcaaatttcttgtttttggagtctggttttcaaccactgtagactcagatcatttattcttcaggcccccaatgggatcatcacaagcactttttctatcaatcatggcagtcacttgagatcaaaggtgaatttcttcttcctcaagttataagcaacactttggcatatttggtgaacttcaaagaaaatggctaagatagaggatgagagacataagaggcttcaggaatatttcagcagatgcaaagcagactacagggtaactcatttcccatatgatttgattgattgcaaaatgtgaaattaaatgcatacaaaggggaatgtgtgtcatttttcctcttaatgacaaagtaaaaaaaaagcaataaaacaaaaacaagcactatttcatgtgtcttgataaacttgtagaaagtcttataatatccacaatatctaggatacagtaaaataactttccatatgaagaaccagaagaacacaacttaaatgagaaaagacaattgatagacaccaatactgaaataatttaggtgctgatgttatgtaactgagattaattaaggagtaattatacaattccttcagtgagcaattttagacattattttttgaagttttaggttcaggggttcatgtgcaggtatgttacgtaggtaaacttgtgtcagaggggacattcttgaaacaagtggaaaagaagcaaatcccgaaaagaaaaataagtcatagaaacaaaccaaattaaaattagaaaacagaaaaatgcaataaattaaaaagaacagtctggagggactctggaacaggtaacagtgaaattaaagttcaggcattagaggaattatttaccgttaagtagggaagaaagtacaaacaatagccatctaagcccagcagagggagctgtggatcttctcagaggtgagcaaggccggaaatgaactcccggggctctcatttatggctcctgggtccatactcactggcccgaattggggtttagagcaggtgctttctcccaaagggcaaactcagagttcccagcagcccatcctccctgacagagcggctgctgcctggctgagcactcagaacttagggagccggtggttttggtagaggccccatgtttgcataatgtcctaaccaaacacacatctacccggggaggtgacgaggagttagaggaactgtcccagggtccagaagtagccgggggttctggggatccttggaaagtccacaccatagcttggatgtctatcctcccctctctccctcctcactgcccaggttcatgtagatttcaaagacaggactttggagggatctgtctgctgtgattcctcacacataacatgtatctgttttagtttcttggttcagttctcaggctgtggtgactcaggagccctcactgactgtgtcctaaagagagagacttattctcatgtgtggcttcagcaccacagcactgaattcagcagaagcctggtcaagtcctcaggacattgatgtgtaacacagataacaaacacccctggatgcccacttgattctctggctccctcctgggggaaagctgccctgacccctcaaggggcccagcctgaggatgaggctgagtatactgtgggctacaccacagtggtccttagcacagtgagagacccagatggggaagcaggacatgaacgagcttttggctgatccggggtacaaacatgaacgtaggatatcaggatcacgtggccagacacctgagctctcaaggacacctaaattttaactatccgtagagagaaaggtgggtggagaggtgtaaattgattcctgtatctgtttgaattttaaagtggaaaatatttgtgaatcatttgggagatgcagattcccaaaaagaagaatttatgtttatattccaaacagaacagtaatagtgagatcaactctaaagactaaggtcaaacacacttcatccagaaagatggatctcaaaagattttgttgttgttttgcctattaaaagctaagagaggaaattatattaataaagtttatttcatgttctatgttaatagtgtgtatttcatagctttttaagcattaaaaattataaaagtgttaagagggattctcttctctaatgttatataagaaagtatccacctaggaaaatattttgaaggtctaacccccagtacttctaaatgtgaccttatttttaaaatagtgttattgcttatgtaattcttaggatgaagccatcctagagcgaggtggcctcttgatccaatgtgcctggtgtccttataagatgatggtagtaaggagattggaagacacagagagaatgccgtgtgacgacgaaggcagagattgaatttacacagctgcaagataaggagcactaaagattgctggcaaaccaccagcagccagaaagagggaaggaaggatctcccctcaggtatatatggaaacattgccctttctatgaattttgggaggctagcctccagaactgtgagacaatacatttgtgttatcttaaccaaacttgtgtttaatacattctgacagcagttctaggaaaccaatacaccagacaataaattacacaatacttctgaaattgattgtacttctttcattttggcaaccagtttttccatgaatatgattatatctgtgctcatatttctaactttataaatatgcttgtaatttaaggttaagataagaaatccttgtgtcttaaaaatccctaaatatatgagaactgaataataatattaacattatgagatctaatggaaaattgtagcttttacataattccacttgttcactagtatcaagatgtgaaggtgggaagatcaccttgttattaacaaaacactcctggtcatctctgtggatttgagagtgcagggggagacacctacatattgtttgggaagtcacaaatgcagcatgcccagagcatcatgtacaacagtgtgagtttgctggacatgtgggcaggaagcagaacagactggggcatgaggaaccacctatcaccaaacccaccagcgccttcctccctggatcagcccagagctgctcagacttgaatgtgcacatggatcatgtgggatcctggataatgtggattctgatcagtgggtctggactgtggactgaaattctgcgtttctagaaggccccttcttccaaagatccacatacatgttttaatattaccatattcataagaatggtgggaaataagggaagccactttcagacagaaaccaaatagaaatttatctgagagggagctaaaggattatgatcaaagagaaatccccaattccaggcagggagctgatcacagagggcagatgggaagttgggagaggttctatttttttttttttaagaaatagaaatgaatgcaaacacaactcaaacctcctcttgatccaacatccctgctggctcctgcccaatttctgcactggcttcttctccagtcttttcccaagcatggaccctcctcaccctctctgcttccccatctcaaactcacaacttcccttctcagttctcctgtttctctccctttcattccacttccttcttctctgtgacctccttagacaatcaccaaaatatttctagaagaaaagccatgggtatttttcatcttttcttgaaagttgtcactcacattccctcttcgttcttcagcctctcttaccccttactacaaaagatgcctgaggccactgtttctcttttccatcccctcaaatagcttctccttccaacccgtttctctcctcagttactagagcattcagtgaagcactcagtcaggttaaaggatcctcccaaatgctcaccctgctctctatgtgtgatctcctgaagaatcaagtagggagagaaacatggcttcatgagtttgtggggaagtgggtgcatggctgaactgtccttgttctcagcaaatgtactttatttcatgcacagtttgtatatgagacaaccttctcctgcggactccttataaaatgggaagaattatgtgttgtgttttcacagaggaagcccaaatattccatgctcatgggtaggaagaatcaatatcatgaaaatggccatactgcccaaggtaatttatagattcaatgccatccccatcaagctaccaatgactttcttcacagaattggaaaaaactattttaaagttcatatggaaccaaaaaagagcccgcatcgccaagtcaatcctaagccaaaagaacaaagctggaggcatcacactacctgacttcaaactatactacaaggctacagtaaccaaaacagtatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctaagaagaaaacctaggcattaccattcaggacataggcatgggcaaggacttcacgtctaaaacaccaaaagcaatggcaacaaaagccaaaattgacaaatgggatctgattaaactaaagagcttctgcacagcaaaagaaactaccatcagagtgaacaggcaacctacaaaatgggagaaaattttcacaacctactcatctgacaaaggggctaatatccagaatctacaatgaactcaaacaaatttacaagaaaaaaacaaaaaaccccatcaaaaagtgggcgaaggacatgaacagacacttctcagaagaaggcatttatgcagccaaaaaacatacgaaaaaatgctcaccatcactggccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaaccattgtggaagtcagtgtggcgattcttcagggagctagaactagaaataccatttgacccagccattccattactgggtatatacccaaaggactataaatcatgctgctataaagacacatgcacacgtatgtttattgtggcactattcacaatagcaaagacttggaaccaacccaaatgtccaacaatgatagactggattaagaaaacgtggcacatatacaccatggaatactatgcagccataaaaaaggatgagttcatgtcctttgtagggacatggatgaaattggaaattatcattctcagtaaactattgcaagaacaaaaaaccaaacaccgcatattctcactcataggtgggaattgaacaatgagaaaacatggacacaggaaggggaacatcacactctggggactgttgtgtggtggggggaggggggagggatagcattgggagatatacctaatgctagatgatgagttagcgggtgcagcacactagcatggcacatgtatacatatgtaactaacctgcacattgtgcacatgtaccctaaaacttaaagtataataataattaaaaaaaaaaaaagagagttaaaggctgagatgaggtaggaggctgccctgaggaagggtctcatcctctggcatctggtcacagacacgatgggcctgggcctgggctgcagagagcacaatggggctgctggtgggggctctgtgcggctctcagctgggaaataaagtccatgaactttgttttgcctcacggctcactggggccagcagctgggtcctctctgggtgcttggggagcttcaggccaagctcagcccaggctgactcctcctagtagtgtcacccagccacagaggctgtacacaggcccagggagagttaggttaagcaggggaagaggagcacatttgcatgaagggcccctccctctcctttgaggctagagggtggataagagagacctgcagcgtggctgcctcagcagagctctggggagtctgcaccatggcctggaccccactcctcctcctcttccctctcctcctccactgcacaggtcaggaggaccctcagcatcctcatgccccagctcactgacaccatctcccaaactcataccagaaatgttgtttgctcttgtccttccttcaggccataatgagcgtctctgttttcagggtctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactcacacagtgatacaggcagatgaggaagtgggacaaaatcctcaacctgctgaggctattgttcagtgacaatttttaattttaaaacattttctgtatgtaaaaaatctatctggatgcatcctctgatttagaacaattttactcacaatttcccatttaatgtttcagaagtctcagaagaaattaaaacataaacaagaacataagcctcctgatgacactgagatgtctgcttatccttatgggctgataccaaagtctgtgaagctcaccttttctcttgaaagaaaaaaagaatgagccttcccttgagcaaatcttgctcagagcccaaacttcaagcccacaaatggacagtcccctgcagcatgggctcttgttcttcaaggggtcaatgaggagacctccctttcccaccccaggtgtctgtagtcagggctgcctgatgttccctgcatcctgggactaggcactcaggtgtgtaataccccagaggacaggcctgggagtaattccaaacacagagctggcctgattcactttcaggttcctttattttaagttaaaatgtcaggatagaaagaagttgggtatggggttattcatgaaactgaggccagaagatgtctttgtgggctgtgagagggtgacatggtggctccaccattgctaggggaatgttgagtgagctcctaagaagtttggggaaatcggtcttgtgagtgtggcttcccttcagctcattccactcagaaacatgaggacacccatgggtggatttttctgaactcacaaacactgacttgtgtcctcttttttcttatcccattggagatattcagtaatctactctgtgagatggggtctacaggagatcatggagaagaaactcttcaacctgtgcaagtgaaacttccttgtgtgaagctcttgatgtgtccagattccaaggtcaccttctcctgcacaggggtcagcagaaacattgaatattaccatggaaactggcccaatggctccagagaaatcctgaatttgtgactgagaactgcagtaatcaaccttcagggatctcagcctgattctcctttttcaacttgactttccttgactgtgcagcccgagggtcaggatgactatcactgtcagagctgaatacaacccgatgctgccatgagctcccattccatggggaagtgacataaacatctgtcctccatttcccccatcaaatccgtcactgccctgtccctgcctgtgaccgacacctgctcaggttgtggattctgctgtcacttgtgattccagcaagtctgatgcttttaacttggtgcatcattattagggaagccactccctctaaatcctcagaagatgcccccaaggagttcccggatcccaaggtgcaggatcaacctcccagtaaggaaggctctctgggccccatcactgttcatctgttctactttaatcctaagaaccttgagccttcattatttcccctttctgcttatttggctggaacgttgctggaatgcatctcagttctttggggactagagggataaaaagcacagcccatagaaagctttcacctggttaagtagcatttcctaagagccacgagggcatctgctcactgctcactgctcatccttgcatcataatgggttcctggaccctgggctctcctggctcattgagtttaccaatccctccacactccactcattgctagggctggctagagggaaggatagtaattgtccaatagggagatagttttaggggggattacagaaactactccccataatctttgttgataacatcttcatcttgatgtttgctccccaggatctgattgtgacagtggaagtctgacacttgaagaaatgtaggtttacccttctgaaaggcctggccctggcttggcctagggctggaaggaagaggtgctgagctttgggcaaccaaggcacagctgtcaaggggctgagctctctgcaatgtgggcctcctgcagagacatccctagggaggctgagacctgacgatgatgcagaaaagcaaattgaagtgagcaggggatggtctgtgggggaatcagatgacaggtggggggccagatgtgatacagatggtgcaacatgaagaaaagtgtcttttgtgattgttctgaggagaagggctcagtgctagagcagtgataatgaggcaggagctgggtcctgaagccacaggggaaccaggtcttgggtctttttctgagggtccctagggaagatcacatgacaaccaagtcccatgttatatgtccagtgctcggtatcccagatgctgtccctcccagagcctctgggtgtcctcgtcccactcttccctgtgatctgttttcagctccaggagcaggttcatactctgtgccaagagtggggcttgcatggctgagtggagaacagatttgcaagaagatcccaccttgcagtctggctctgtgtcctgggtgtgggtggtaactgaggagatgtaggcatttgggctccactagagaccacagggagcagagctcacaggggctccccacaacccgggctcctcccttcatcctcctcccattgccttcctcactggggttcgggccaggggagaacccagggctgcttcaagggccctgctctgcaaccatggtctttatccaagtcattgtctccaaactctgtaagggctttctctgaaactgtaggagcattttttttccatatgcccaaggcaggcttacagggtgctgaccccaccccttaaaagtgctaatagtctctcaatgctcaagacaggagggagaattaggaatcaggagcctacccagagcttccctctttcctcactttcaaaattgcactgtgtctagacatagaatttatgcctgggttgggaaatatttatttacttattaatgtattcattcattaatctcactttctgcaatctgtgtaagtgaggggcagaagggaagaggggcacagagggagaggttgaacccaagggcaggtcctggcagtctgggcacaggctctgatcagccagggggaaggaagagggagcagctcctggtgccctggagggaggggatgccctgtccctgctgggcctcccacttcgttgtacccagggaatgcttttcagagaggcagagctcttagcagagtcccgtaaaccatacagtgagttgggcaggtgagtccaggggtaggggctgtgtggagacctgagaccaggtgtggcctggcatggacactgcccagctccattcttttagggaggacaaagtggacagaggaagagacaggagacatgggtgtgtctgagctttgggcagcaggggatgctgtggcctagccctgagggctgtgctgtggatcccagctgggagccaccccctggtcctggcctggagccctctgtcccctgctcactgggactagcagctgtgtcctcacaggtccctgagtacccacagaatagccacacccaggtccacactctcccggggttagctttccaggcagaggtcaagagtcagaacccaaggtggggtttagacagcccaggagaggaggctggtttgcaagtccctcctaacccccttcgccctgaactgctggaaggataggagagacttgaagaatccaggcccacctgagggtcctcaggacacagctgtgtggcgggtccccaccatggcctgggctcgtggcctctttccttttctccttcactgctcagctggctggggccaggcgtcagggctgaggatgaagggaccaggattgctgtgtgtgtccctgtccactaacctgtgtctcttactctttgtctgtcatgatattcagggtcctgggcctgttctgtgctgactcagccaactgcagtgtccaggtctgtgggacagatgaccccagcacctgcactgggagcagcaccaatgatgggagtatgcacgtgttttggtaccagcagtctccaggctgtggtgcctcagaaaccctcctagtcaacaacaccctgcccagcaggagcgggccatgctctgattgcccatctggggtagtgtcagtggggctcagtgagcagctgagctttcaccccaatatcctcaaccaggcgagcatggcagggctagtttgagctggtttatcctcccatccacctatgcctgattttggcagggcccagtcaggaactgaatttcagcccccatccccagcaatgagttgaatgaaatggtacaaggcagagcacaccagccctcagtattccctccctgaacccagactctggtggttatgggggccagggaggaccagagctttgtctcccacctggcaatgagaatactggttggggatggaagtcagtgtcgttggcacacctgctgtccccctccctgccctggtgtcagtgagtcctctttttctcatgaaagtgtcagcagcactggagtactgagagccagcgttctgcctttgctttggcagtgggaagctgaacctacaaacctgtgtccttcaacaactcaacaagaagatcacctgataaaagggagattagtggtgcctagaggctcaaaatacagtatttaaggtgtctagcattcagttcatgaaatcattgtcacatcaagaattaggacattcagaacccaaatgaaagaagacagtgacacgcatggacactgaagcaaactcagatgctaaaatcatatgacggatttttaaagcaacaaccacaaaatcccttcaatgaataattaaaaacactcttgaaacaaatggaaaagaagaaaatctcagaaaagagaagttataaaatcaaaccaactggaaattaaagaacctaataaactagagcacatttaaaaagaaagttaaggcaggactcaagaactggttacatttgagattcagtcactgggtgaggtgttccacacgacataaaaatacagtaaaaataagtaggtaaacacatgaaaatcaatgattctggtttgacttgggaaacattaaagtggaaaatataaagaataaaatagcatttatttattgaaagaaagaactacctttagctttttatcgtttccccattaatactctcttgaagatgttcccaggggacactgtgagtcttctcagaggtgagaaaagcctgaaataaactcccacgaatctcatttaatgggtcctggggcccatgctcactggtctgagttagaggtgatagcaggtgcttcctctcaagtggtgaaattagacctcacagcagcccagcccccctgacagtagagctgctctctcagctgaaaacaacagaagcagatggtgttggtgatggttttggtaaagtgcttattaatgtgtgaaccaaatatatgcccttcatctagggagctgcataggagataaaagaaccatctcagggtccagcagcatcttagagctctgcagatttttggaaagtttacatcatgccctggatgcttctcctccacttccccatcctgttcagtctttgcccaggttcatggagatttcaaagaccagcccatggagagagccctctgttcttccccattcctgtcgtgtctgtttcggtttcagtatccagttcttagggtgtggtgactgaggagccctcactgactctttcctgaggagggacagtcactctcacctgtggctccagcaccagagtggtcaccaacaatttctatccacactggatgcaacagaagtctggccaactttttgagacattgatttatgatgcaagcaacaaacattcctgaatgaccacctgattctcagaccttcctgggagcaaagctgccctgagcctctgggggacccaatccataggctagactgagtactactcaagctacacgacagtgggggttactgcagtgaaagatccagatggggagccaagacgtaaccctgcctctgacagcctggggagaaaatgatcacgtgatatcaggatcacatgaccagaaacctgagctctcaaggcggtctaaatgttgcctatccttaaagaaaaaggtaaacagaagggtctacatcaatatttattcctgtttgtgtccaaaagttgaggaaatccatcaatgaggaggaactgttccagaaaagcggattcctaatattttgtaatccaaaaggaatagtattgcctacatcagatccaaggaataaatttaaatatatttttttgcaggaggaataatcttcaacgatgtactttgccagctaagaacgaaaggaagaaacgttctttggtatattaataacattttttattaggttgtaattaaggtgtattgcacaatttaaaacatattaaaatgattttttgtaagaaattcttttttctatatgttatgtgttgtattggactctaaagaatatatgttaaagccctacaccccagtattcaagcacataaaatcatttgaaaatcggatcattgaagatataatagttaagatgaggtcattctggagtagggaggtctctttatcagtgttcctgggtccttgtaggaagtcaaccatgagaagacagagaggcacagggagaaagtcatgttaatatggaggcatggagtgaagttactcagctacaatacaaggaacaccaaagattactagcaaagaggaagagctgccaggaagaatcccaggaaggttttctctacaggtgtcagagggaacatggccccgccctatggatttggatttctagcttccagaactgtgaaacaataaatgcctttcattttaaatcacatgtgtagggttatttttatggcagctcaaggaaattattacaccaaacagtcattgtaactatttctgagtttgcatgcattctctcatcttgtttctcagttttttcaacaaatgtgaccatgtctgtcttcgtatttcttccttgtataactggcattgaaggttgacgtaagttattctcgctgtcacaaaaattatataaacatgtaaataaggcttaattttattttgttcgtaggtacaaatgcaaaactaattccaattgttttgtaagaaatttttgtaaatatttttctcatgtaaattagaagggtctcttgagttactgaaacacttctggccatttctgtgatcttgtggtgtcaggatgagatggctaccatgttcaatgaaagcttcaaatacattattattttttctaggtttttaaaatttaatacagtctaattaaatagtaacagcagtaactaaatgcactgaaaaacagacaggtgcctgcctatatctggaataaaattacatcaaactagtctccatggtaaaaaaaaaaaaaaaaaaagacaactgctgatatccatggttagacaagtcaaggacaacttggaatttctaaagccatttttctaaaaatcaacagcaacagggacacaactacttcaaggggtaaaatatctatatctacattgttttttattaacgaagattgagttgcacctaaacagcatggcattcttatctttagccttaaaggaaaagtgaaagtattttccatttgcaccagtttgaaatatttctgaaataaggattacttcaaatgaattattacattacttatacacataagagggtctcacatatagtgaaaaggcaaacccaggattttaacgtcaaccttttaaagttgatttgattgcataaaatgagagagaaattctcacacgcataatctgtttaacaaaactcctcggtgaatcaggatgcaaaatataaaatgttctaagggagactctgatgagcaggcatataaaattgaagtgaaacccatgtcagcttcgttcctcccacttctttggtgcttctatgaggagctctttctctactgcaagagcctggacttttgacctaatggagaagaacctcaggaaggcaaggcattctgataaaatgccccttgagaccttttattttttaatttaaagggatcaactggtcttgttcagccttaggaaagaaagcatcactcagataaaagtatttggggaaactttaaatacctggctacctcttgatatatttaaattagattgacttcagctgttcttagaaagcattctgcatagttatccagagcagccactgaagttctggttctccttacatggctgcattcagaggtactccacatgaggcatgtttagaaaaagaaggacccttatacttgggagtttttgttcttccacgtaacctgttagtactgttggtaaaggcagtccccagatggcaccagtgcattttgtcaatggtgagtctagacagtgttgcaggggtgttgctgatgagtagaacagtgagcagataaaggtgagcagtgttgatctaaaggctttggggtccatctgcttatccttgcacacctgaacaaagtcatcagatgtgccacaccatcaaactgttgaagcttggacttgatacatgatagagttccatgccaattgcccatcttcatattcaacttgcagattagttggtccagctgatattttaacagatactgttagtagatcatctgaatgtgaactatctctaaccaagaaatttccttctggtgtctcttttaacttttctttggcttcattaacaatcatccttccccagtgccatcctgtttgagctcctacggggacttcaccagatgcaccacctccagggaaggttcctgtgctgaccctgctcctcactggctctgcatctattccctgccattcccagagggctggagacaccacagggtcatggaagtaaggtcactgaggcaaagacagatggccacccaaactgggtgagaaaggagctttcatttttcctggaagtcagtgggaacccccccaatcaaccctatgggtttctgaaatggtggaagatggggaaggaatgaaaagctgcctgtttttctcaacaggtccaggttgagggatgacaaagttccttgcagatgcatcacccacagatcaccagcaggaggatcctgaggctgcggtcagtgccctggcacaggacacatgggccatgtcccatgcagcaccggtggctccgagtgagagggcttatgctgcaggggaagccaaagattcctgagccacagcggtaagacatgagatgacttaaatatctgtccctcaagtatattattcttaatatttaatgcacaaaatagtgaaagaagagattagcttgcagtgcaaattgaacagattcagtatagcttgaggcatgagaaacaacagctctattaccatttaccaaaaatacaccctgaatggacagggggtgcccgtgagctggagatagggtgccccaattgaggaaatataaatactggttatcagttaaatttgaattcatgtaaacaaccatttaatagatttttatttttagtataattatgtcctatgcaaagttacttatctttaattctaatgtaactggatgtcttgcatcttgtgagataccattcccagcattcccagctgggctctgacatctgagtctatgctatttacctcaaaaacagagttcctgtaacaaagttatccccaagtaagtacttcggttagaaataaatatgtctgggctgggcacagtggctcatgcctgtaatcccagcactttggtaggccaaggcaggcagattacttgaggtcaggagttcaaaaccagcctggccaacatgatgaaaccctgtctctaccaaaaatacaaaaggtagccgggcgtgggggcacctctgcagtcccagctactggagaggctggggtgggagattcacttgaaccgggaggtggagcttgcagtgagccaagattgcaccactgcacttcagcctgggtgacagggcaagtctctgtctcaataaataaataaataaataaatacataaataatttataaataagtgtgtcatcccatccacctcaaggctgtaaaacctagcatgccttatccctcctcactttcttttttttttttttaattatactttaagttctagggtacatatgcacaacatgcaggtttgttacatatgtatacatgtgccatgttggtgtgctgcacccattaactcatcatttatattaggtgtatctcctaatgctatccctcccccctacccccatcccatgacaggccccagtgtgtgatgttccccttcctgtttccaagtgttctcattgttcaattcccacctatgagtgagaatatgcggtgtttggttttttgtccttgcgatagtttgctcagaatgatggtttccagcttcatccatgtccctgcaaaggacatgaactcatccttttttatggctgcatagtattccgtggtatatatgtgccacattttcttaatccagtctatcattgatggacatttgggttggttccaagtctttgctattgtgaatagtgccgcaataaacacaggtgtgcatgtgtctttatagcagcatgatttataatcctttgggtatatatccaataatgggatggctgggtcaaatggtatttctagttctagatccctgaggaatagccacattgtcttccacaatgcttgaactagtctacagtcccaccaacagtgtaaaactgttcccgtttctccacatcctctccagcacctgttgtttcctgactttttaatgattgccattctaactggtgtgagatggtatctcattgtggttttgatttgcatttctctgacagccagtgatgatgagcattttttcacgtgtctgttggctgcacaaatgtcttcttttgagaagtgtctgttcatatccttcacccactttttgatggggttgtttttttcttgtaaatttgtttgagttctttgtagcttctggatattagccctttgtcagatgagtagattgcaaaaattttctcccattctgtaagttaactgttgtacttagttgtactgggtttgatcgtagtttcttttgctgtgcagaagctctttagtttaattagatcccatttgtcaattttggcttttgttgccattgcttttggtgttttagacatgaagtccttgcccatacctatgtcctgaatggtattgcctaggttttcttctagagtttttatggttttaggtctaacatttaagtctttaatccatcttgaattgatttttgtataaggtgtaaggaagggatccagtttcagctttgtacatatggctagccagttttcccagcaccatttattaaatagggaatcctttccccatttcttgtttttgtcaggtttatcaaagatcagatggttgtagatgtgcggtggtatttctgagggctctgttctgttccattggtctatatctctgttttggtattagtactatgctgttttggttactgtagccttgtagtgtagtttgaagtcaggtagcatgatgcctccagctttgttcttttggcttaggattgtcttggcaatgcgggctcttttttggttccatctgaactttaaagtagttttttccaattctgtgaagaaagccattggtagcttgattgggatggcattgaatctataaattaccttggggagtatggccattttcacgatattggttcttcctatccatgagcatggaatgttcttccatttgtttgtgtcctcttttattttgttgagcagtggcttgtagttctccttgaagaggtccttcacatcccttgtaagttggattcctaggtattttattctctttgaagcaattgtgaatgggagttcactcatgatttggctctctgtttgtctgttattggtgtatgagaatgcttgtgatttttgcacattgattttgtatcctgagactttgctgaagttgcttatcaccttgagattttaggctgagaggatggggttttttattttattttattttattttattttattattattatactttaagttttagggtacatgtgcacaatgtgcaggttagttacatatgtatacatgtgacatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatattttactgagaatgatgatttccaatttcatccgtgtccctacaaaggacgtgaactcatcattttttatggctgcatagtattccatggtgtatatgtgccacgttttcttaatgcagtctatcattgttggacatttgggttggtttcaagtctttgatattgtgaatagtgccacaataaacataggtgtgcatgtgtctttatagaagcatgatttatagtcctttgggtatatacccagtaatgggatggctgggtcaaatggtatttctagttctagatccctgaggaatcaccacactgacttccacaatggttgaactagtttacagtcgagacgatggggttttctagatatacaatcatgtcatctgcaaagagggacaatttgacttcctcttttcctaattgaatactctttatttctttctcctgcctgattgccctggccagaacttcgaacactttgttgagtaggagtggtgagagagggcatccctgtcttgtgccagttttgaaagggaatgcttccagtttttgcccattcagtatgatattggctgtgggtttgtcataaatagctcttattattttgagatacatcccatcaatacctaatttattgagagtttttagcatgaagggctgttgaattttgtcaaaggccttttctgcgtctattgagataaccatgtggtttttgtttttagttctgtttatatgctggattatgtttattgatttgcgtatgttgaaccagtcttgcatcccagagatgaagcccacttgatcatggtggataagtttttgatgccctcctcactttcaaacagtacaacagttaacatttcctaaccattggagatattaaagcacagatcttttatatgagattagttaaaatttttatctttaatgcacaagagtttgggaacattaggaatttgtacatatgctaaattatatgtaaatgaaatgatacgatgtttggaatatgttttaaaattagttgagtgtgtggagtgaggggtaaagagggatgtaagatgaataagacaattttatgttgatgatgatttagttgggatgctgggtccaggacatgcaatgggcttttctccatagatgtctgcaacttcaaaaacatccacagtgacaaatgtgtaaaaaaaattctgtgaactcttctgtggtggtgtgtgtattgaggtggataagggaccccctattaagggcctgacttctccccctgaagcacggaaataaaggagaatcttgagtttcttcaagggaaatttcaggtacctcactgtccctgagaagaaaacctgactagcaaaaaggttaaaggagcttaaaacaaccaaggaagttagaggcatgggatgtctgggtccctatagaaactaaaaacaacaacttaacatatgcccctgagttgtttttcaaacactcagaccacctccaaaagtctcggctgtcagtaggcctcagataatgggaaactgaggactgaggtctgactgcccttctttgttctaagtctcttactgaggggccctgaggaaatcacgcccatgagccagagctaacatttctttctgttgaccccaattttttggacaaagctttacgaccttaaccagttgcaaatcaggaaatttctaaatctacttacctttgatctgaaagcccctgcttcaaaatactctactgttttaggccaaatcagtgtataacctctatatattgatttacagttttgactatgacttctgttttctgaagatttcccctgcttttaaacacctttgctttcaggccatcagggagtttgggtcttaagcatgagctgcccgattctccttgcttgatgcctgtgataaatgtctcattctcttgctgcaatcctgatgtcagtgcttagatttgtatacctggtcaatggattcaagtttggtccattaatagtgtgtcttgcttttaacagacactcagagttgccagatggtgtgcctccaccctgacctccagttgaagctcatctcctccccgcacacagaggaggacttggtgagaaggccacagaatggaaaggagctcagggtttcccaggaaagagaagtgagtgatactggaggccccagagcaagaggaagggctgtgaggtaggcaggggccataaagtgaagggcatgctggtggggctgcaaggtccagggtttatgtaaacagcaatgaagaaccacaaaaggagtttaagcccaggagtaagatgaacaggctgaatgagaaggatgtctccagctgcctcgaggagaaaggcctgagggcaccaggggatcctggtcatagattattcactaagagaacctgtgagtctagaagtttgaagactatttgcacagttaaagcagatttgcatctgggatacagtgaagaagtgataatttctgcattaatctgtccagtcattcaacgtttctgcagaaacattaaaaggtcacacttatctttcttagtaagccatgaaaaaaatgtaagtagggaaaattaggtttagaatataaacaaattgtattctatctaaaacaaaattctattgagaagtagatgaaacagataagcagaaaaataaaaaggtaggaagacaaaactcacttcataaaataagaaatgtgttacaccatgaactggtaaatgttatgcctacccaactattattttttcacaaataaaatctagtgagtatcaacatgctaaaatcatggtgtgacttaggaaatgttttctgggccaggtgcggtggctcacgcctgtaatcccagcactttgggaggctgagatgcgcggatcacgaggtcaggagatcgagaccatcctggctaacatgatgaaaccccgtctctactaaaaatacaaaaaaaaaaaaaaaaaaattagccaggcgtggtggcaggtgcctgtagtcccagctactcaggaggctgaggcaggagaatggcatgaacctgggaggcggagcttgcagtgagctgagatcgcaccattgcactctagcttgggcgactgagtgagactccgtctcaaaaaaaaaaaaaaaggaaatgttttctgaattgctggatgttaaatctatcactgaggtgattcctgaaacagtccccttctatgtcattgccttgaacaaccccttcatgccactcaagtcagcacaactgtttcagcatctgtggtggtgccatagtgacgtatgcaggtcacttagctttttctagaatgtactcttggggcactggcaccttaaaaggttataaaatttttaaacagttataaacgaacatatttgctcctctcatagatcaagactacttataggagtgagatactggctaggcatctagtagaccacgtcatcatcacaggatataggattcaggacacagatgtgtatacagaggaatagtgtcctggtgagctgcagagatcagctgggctctctggtctctgagccatggggaggtgagtgtcctgctatcagcaggctgcactgtgggacttgcctgtggtgtctgcacagctgctctttaagaaccattcattccaaggagcctaggtctaggggctgggccttgtgctcattgatggggactcggcagctgtcttctctggtctggcagagtctgctgaacagggacctgtgtatggtctcagcaggtgatatctcctagggcccttccaaggagggaaagcaaatcatcttcctcagtctgcagtgtgagctgggctccagccccagggctcaggaagggactgggcagtccctgcatagaaacacatttgcatgagcagcccctcctctgctgggggttgggaagaaaaggaggcctggggcagctcaggctcactgtggtggtcaggggctgtgtccaccatggccagaacttctctcctcctcctgatcctctttcactgctggcctgaacttctcttctccttatgctcctctctcactgcacaggtaaggacaggcctcggagatcaggactcagttttcagcctgcatcagtccctcaggctcaggaacccatgacaaatttcatcctcatcttaaccctgtctcttatttgtgtctgtgtttacaaattccctctcccagcttgtgctgactcagctgtgtcctcccccctacttcctgtatctctgggagcatcttccagactcacctgcaccctgagcagtggctgcagtgttgacatttatctcatatcccgctgtcagcaaaagccagtgagcccttcccagtatctcctgatctacctctcaaaagtcaagtaaaactagggctctggagtctccagctgcttctctaaatccaaagatgccttggccagtgcaggcaatttgctcatctctggggtccagccagaggacaagactatctgttctatctattactgtcagacctgggatattgatacttcagttacacaggcagatgagaaagtgagacgaaactcagcctactaagaatggaactatggctctttttccaattgtcaaataattttcacatacacaaactattttggaagtagctactgattcacaatggttctctcaatgtcccattcaatgtttctgagtcctcaggcaaactaacaacaaaacaatgataaaacatatgacaaaacatatgataacactgactctttccctgctgaaccacatgtaataaaaccagaggagctggtttaataaaacctgaggagctgacttttcttttaaaagaaaagatgacagtcttttggagtctttttcttggtcaaaatttcctagaccatcccagcaggtggacagtcccctacagaagacacgatcctgggaggaatcccaggtacagagctggcctgcttcacttgtgggtacctgccccttcaattgtgaaatcagggaggggagagtaagcatagggggtaggtgaggatcaggaaaggggcaaggccactacatttcattaaccacctttggactccagtgcaagatagaggctgatgatcccatcacacaggtgactacaacctccttgtcatcaacagctcctgcccatggggaagcgaaatgaaaatctatccccatccctctcttcttacatatccctgtcctgcccctgccggtgaccaacaccagctcaggttgaattttgttttgtcacttgtgctattaaagaaaataactccttctcttactggtctcctagttcagacagaatcagtttgtttccagaaatagaaaacgctgctcacacacatgagtgtaaagtaaggatgacaaaaagaaaaaatccaggctatgtggcccagagacccaggtgccctctgattggcctcatagatgtcccctcctcctggcccaggtttgcttgtcattccttaagctctggaaccttgaactacatgggttctgtcttcatagatacagaagaaaaccctccccaagaaggagatggttcccagaaccagcacatgctcacttttctctgtttaattccacacatctgacttatttttgcttccatgagcctttgttgaagatatctctgaatacctctcatttctgttaggtctacagcctatggacctatctccattatatttgtgcttatttttctaacctttatgactgattatcatttaagcttaatatgagatatgcatctatattaaagatatataaatatgtcatcaatggtcaatattattaaagttataagtagtaatgcaaaattgtagctattatatcatttcacttgttcactaacattaatatgtgaagtgagaagatcactttattaatcacgcactcctggtcatgtgtgcggatgagtaagctcaggggggatgctgccatggtccatgggaagcctcaagaacagcagacctggcacatcaggcacaacatgggacacagggagtgagccatgtcagcagaaagcagaatagactgaggcatcagaaacaacccattgccaaactctccactgccttcctgcatgggtcagaccagagctgctcaaacataacgtgcacacagatcatctgggctcctggaaaatgtggactcaggggtctaggatgaggactgagattctacacttctaaagatcccttctcctacaaatccacatatgtgtttctgtatcacaaaattagtaagaatgggggaaaataagaaggaaagccatttgtagacaggaagcaaagaaacatctttcgcggagagaactacagaattttcatgaagaaagacttccagttgaggcaggcagacaaccagagaggacagccgagaagactgaggaggctcctctttcttcacaaaacaaacaaatgaaagcaaaaagacaccaagcctcccccttacctgccctgccctctggctcctgtccaatctccccaccagcttctccttcagcctcttctaaattgtggaccctcctcaccttcccttcaggagatgccctgagtccactgcttctctttcccaaccccactagcaccttccgctacttcctgggtttctcctcagctaccagagaatgcagtgaaccatccaatccaaataaattatcctgttaaacattgaccagtaggtctcctttgtgcggatctgaggaatcaagcagggagaaagaacctgactttgtgagctgcctgagaaatgagttcatggctgaagtgtcccttttctcagctaacatgttttatttcatgcacagggtgtatacagagacaatcttcccctgaggactccataaaagatggggagaattgtgtgtccagttcccattgaggagacacacacagaaaactaaaggctgaggtgaggtaggaggctgccctgaggacgggccttgccctgcccttggtcagggagtgagcagtgttcaagaccctggtggggacaggaggctctgtcaggaccccggcatctggtcagagacacggtggacctggacttgagcagcaggggatgctgtggccctgctgctgagccctctgtggggctgtcagctgggaaaccagaaccctgtgtggtctgtgctcagagatcactgggccaagtagctggatcctctgtgggctcctggggagcctcaggccaggctggatcctctgtgggctcctggggagcctcaggccaggcccaagttaggcccacccctcccagaaatgacacagccattgccgctgcatacagccccagggaggggtacggttgggcagaagagagacaagtttgcatgaagggcccctctctctcttctgggactaccggatggataagagggacctgcatcatgtcagcctcagcagagctctggggtgtttgcaccatggcctggaccccactcttcctcctcctcaccctcctcctccaccactgcagaggtcaggatggcccttagcaccctgatcctgcagctcactcacactgcctcacaaactcataccaggaatgtccttccctcttatccttacttcaggccataatgggcgtctatgtcttcagggtccctctcccagcctgtgctgactcagtcacccactgcatctgcctccctgtgggagcctcggtcaagcttacctccactctgagcagcaaatacagcacctacattattgagtggcatcagcagtagccagggaaggtcccttggtacttgatgtatgttaccagtgatggaagccacaaaaatgggatccccagttacagttctcaggatccagctatggggctgatcggtaggtcaccatctccaacatccagtttgaggatgaagctgattgtatctgtggtgcagatcatagcattggtgtgacatatgggtaaggcaaagtgaccccagtgaatgaggaagcaggacaaaaactgttttctctgctccactatgaaggctgccacgtggccctgagaaacagtgcctgttttccttactactcaagaaagatagatagatagataggcagatagctagctagatagatagctagctagacagataggcagatagctagctagctagctagctagacagatagataggcagatagctagctagatgctagatagacagatacctagatagctagatagattttttgctttgggttccttaggaacaagtttgctaggccaagctcctaaggagtacacaagtctgtattaatgtggccaatattaaggcagatcctgtcaccccctgcatgtcgatacattgtcaccacatgggaactgcaaggacatttttccctgtggatttaaacactggaactctgctgcatggcacacccctgccacatcaagtttcattttaacaatcacccataagatataacttcttaagaaaattttgaattctaacaaaatgctagaaatcacactgttgatacacagcgatggaaataatgaaaatttatagacagtgaaataaaaagatttaaaatttttggtggtttataaaggttttctcagttgttcagtgcgtgggttttgggattaggagaaaatgaggagaaactgcctccaccacattgaacatgacaactgatttgcaataatctaacaaagaagaaggatataaataatcattaatgtcatcctgacagccctgatcctaaatgtcagaattttatttcttaacttttttctccaaaaaaaaaatgtagcttcagaaaaacttctggaatggtggtatgaggccatcagaaaacctgattcaccatacaagcaatgagaacagcagtaaaaatgatataaatctacttttcagaactctgtacattaccaaaagcttacaaaattctgggaatcataaaaaatagtaataacagccagacatggtggctcatgcctataatcccaacacattgggagctgaagcagagcgattgctttatcactcctgggattttgtgatcagactgggcaacagagtgaggcctcttctctaaaaaacattttaaaaaagtagctatatgtggtggtgtgtgggtgtagttgcagctactggggaggctgaaggtggaggatcacttgagtctgggaggtggaggctgcagtgggctgtgattgtgccactctacttcagcctgagtcataaagcaataccctgtctgaatcaatcaatcaatcaattaaaataatgtggaatctctgtaagaatctgaagctttgtggtgattttatttcttttgctctctcccaagttccacagtagccttaaaaaccaacagcctcaaatctcctggatctagggaaactagaaaaatagcattcactgaagcaaccaaataccagatctggaattttctcaaaagccccattcccgtgcgactgtcattatttgagctttccaaagctcagaaaagcttcacgctctgtacttttctaaatgtgaattgtctcagagctcgcttggtttaaacagcttcatcctcaatacatttatcaaaacaatcagtgagatctgttaaggtcctgagtcagtgatacaagatggggtcaataaaaggctgaccaaaaaccttgagagaaaaaaactgggtgtcagaatctgtagaagattttgatgagctctgccatattcctggaaagacagaagatcactctcatgctcagagttatgtgcatggccaggtaaaaattaggaaagtccttaattttcgacactggctgaaatcaacaaggaaggctaaaatagagttgtaaagtggcggggttttgcagtcatgacccaacccctgcacagagcattcggcaaatgctgaggaatgtgttgttcgaggcgtttaagaacatgtctgtccaataataagctaatgactgatataattgagcagagactgcagtggctgcacaagcaaagaaaacagacttagagaattattccagtaccgtgaaacaataaatcatcatcaacaataacaactacaacaaaaccagaagcaattatgacaaatattttaaggaaagaatctgatttccagaatcgtcacattgtgtgactgagaagctccatttggcaaagtgaaattttgaggcagggacacagcaaagtactgtccatacacagggttaaaaaggaaagcaaagcaaaacataaaaacaaacaaacaacattaaaaataagttgacaaaatgatgtccagagatgcatttggtggttactacataaaaacttcaaattagcttttgtaaatgtggtcaaataaataaataaaacaacgttaacaattgttaaggaaagtacggaaagaatgcctcattacagagagaacattggcggggtgcagtgcctcacacctgcaatcacagaactttgtgaggccaaggcagacagatctcttgagcccaggagtttgaggctagcctgggtaacatggccaaaccatgtctctacaggaaatacaaaaaagctagctgggcatggtggtgcatgccagtagtaccagctactcaggaggctgaggtgggaggatttctggagcttgggaggcagaagttgcaagagcaaagatcatgtcaatgcactccatcctgggggacagagcaagagtctgtctctaataataatataataataataacaatagagaatactaataaagaggtatagaagaaaggatcattgaattaaagacagataaattgataattattctgttccaagaatagaaaaaaatgacaaacagtctgcacaacctgagagacgatgtgacaccaatcaaatgttccaatacacacatagtaagtttcagtccttccaccatgtgagctcgcagtgagaagatggcagtctatgaaccagtaagcacatccttaccaaacaccgaagtatctgcttgtactttgattttggaccttccagcttccagaactaaactctgacctattttttttggacatttgcatagtgtgggcctcagaaggaagctggctggaatttgacatcacagccactagtagtctgtgggttgtaaccccacagcataacatggggcttcagctgagcgtagtgacagaggatggagtccacatccaccctctagctgcagacctggtgggcagagacagcacttaggctatgcagcccttcatggtggctttcttcaaagtcattgtggtccatgtgtgcatcaccaggtcagcctctggctggcgttgacagcagagttgtactcactttacccagtcccactacgtggctcaagtctccagtacttcagattacatcagcagcaaattaaaaacagcctgcaggaagcatgagctatatgtgagcttccaagacctggatggcaggactggttcatcgcacccaagggctatgctgctaattactgtgatgtagaatgctccttcccaatcaatggacatgtgaatgcaatcaaccatgtgatcattcagaccttggttcaccttatagatcctgaatatgtcccaaagctgtgctgtgtgccaactaaactcaatgccattttggttctttacttcaatgacaattccaaaatcaccttgaaaaaaatacagaaatatggttgtaagagcttgtggatattgctaacttgaaaccagatgctggggacacacattctgccttggattccttggtcatagctgccttaaaaaacatacagaagcacagtggaggtggagggataagactttgaaaccatctcatgctgatgccttactgcccgagaaaaattttaacggaccttgctaataatttgctcacttggtaagtaacatgagtagttgttggtctgtactaagctgagtttggttgtctggtaactacagaaacttaaacttaaaaggtaccccccaagcccaccaaatttaattttagctatagttcaagctatttgggttattagtgagtaaatagggaaaataatctcaatggagttaaatgtattcttgggtaaagtatcagctggtttattagtgtctatcaaaggtacattttacagatagtgaaagttggggaagtaggaataactcctctattcacagatttcattcccaggaaggcaaattttatactggatccacagtccaggccatagcccgggctccttggggatgcctctgtctcagtctttgctgttatgagtttgtgctggagttctgttggtgtgaaaatatacttatttcagtcaaaacaaaccatatcattttcacatctcagtcctccatttgctgtattctttgctagtacccaaagtagactgattaaactttgaagtgaggcttagaggagtggaaagcatttgtgacaggctccatggtaactgtgtaacatgtgaaagcaatgctgcacctcttctttattggaatgactttttgaccagcacattaacttgaggactgccgactctaatatctatttcaggaaagcggtgctttgtctttttactacagagcataccacgtgattgggttagaaccaacaaaggaaataaaatgggaaagggtgccccacctttaagaatggctttagggggatgagtgtgccatttatgaatggaaattatgattttctcttgtagaaaggaaggctcagattaaattttagaatatttttaaaatatctttttcaccaacatgtactgggaaagcaatttcatactaaactgattaaatgatagttttataatctataactgcagtaatggttttttgtaaatatgaagtataatttattttatatctgttttgctgtaacattgaaggaaataccagacattttctttaagtgtttatttagaaagtaccaggagatggttccaagatggccaaataggaacagctccagtctacagctcccagcgtgagtgacgcagaagatgggtgatttctgcatttccaactgaggtaccgggttcatctcactggggcttgttggacagtgggtgcaggacagtgggtgcagtgcactgagtgtgagccgaagcaggatgaggcatcgcctcacctgggaagtgcaaggggtcagggaattccctttcctagccaagggaagtggtgacagatggcacctggaaaatcgggtcactctcaccctaatactgcgcttttccaatggtcttagcaaacggcacaccaggagtttatatcccgcacctggctcagagggtcccacgcctacggagcctcactcattgctagcacagcagtctgagatcaaactacaaggtggcagtgaggctgggggaggggcgcccaccattgctgaggcttgagtaggtaaacagagtggccaggaagctcgaactgggtggagcccaccacagctcgagaaggcctgcctgcctctgtagactccacctctgggggcagggcatagccaaacaaaaggcagcagaaacctctgcagacttaaatgtccctgtctgacagctttgaggagagtagtgattctcccagcatgtagcttgagatctgagaatggacagactgcctcaagtgggtccctgacccatgagtagcctaactgggaggcaccccccagtaggggcagactgacacctcacatggccagatacccctctgagatgaaacttccagaggaatgatcagacagcaacatttgctgttcagcaatattcgctgttctgcagcctccgctgctgatgcccaggcaaacagggtctggagtggacctctggcaaactccaacagacctgcagctgaaggtcctgactgttagaaggaaaactaacaaacagaaaggacatccacaccaaaaacccatctgtatgtcaccatcttcaaagaccaaaggtagataaaaccacaaagatggggaaaaaacagggcagaaaaactgaaaattctaaaaatcagagtgcctctcctcctccaaaggaatgcagctcctcaccagcaatggaactaagctggacagaggatgactttgaggagttgagagaagaaggcttcagacaatcaaacttctccgagctaaaggaggaagtttgaacccatcacaaagaagttaaaaaatcttgaaaaaatattagacaaatggctaactagaataaccaatgtagagaagtccttaaaggatctgaaggagctgaaaaccatggcacgagaactacgtgacgaatgcacaagcttctgtagccgatttgatcagctggagaaagggtatcagtgattgaagatcaaatgaatgaaatgaagagagaagagaagtttagagaaaaaagaataaaaagaaatgaacaaagcctccaagaagtatgggactatgtgaaaagagcaaatctacatctgattggtgtacctgaaagtgatggggagaatggaaccaagttggaaaacactctgcatgatattatccaggagaacttccccaacctagcaaggcaggccaacattcaaattcaggaaatacagagaatgccacaaagatactcctcgagaagagcaactccaagacacataattttcaaattcaccagagttgaaatgaaggaaaaaatgttaagggcagccagagagcaaggtcaggttacccacaaaggggagcccatcagactaacagctgatctctcggcagaaactctgcaagccagaagagagtgggggccaaaattcaatattcttaaagaaaagaattttcaacccagaatttcatatccagccaaactaagcttcataagtgaaggagaaataaaatcctttacagacaaacaaatgctgagagattttgtaaccaccaggcctgccctagaagagctcctgaaggaagcactaaacatggaaaggaacaaccggtaccagccactgcaaaaacatgccaaattgtaaagaccatcgaggctaggaagaaactacatcaactaacgagcaaaataacaagctaacatcatgacaggatcaaattcacacataagaatattaaccttaaatgtaaatgggctaaattctccaattaaaagacacagactggcaaattggataaagagtcaagacccatcagtgtgctatattcaggaaacccatctcacgtgcagagacatacataggctcaaaataaagggatggaggaagatctaccaagcaaatggaaagcaaaaaaaggcaggggttgcaatcctagtctttgataaaacagtctttaaaccaacaaagatcaaaagagacaaggctgttacataatggtaaagggagcaattcaacaagaagagctaactatcctaaatatatatgcacccaatacagaagcacccagattcataaagcaagtcatgagtgacctacaaagagacttagactcccacacaataataatggaaggctttaacaccccactgtcgacattagacagatcaacaagacagaaagttaacaaggatatccaggaattgaactcagctctgcaccaagcagacctaatagacatctacagaactctccaacctaaatcaacagaatatacattatcagcaccacatcacacttattctcaaattgaccacatagttggaagtagagcactcctcagcaaatgtaaaagaacagaaattataacaaactatctctcagaccacagtgcaatcaaactagaactcaggattaagaaactcactcaaaactgctcaactacatggaaactgaacaacctgctcctgaatgactactgggtacataaagaaatgaaggtagaaataaagatgttctttgaaaccaatgagaacaaagacacaacataccaaaatctctgggacacatttaaagcagtgtgtagagggaaatttatagcgctaaatgcccacaagagaaagcaggaaagatctaaaattaatacccttacatcacaattaaaagaactagagaagcaagagcaaacacattcaaaagctagcagaaggcaagaaatgactaagatcagagcagaactgaaggagatagagacataaaaaacccttcgaaaaatcaatgaatccatgagccagttttttgaaatgatcaacaaaattgatagactgctagcaagactaataaagaagacaagagagaagaatcaaatagacacaataaaaaatgataaaggggagatcaccactgatcccacagaaatacagactaccgtcagagaatactataaacacctctatgcaaataaactagaaaatctggaagaaatggataaattcctcgacacatacaccctcccaagactaaaccaggaagaagttgaatctctgaatagaccaataacaggatctgaaattgagacaacaattaatagcttaccaaccaaaaaaagtccaggaccagatggattcacagccgaattctaccagaggtagaaggaggagctggtaccattccttctgaaactattccaatcaatagaaaaagagggaatcctctctaactcattttatgaggccagcatcatccttataccaaagcctggcagagacacaacataaaaagagaattttagaccaatatccctgatgaacatctatgcaaaaatcctcaataaaatactagcaaactgaatccagcagcacatcaaaaagcttatccaccatgatcaagtgggcttcatccctgggatgcaaggctggttcaacatatgcaaatcaataaacgtaatccagcatataaacagaaccaaagacaaaaaccacatgattatctcaatagatacagaaaaggcctttgacaaaattcaacagtccttcatgctaaaaactctcaataaattaggtattgatgagacgtatctcaaaataataagagctatttatgacaaacccacagccaaagtatcatactgaataggcaaaaactggaagcattccctttgaaaactggcacaagacagggatgccctctctcaccactcctgttcaacatagtgttggaagttctggccagggcaatcaggcaggagaaagaaataaagagtattcaattaggaaaagaagaagtcaaattgtccctgtttgcagatgacatgattgtatatttagaaaaccccattatctcagcccaaaatctccttaaggtgataaacaacttcagcaaagtctcaggatacaaaatcaacgtgcaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacaaaataaaagaggatacaaacaaatgggagaacattccatgctcatggataggaagaatcaataccgtgaaaatggccatactccccaaggcaatttatagattcaatgccatcccaatcaagctaccaatgactttcttcacagaattggaaaaaactgctttaaagttcatatggaaccaaaaaagagcctgcattgccaagtcaatcctaagccaaaagaacaaagctagaggcatcatgctacctgacttcaaattatactacaaggctatagtaaccaaaacagcatggtactggtaccaaaacagagatataaaccagtggaacagaacagagccctcagaaataataccatgcatctacaactatctgatctttgacaaacctgacaaaaacaagaaatggggaaaggattccatatttaacaaatggtgctgggaaaactggctagccacatgtagaaagctgaaactggatcccttctttacaccttatacaaaaattaattcaagatgggttaaagacttaaacgttagacctaaaaccataaaaactctagaagaaaacctaggcaataccgttcaggacataggcatgggcaaggacttcatgtctaaaacaccaaaagcaatggcaaccaaagccaaaattgacaaatgggatctaattaaactaaagagcttctgcacagcaaaagaaactaccatcagagagaacaggcaacctacagaatgggagaaaatgtttgcaatctactcatctgacaaagggctaatatccagaatctacaaagaactcaaacaaatttacaagaaaaaaacaaccccatcaacaagtgggcgaaggatatgaacagacacttctcaaaagaagacatttgtgcagccaacagacacgtgaaaaaatgctcatcatcactggccgtcagagaaatgcaaatcaaaaccacaatgagataccatcccacaccagttagaatggcgatcattaaaaagtcaggaaacaacaggtgctggagaggatgtggagaaataggaacactgttacactgttggtgggactgtaaactagttcaagcattgtggaagacagtgtggcaattcctcagggatctagaactagaaataccatttgacccagccatcccattactgggtatacacccaaaggattataaatcatgcttctataaagacacatgcacacttatgtttattgcggcactattcacaatagcaaagacttggaaccaacccaaatgtccatcaatgatagactggattaagaaaatgtggcacatatataccacggaatactatgcagccataaaaaaggatgagttcatgtcctttgcagggacatggatgaagctggaaaccatcattctgagcaaactatcgcaaggacagaaaaccaaacaccacatgttatcactcataggtgggaattgaacaatgagaacacttggacacagggtggggaacatcacacactagggcctgtcgtggggtgggggtaggggggagggatagcattaggagatatatctaatgtaaatgacgagttaatgggtgcagcacaccaacatggcacatgtatacgtatgtaacaaacctgcacattgtgcacatgtaccccggaacttaaagtataataataataataaaaagagtcagccccctagcctggcagtgctgctctacaggcaccctcagccctgatcccttcactgcacctaggggacacagtttacaggactgagtcagtgggacaccctgttcctttacattcccagtcatgggctcagattctgcacttgtctcactgctggagggaggagcctgcatcagtcaccctcaaagaagacatgaagttatttcacctgtaaaggcaagaaactgttcgcagcactgggggcaggcttggggaagatgaggtttgtgaggatgttgagaattcatgcagctcatccttcagccctatagctttccagagaagtgtataatgggggtcactaggcatgtgagtaactgatttggtgaaagatgccacttcagatcaaaagtgcatttccccttccccaaggtgtcagcaacactgaaacatatttgactaactttatagaggaagattaagatagaggatgagagagacataaggcctcaggaatatcttagccaatagaaagcctgctggaagatgcatttccaatatgattagactgattgaaaaccttgaaactaaacacttccaaaggagactgggacccatttctcctgagaatgacaacacaaaaaatagtagaggaaaccaacaaaccaaaagcagacactgtttcagatctattgaaaatcctcaagatagtctcataatataatattcaaaatatctaggatacaattcaaagaaacacttgttatatcaagaagtagaaaaattcaccatttgaatgagaaaaggcaatccagacatcaacgctgagatgatttagggctgaaattacctgacagatatattgaaatcagccaccataaaatcctgttgatgagcaatttcaggcattcttgaaacaaatgaaaaaggataaattctcagaaaaaatagaagtcataaaatcaaactaaatataaatacaaataaaataaatgaaaaatttaaaaatacctctctggagagactcaagaacaagtaactatgaaactaaaatccacgcattagagaagacacttaacactgttaactagagaagcacaaaccatagttatcacagcccagcagggcgagcaatcagtctgctcagaagtgagaggcctgaaaaaaaactcctggtgtccctgatggtgaaatctggcccctgatcccagggttcctccctcttcgtgctcagagggctagacctagcagtgaagggttcccaacctcaccctatgcggcccctccagaaggcagagcccattcttgctgatattcccgatctccaataacacaaagtgaaagagaatgtcttaaccagagtactgagtcttggcctatctgaacatatttcaaagtttaaatgtacagtgagcataggatgctgagcagaggccccctggacagtggctggagttgggagcagtgcaggatggaaggacaggtcaggggccctgagcacctgtacctgcacctgcacctgcccagggtggacatgactcccgcatccaccagagggcgttgtggtctaagcaactaatcagagctccccagatcctctgctgttttccctccacctgctggtgtttctgtgccctccagatggtgttgctcctcccccttctatgaccacttttcagccataaccttgtctgaggtcaaaggagggggttgtgcaaccttcagaaagggagaaatttgcatggagccctaccactctgaggatacgcgtgacagataagaagggctggtgggatcagtcctggtggtagctcaggaagcagagcctggagcatctccactatggcctgggctccactacttctcaccctcctcgctcactgcacaggtggctgcctgcaaggaattcagggagcgttcctggatgtcacctgggctgatgatctgttcctcctgcctgggaaccagtcttcatctctcccgactgatctctgtgttgctctcttcttgcaggttcttgggccaattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcacacagtgctccagacccatggggaagtgagacagaaactccccagagcatctctacctgggccagtctcagcctgtctccaccagagagggtagctctcccatctctcctgtctaagtgcttgaggtgaactttgcttatgacttcctcttttccttttcaaaataccaatctgtttttccacaccttgatggctgattttctgatatgtgcacgatcaattgtgggataaatgtagtttataatcgggtctctgagccacaccatgattgatgttctggttggggctgccttgcacagtataagttattgacttgcatctctggcctctacccttagatactattaacaccctcccctcatttgtgacaacaagactgtcttgagacactgccacatgtcccatgcttggggacaaaatcagcccaggttgagatactcagttaaagagcatgtcttcagctactaagaagcttggctttgaaatgtgtttatgccattctgctgagcatgaggctggttttctaatttttgtttctggttcccatctatgagacaaaacaataacaccaaacttcaatgttttgatggttgaatggtttttccaagcaacaagaagtcagagattgtgctacttagaggtgtagaagccctaaccagatcctgtaacacagagtttagctctgactaggacagcacacaatgccttccatcaatctccaacccacagcccgcaggctgcatgcagcccagaaaggctttgaatgtggcccaacacaaatttgtaaactttcataaaacattatgatttttctgcaattttctatagctcaccagctattgatactaacagttagtatcagttttatgtgtgttccgagacaattcttcttccattgtggcccagggaaatcaaaagatgggacacccctgctttgcacttttgtacaatgcacatggaaatataatagagccttcttccttctaaggtcatgtgactcagccattgaaaggtggaagtgctgaaatgagctccatatgaacggaccttgaaaaattatgctcagtgaaaggaacaaatgcaaatatctagaaatgaaatgtctggaaatgactgtatttataacaaatgtccatgatacgtaaattcatggaggctgaaaagatcgagattatcctcaaaccttgtgataatttaggtgaaaaggatgatttcagaattggatagaaagtgatctacttcaaaaataagctggaaatgcctccacgaacagaggcgatgctttgcggaatcctaggtggagaagtgtatcaggtgcagatgaggtctttaagaatacttcttgttttgttttgtaaaattaaatatgaataagaacactgtgggccaggcgcggtggctcacgcctgtaatcccagcactttgggaggctgaggccggtggatcacgagatcaggagatcgagaccatcctggctaacacagtgaaaccctgtctctactaaaaatacaaaaaaattatccaggcgtggtggcaggcacctgtagtcccagctactcgggaggctgaggcaggagaatggcgtgaaccagggaggcggagcttgcagtgagctgagtttgcgccactgcactccagagcctggctgacagagcgagactccatctcaaaaaacaaaacaaaacaaaaaaacactgtgcttgctcgcttacctcctcctcaggtcatttcctgcagtctctaagaacagtccgcctggcttccccatctcctccctgagcgccagcatctggggcgtgaacagcacaatcaaggccacacctgtgagaccctcagtgcgtcagcagagctgtgtcctggtgatgtcaagggacacggggtcagcaggggacctgtgaggctgtctcagggggtgagcatgtctggccctgccagctgggaaggccctcaggaggttgaggggagctgagcacacagtgagctcactgagctgagatgggaagtgactgcagctgtcaggaccttcagggacactcagtctaggatcaggctctctcaccctgtggggcctggttcaggtcaactcctcatcctcctcttcttcctccagacaagagagacattgcctatggctgaggggtcctggaggtgatccgggtgcagggacttatttgaatgtaggaaattctctcccagtgagacctgtagagactaaaagagcgttaggaacattcactgttacggctggagtcttagggtgcagatctcttgagcacctgcaccatggcttggcccctctgctttttgacctcttccctccctgcccagctgaggcacatcctgctctggggagaagggtctatgcggtcctcagcccacctctgctccactccctttctcacagggctcattgttttctctttctctccaccctcctgggtctgtggtccacatggcactgacagcctctttcactgaccaagcctccgggactgacaattacaatcacccaccctggaaacagccataatactgtcaatcaaggcacagcttggattcaggagcacctgggacatgtccccaaacctcagacccagagggggtaacaaccatccctcagggacctcagggaatttcccagccccatgttaggcagtttggcctccctggccatctctgggctccaggctggcgacggtgctgattttcactatttagcacagaatggcagcctcgctgattattctctgattatctggatgctctgtgactccttctgtgcatctctgggatcatcattcagactcacctgcaccctgagcagtaacatcaatgttgtttgctatgacatttactggaaacatgacagggcagggagccttccctccctggtatctactgagattctactgagattcaagcagaaccagggctcagggtccccagcctcttctccgtgtgagtgggtgccgtcgccagtgctgaggctttccatatctttggtctcaagcttgaggatgaggctactcatggcacagtagtgcctctcacagtgccatggatgggatgttctctctaaaatagaagtctttttttttttttagtttggcccctttgataagtagattctataataattaaagaaaaaaagtaatgtcttttttggagagtagaaacactggtgaaagagaaaccgggaaggacttggcatggggggtgggtgggcttcaggccacggctctgacccccacgaaaggagagaaggaagggggattagtaggaactgccccagcccacaggcaggtcagacctcagacaaagcctcagccaactgagtgggttctttcccacgggtgcccattacaagtgccctgcttcctgcaggaagacctgcctggagggaccctggggtccccattgcctggagccagcccacgggcaggggacatgttagtcacttgtggtcctcctgcacgttctcccaaagaggcatctgagtgggacacttccacagccgccaccagcactgctgctgcattccccctcaggacaggggcagtgccttccttccccggctcatctacctgagccccatgtgaagtcaaagcttaggtgtctcagggctttcctccaacaggccctgcagccactgagacccttatataccctgagctgcatgctgtggagagagggtctgtggaagaccttggctcttagccatcgactcctctggggaacaccatgaaatcctcagactggggatgtcctctggagccatctttatcctcttcttcttcccagtatctcctgctccatgatctgggtcctgtccctggccctgttgcatctccagtgtctgatccatgccagcccttccttaaatatgtgttgaacccatttcccatttgcccaagaaatgagtgctggcaatgagctgcactttttttttttctaaatgggaaatgggtcaataaatgaatgaatgaatgaataacaacgcaacctgagtctcctgtcacatggttattttaagacctgcgtttttctttacccaggaggaaaatgagtacctgcagccgttattgcctctgaattgagctaacttgtttctacactgtcatgccatggtcacagtgggacagatgtacaccaagcctaccatagctttcagccctgcccttccacccgccccacctgtggcagtgatggcatcaaggcttccctcagagtcggcctctacccaccacacactctgggccatctcctgctctccaacagcctggggttcagtgatccctgtccatgtgttctacctcagagacacctgccactcctccccttccctaatttctctgccatcctgtttctccagcctcccaggaatgtcccctgcccaatctcatgtctcaggttctagaacttgtcctggaacttccccagagctgagtctctaataggagagctgatgacaggcacagccgtggtcaagccctctagccagcagatggaggagaatcagcctgagggccctgtgcatcctccctgctgcacacctgggcccatagccccctccaccctccatatgctcctgcagcccccacctcagtgtctgcctcagtgtctcctcccagcaccttcctcaggaagggcctgagatcttgcatggtgtgtttccccttggtgaactcctagtcacagcagcatcccgagtaagagcctcctggtgaagagatcgtcttggtgctccaccctggcattgtgtcctcagctccagggcaggtcacacgctttcctggaccaagattacatgcaggccacccctgctggcccctgccccacagagggaggcccggggtcaggggtggcaccaagaccacagctccattgatccctgtaggaattcttcctgcatgtttgaaagacaagagttacagaaacaaagcagagggaagattctgggtcattgcaaaaggagaaatttgcctgcagaccagcaggggacgcggtgagaccttctctgtgtatttctgcaggacaggtgctcacagctggggagccctcaactgacagaggcccagggctgctccttcatttcctcctgggactctgcagccttgtcccatctgtgcctggcagagtcctctacacatgaccctgtgtgtggtcccagcagctgctgctttctctggtcccacccgtggggcaaactcttgcttcatgccagcctccctgtccaagggcctggtccctgcgagtgcacctgggggagaggcaatggggaaacacatttgcatggtcagcccctcctctgtgagcccagtgacgctgggataagagaggcctggggcagcccacccctaggtctgtggcctcagaggcagctgtgtccactatggccctgactcctctcctcctcctgctcctctctcactgcacaggtagggacagggctcagagcccagggtggtccccagcctgatctgtccctcatggctcagatccctcagcagctgcgccctgaccctgctcctcactgtgctgtgtctgtgtctgcaggttccctctcccggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaatcacagtgagacagatgaggaagtcggacaaaaaccaaggttttaagcttgtcatttttactgaactggttaagaacttcagtggttaataaaatcacattaaatacaggattgttgttaaaaatggtggcacattataactctctcccatttttttcacataatgcccatagtgactctaagcagctaaaatcaaaacacaaaaacttataccaatactaagaaatactaacattactaaccaatttccactagtaaaagagttgtgaaacagctgaaatacatccagatggcataatacataataccactatatacaagagttgtataaaattatgtatcatgtatatataaaattatgtatcatgtatatgtataatatatgaaataaaatgtcagcagacattaccgtcttcccaccagtagccagcaattctgccctgcctctagaataaatggttaccacgggttgaataggcgaacagccctggcagctctgcaggatgactctcactgtttgttattgttttatttttaagattgcttttctttcctattttttttgaggcagagtcttgctgtcagccaggctggagtgcagtggagtgagctcggctcactgcaacctaagcctccctggttcaaacgattctcctgcctcagcctcctgagtagctgggattacaggcgtgcgccaccatgcctggctaaagtttttgtattttttagtagagacagggtttcaccatgttggtcaggctggtctggaactcctgacttcgggatccgccgtcctcggcctcccaaagtgctgggattacaggcgtgaaccaccgtgcccgacctcttttttttttttttttagtttggttttgttagtttagttttgttttatctctttaacttgacagtcagagatgatccatgtggatctctgcatgggtctgggagctgcaaggctcctggtgcatggcccggtcccgcctgccttggcagggctcctccacctggctcctggaggagcagctgcgcccgactaccctgcatggagcccgcggcttagcggcagctcgggaggggcctgatagaaacttccccctgagcaagcagcgccaaacccaggccgccacccaggatggaggctgcatcacccccggggagcccggatcctcgccagggtccaccaggagaagagcacatggcggagatgagcctgcggggctgggagagagagaagacacggcgaagctgcaggtgaagacgctgcactaaggccccacccagaggctgaggttccccgaccagaccagcagcagcgaggctgcccagagcggcgccagcaaggtggttctctccaggtcggatcacaggagaagctagccttgcacctggcccaggcaagaagcaggacatgggcttacgcagaagaatcagcaccgattccacatcattccccatggcaacggcctctacggtgctgtcagcaagacccagtgctagacccgagcctgcaccaggagctgcggagcggagggtgcgccccatcccgatcgtctccaccactttagctccctgggtgagggtgacacggggaagcttattatcgcggctgcccaaaacggggcgtggctgggtaccctgtgtacatagggtagatgctgaatgtgaatagcactgaactactagagggaggctggagaggcccacagtgtctatctaccatgattcattatttgggcccagaggattgcctaaggcctagtatttggctcagttggctcagtaacgggcactaggatgcagtatttgatcactcctatcctaaccaagtacgacaactggtgcaaacagactcaaaagcaaaggcaacgcaatgaataacttgctcactctggggccacatatgctgaataaaatgcctacccttgaaatgtctgaaaaccttacaccctgggaaaattgcatacagaacttgtgcttggagaatgacatgaactctaatcagggtaataacacttgtaaagttcctaacagcttttctttccttttttttttttgtttttgagatggagtttcgcagtgttgcccaggctggagtgcagtggcgcgacctcggctcactgcaagctccgcctcctgggttcacgccattcccctgcctcagcctcccgagtagctgggaccacgggcgcccaccaccacgcccggctaattttttgtatttttagtagagacggggtttcacggtgttagccaggatggtctcaatctcctgacctcgtgatccacccgcctcggcctcctacagcgctgggattacaggcgtgagccaccgcagctggcacttcctaatagcttttctgtgagtgtaacgccataatcatcttttaaaatgttttctcggaactaaaagttgctgggcgcctaaatgatgttgcatgatagttttgggtgattttactgcatctgtaattttctgtttaagtgagcaccgcttaatttgaaagctaatttctcacagtgtaaatctgttcattcctggtagtctattttctacaaaagtgtatttttacacaacattaaaaaatggtgtaccttcatctatgacagtacattacttttgacaagcagctttcaggcagaaattaagagaagtgttttatataaaatttattattttgaacagagtttgtgatttggtagttacgctgttgaaatttgaattttacaattcttagaaacttatattgatgcattcttgttaccaaatgattggcccattacattttgatacaaatagatttgttgttttggaaccattatttgtttagaaatggtcaatcttttagagagaaatacttaacaaaggattgtgggaagttttttttttcttcttctttaacggattgtaccaggtcttacttgaatgaaagtctgatgcttgctgatggcagagtgactaatctgcactagattgatgtttagagcagaatgttgggtgatctcaattgtttttatttatgtttgtgattttgttttaaggtaatcttaacatggtataagactctgtgacaagctaaacctactgcaatatagcatgttggagtcccctaagagttttaaaagctaatggcataaatgcctggagccaacctcggcagttatttcatagcagaagataccgtcttaatattccttttaaattcttttaaaaggcaaaataggatcatcctattttataatgtacaaatgtctgcagagattgtatggtttgttgtgttaatgtttcccacctaaaatctatcatattgccactttgcctaattgtagtcacatttattaagtaatgcagtttgtactttttattttgtaacattctgtgatttttgtacaacattgtatttgtacaatacagcaattcccagttgattgaatgaataaataaaatgtaaaatcatactttataaaaagatctatgtggctgatagaattctgacattcccctccaaatggaaagtgatgtgtttctttaaagtaaaggtagaggagtcttaaatataggtgttcctgcccctattgagaggttttcaaaacatgctcttaatttaacgtttaaatataccagagtcttagaatgtgagaataatgaaattggtttgttttaattttgtgataatattaaatctactggaaagaatattctcctttgaaaagattctcagctcagtgatcatagaacctgtacttgcgtttaattcaatgaggaaagacatagaaatgccacgttaatatcctcatttaggtggtttctcccttcactgatcagcctatgaatgtgtcaatgcagtactccccagtttaggcttaggtacttattgaaaggatgctgcctgagcatttttaataattgctatttcaagatcacattttggccatgaggcaggctgccactcactttaggctctgcctaggcaggaatgggtcctggaagacacatgttctctctctctctctctctctttcacacacacacacacacacacacacacacacacacacacacacacccctctcttctctctgggtacacattattctggacatcttcagtttccaggattctctatgtctccagctagaagtcagggcttagcctgtggtgatccagccaccctcaggttgaatctcgatgaagtcacaggaaccaccagtggcatggagggtaagggatcctgctatcaggttcagccaggaaatgctctggacacctgctggtggaagagtttaatgctgggcaatcacaagtcaggtcccttcttccagtcggcagttcagcctccctgactttctctgggttccagtcagtgcatgaggatgatggtgacatttattcaggggcagcacagcagcctcagtcaccaccaacagtcactgtcatatgagaaaattagatagaaattggccttccaactcttctgtcagatccatctttgccctttttctgcctgcttgagtgaatacgaccaagaccagctcaggtttttgctgatgctatcacacgtgctcctaaaaccagaaggcttaatggtattttctgtttatctttacggattcaatgaaaagacaccttttcttactggtctcccaatgaaaacataatcactatgtccacagtaacaaagatagccctcgttgttgtctgctgggatgagaagagcagcagaagtttggcaggtatggccctcatgggcttcacatgtccctacatctggccctggctttgctgatcaccctttgggctctgaacccacagggaagttaggtttctctttcttttgagattgcctctggaagagctgctctgttcccaggtgcagggcagcccctccgcagtaaggacccagctctcagagccatgaaggcctcaagcctccaggttgactccacatttctagtgcttgtctctggttctttggttggaaagatgttggatgaatagaagttctctgagacctaggctttgtgaatccaacccccattaaatccagggatctttttaacgaataaaatgaatcagggcccagtgatggtggggaaatgggacgtgagggttcctcaggccagtagtatggggagaacatccaaaaagaaaggaggggttccacttttgagaattgtctttttatatccatccacatattgacgaaaattataaaattagactaaaataccttaaatatataacatggtcaaaagaaaagaggtattaccaggataatattaaatagtaaaagaagtcagaggcgaaacagagcaagagacactttttttctgacagcatcattcttatgggctataatgccaaggcttgtgcagtaggagctgaaggaatctcacaggcgaccctcacgacaataatgacaataacaaaataagtcaacctctaaaagaagcccatgtagaattatccccaggtatgaaccacctggaggctcagcagaacattaagccttagattgggttcaagatgaccacagactggtgatgaccacaggcccctgggagcaacacactcacacgcctggtgatgctgatatctggtaaatcatcactgtgcatcctgaaacacattctgtgattagctctttgcagaccataactaacatgaaagaaataatgcctcagctgtaaacactgcagagaggacccactcattctactcccttaggtcatgagttgaaagatccatttgcaatggtcaggatgtccttccagaagagctgggtctgttctgaggggccacccgacttgggatcggagcccagcagggggtgctgttggactgttcctgagagggcagggctctgggccaggccacataggaaaatactggttctcatacacttgagcaagcagtgtcctcactgaagtatgacttcctgcacctgcaccaccgagcaggagccacttcctgcacctcaggagccactgagcactagactcacacgccaatgcttcctattttatcctccgccctcatggagtccttgtccaagcctgcccttcaagcagagacaaatcacacagcaggaacaaatttgctcaaaggaacttgaactacaatgtttcctgggcacagaatgagaaacacttggaattggggaagttcccatcctaacaacttagactcaggaagaagaaccctggagcttctccagcatggccagaatctcagtccacttcaaaatcctcagtctttagatcaggagttcttttagggatgaggtcaaggtttctgggtgcacattaccactgcctttcagtcctatcatctgggcatgaggagcttgttatctcgttctatccattatttctaaacctccttgtagagggctgggttagagagtgctaactgccatttatacagtctggacctttgtataaaattataaacacacacacatacacacacacacacaaacacaaacacacatacttattttgatgttccagcgaaagagtaaaactaaactcaacagaaacagaaacagatttgaataatacaagacaatctcattaatgaacatagaagcaaaactctctcagaatattagcaattagagtccattttatatcaatgaaggattatcttgagcatctgggaggatgtgggttgagacatttgcacagtcattggaagacagtgaacatgatttttgaaaaaacagcatgtttagagatatcaaccagaggtcagatgcttcaatcagagaaagatcctctgagttctcagggctgcttccctgaaaagctacgggagaaggaaatggagtgactggacacaatgccaggggattcattgaccctttggcttcccatgggcagcatgcatcagcatggtcttacaaggatgaaaaagggcatccctcaaaaaagaccgaccatttccccagaaattaataaagaaatatcatggccgggcgtggtggctcacgcctgtaataccagcactttgggaggtgggcggatcaggaggtcaggagatcgagaccatcttggctaacacagtgaaatcccatctctactaaaaatacaaaaaattagctgggtgcggtggcaggcgcctgcaatcccagctactcaggaggctgaggcaggagaatggtgtgaacccaggaggcggagcttgcagtgagcctagatagcaccattgcagtccggcctgggcgaaagagcgagactgtctcaaaaaaaaaaaaaaaaaaaaaaaaatcacagtattttcaccagtgcatttctgtttgagcgaatatgttgggtgaagaaatatataatatatacttttctaaatgaaatttttatctcacaaaattgtagaattaaatttttgttttggataagaaatcaagaaacaatcacacacattcttatgatctcatgaaaaccaggtataggaaaggaagtgacgaccccaaaattcatctaaaaagtgaaggttttggttcaaagataagagggttgtcatgttcaagacaaagtcactaccattcgtggtatttaaagctgttggtacaagtgcctatcattgccgattcccttcaaatttcttgtgtatgtttggatcttaaacatgagcacacacaaaaagagaaacagcaaaactagaaaacagatttacctttttgagtttccaactggaggagaaaatgaacaaagagtaagaatatcacatgataatgggaggaggagtgttaggaaggtgatgaggagcagttcagccttcccagcttggggacagtcttagtggagcagagaaacctccttcctgctgccacctgactctctagagtagatgaagaataaataactaaacataaaaagcccttaggaaaaagattgtcatgatgtcagtgctattaatagttcagttaataattctgtaagaatatgcaaaaacttactggctttttaaaaatttttatttatttatttcttttgagacggagtctcgccctgtcgcccaggttggagtgcagtggcgcgatctcggctcactgcaagttccgcctccagggttcaggccaacttactggcttttatatttggaatcacaacctgaaaggctgcagaacatgaaaggaagaaaactcagattgcagtgttcattctcttttatattatgagtttcctgcaagagctacatctgttattatgcaaaaacaaacagataaggaaacaagaattatccagcctcaagagtggaataaaacatgcactttttttgcttgtaggcataggtgagtaattcagacacggctgctgtgggtgactcatttccccttatgatggagcctcagcaaaaaagcttcacagattggggctgatttggtatgaaggggttggaatcgactgaaggtgacctcattgagagtctgcagtgaagccggccttggctgaatgacctacctgaggcctcccatgtggcctgggtttccaggaagctgggcagtcccagagaattcagagctctgacttggtttataaagtgtcacttccacagaaactgtcagtgccgagagatcactagtgccagatctggttaacagggaggggcctgatctcacccctcaacggaaggtgacgggaaaacaaaggaaaagctgtcttcacatcaacatgggcagataccactttaaagcatattctgtagcagggttcccactccagaagctgtggtacaggatgtgtctcctatggcatgggccaagggagggtaaaggtgagtttgacatctgtctcagtcaccatgaggtttttctgacaactaaatataaatatgtaaggtgtctcacagcacaatcatgtgacaataaatgcagtgcgtgccttcaatattgctctatcaaggaggctttccctccactccaggtgtgagcacgtggcttgcatgtccctccactccaggtgtgagcacgtggcttgcatgtccctccactccaggtgtgagcacgtggcttgcatgcccctccagcttcctgcactgtggtcatactgctgctgcctcattctcagcctgagcatccctacacaggcacaaactctatggctcaggctggtcatcactctgggtccacagtagctggtcagagagaaactgtcttcagccctgcccagcaggagaaaagagcattccagactgatcagctgggttcctgccatccagaagtccttgtctgtctggaggctcaaaacatgactgtgattcctttgaggactcctcccatacccaggctgtgggcttcgctgccctcctcaggacccgtgcagcctgttctatccctgcctcagctgcaggcaaagctgcttgccacaagctccctgctcataggatgccggagtcctcccaagggctgctcttcctggagaagaaggagaaccaggcagtaaggtctacctgagcatcatgggaaggaagtgatccgattctgactccggtgggcgcacacccttggtgctttgtgtctcctgctatcccagccacaggagtgggggaaatgtgtgagttgtagtcctagccgggaataatccataaaaggtgaaggtgagagaaggacactatgcatggtgtcaccttgttttcctcgttgtttcagcggcctgagtcctgtgtttcctgaaagatctgtggctcgaggtgacacgccctatcaggggacaggaatcaaagaggagaatctctgatggaaaaattcacaaaggaagagggagataaaaattgggcaacatgctcagggtgagaacgatggctttttgtccttgtgatagtttgctgagaatgatggttttcagcttcatccatgtccctacaaaggacatgaactcataattttttatgggcaaggacaaacaaccaaacaccgcatgttctcactcataggtgggaatcgaacaatgagaacacatggacacaggaaggaggacatcacacaccggggcctgttgtggggttgggggagtggggagggatagcattaggaaatacacctaatgtaaatgatgagttaatgggtgcagcacaccaacatggcacatgtatacatatgtaacaaacctgcacgttgtgcacgtgtaccctaaaacttaaagtaaaataaaaaaaaaaagacggctttgtgtcaagggctatttatttagtgtctctcgttcccattattaaataatttaacaacaaaaattgccttttctatgaattttcaggaaattctaaccatcattcctttattaaatatctagatatgtacatctacacatatgcatatacatgtgcatatatagacatatattatattatatatatttgtgtgtatgcatgtgtgtatatatttatatatatatacatgcatgtgtatatacacacacaaagacaaattaagaaatatgggaatatagtatacttctttaatttcttaataatgtccatttatatctaaaaaaaagatacccctaaggttgaaccactagaatcattttatttttaatgtggaacaatagaaagcttatggcccataaagatattggataacatatttttctagcaatatgagaaataagcaaaagtgtaaaacatttaaatacaataatttaattcaaaaatatgaaataatttgtattttttagttgctatgtttatctaccaagaaggcattatattattctgatgttcttacacattgttgaattaaagcttgttaaatacaaatgttatcatatgtgcaaatagcatatcaacatttctttttctctcatatattttcagaaatcactttaaaatgtagcagttcataatgttgacaaaatatcaaaatctataaactctgggtttaaaaaacaatgaaatacacagtacacataagaaaatagtgtcaaagctcactactataagagacaatgatcaatattgaaattttctcttacatgaagacgctcaaaacattttagcagtgactagtgaggttgtatccattctcttatgtttatatttatgtttaaaatattgtccttgagaaggagtgtaggtaggtataagcagaggtggctgtgcggatccaagattctagcctgcccccttgatacagcccattaccctagtcccatccaatctcacacatggcccatcatcatcttctgacttgagcggggagagagacggtgggtagagagggaggaaaggagttagttcagagcataggagacgtggtcagagagttggcagagggagggagggaggcacattctgtgggttcacgtggtgctttgacaactgtggatttacttctgaatgaagcatgaagtcattgagagtgtggaacagtaaaatgatattgcaaaataaaataaactaagattccagtgagcatgttgggaatcacaaacactcacagctgggtgaataaacaagtgctgccatctggagaaaagttcctcagcacacaaggagaagtgtgtttgcctctgtcaagcagaagtccacctatacagagacacaaggaaatgtttataaagagatccttattcggagcaaagtattggaagcaacataggtgttcaacacaagtggaatttataacacaaggagaagataaaatgctagccagttggaagtaatacaacttcttatgcgacacgaataaaaatataattatcagttgaaaaacaataacaacaaactcccaccaaattaaacaaaatcaaaagctctcaagaaaaaaacaatgtgccacttattttaaagcagaaacatgcataacgaattcttcaagcttatataacgggctttttggaaagtagactggaggcacattatttcacataaatgggtgtcttaggaagagatggagacacgtataatggctaaaaaatgaaataaatccatagagaggtttttagtgtctagtgataaaagtactaataatattacgtaattaaattccaaaaaattaatacagaaaaatattcttgatttgggggtggtaacagatgattaagtaaagcgagtctacatgagctgctgatgcagtggatgacaagctctctgcagctcattgttagtgagaaggcactgctttgccagaaaccccttttatttagatttctcatggtccctgggtccctctccaacaccatgagcagcttcagaagaggatcaggataaccagtgactctctggctaccatggcccagttgtgtccgagaggtaagaaaggtttgggatcttggacagagtgggacagtgggagaaattcctgagatggccccaaccagcctggaaaccactcagaacctgcattgaagtttagccatcagggtgctcttgagactcggtttgggctgcaacacagacctgtggggacaggggtcaccataagccaggccacctccacccctgggtcagctcatctcctccctctctgcttcagatctttgagtaaccagcacatggaggcccgggaaaagtcagagagcaagatcttatttaaatgctgtgactccacccccatgaaggctttgggagctataaaaaagagacttaggggagcccagtctccaaacagagcttcagcaagcatagtgggaatctgcaccatgccctgggctctgctcctcctgaccctcctcactcactctgcaggtgagagtggaccttacccagggatctgcacccacctctgctccagcttctccactccctggctcagtggactctgatcctgctctcacattcctttctgtcccctctacagtgtcagtggtccaggcagggctgactcagccaccctcggtgtccaagggcttgagacagaccgccacactcacctgcactgggaacagcaacattgttggcaaccaaggagcagcttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcattggacagcagcctcagtgctcacacagtgcctcaggccagtggggaagtgagataaaaactcaagagctccctcggcctcactgaacaggcctcacagagcactgtttaaactggaccacccaaaagacaagggatgcattcacaatagtgtacactatttaggactgttaaaaataggaacatgaagtgaaattagcaagcctgccttattaacaaatgtgtgtagggaacatcattgtttatatattagtagttacatatatataatactagtgcatgaacatacatatgcactagcaattagtaaaaaagaaacactaggtttaactaaggaaatatttattattccagagttttcttatccattccatttgaagatgctgggatcaagtcaccgagggtgctgctctctggccttgagaatccactcagcagggccaccagcagcccctcccttctgtggcctgctcatgccctgtcttctcattagaatccccttccctgctgtcacagggatccctggactcctccagatccaaatatgtccaatacatttggttgaggcctcctgggccccacattactgtgtaatctcaacacccacacactcaaaacagtgttcccatgcgtattcttctttcgactcatcactgtcctctaacagccatgggcagtgtgtggagagagcaggtgaagttggagctttggggtacagttgacagagatgttgacattttgagaaaaagaaaacacctatatagctgttttcaggataattttccatcaagataaaaatccacgcatgagagcatcactcttccagtgatgaatgcatggaggatccttctcactctattgttgggtagtgacacctgggaaacttactgtgttatttagtgtgcagacagctggtaaaccactcagctgactctagggaagttgaccaaacagtgtccccactgatgtgtgacttttctccacccatgaggccccactaccctgtcacctcctgagtccacctttcccattgcgttgctttagatttgaggcatctctctcttacctctttaaagtctttacccaagtctggttcaggaagtgctgatacacggtgagaacccagggtgcatatggatggagtgattctgtgcctaggagagcctggccaggggatccaacacagcttgtggccatcctccccgcagtggagcttctggagacagagctctgaggtgtccccaccacaccctggggcctttctccctcagttctttataaaagggatatttgtcatgggcttaggggaagaggccgctgaggtcacacaagacctgccttcttgctctggctcacaaggcacaagtgagctgtgaccctggactctgtgtcagtgctgtggtcacttggtcagaactaagggaagctggagaaatgtgggtagctttgatgcagtctggcaccagaagctccatcctgaagcactctgaaggtgctgatggctgttcactgtgctgcaccctgagcaggaggatgatcatcatcgcagacctagggtgacagcctcagagctgaaatattcctcctggccctgagaaaagtgggctaaagttctcccttctgcgtgtgttacccagtggtttgcccccctttcatcacctgtgaccaacatgggctcattggggatatttgtgctgtcatttctggcacaagaacccaaagatctaagaccataaaatgcatttggtctttcatactgtctattcccatcagggcagacatctatccattaatacattttatttaattttcttgtcttatattttcagagcaatgatgagtaatgagtgaggtaaggggtacctttgcatttttttgatctcagggaaaatgtcctccatgcagtaagatgatgactccggaccaagacaggtgtgtgtgtgtgtgtgtgtgtgtgcgcgcgcgcgcgcgtgcgcgtgcacacgtgcacacgcatgtgtgttaccatatcataaacaaatttatctgtttctgtattcttacgtgatttttattagggatagatattaaaatttgccaaacacattaaaaatctattgatacaatatgatctttggttgtgatgtaataatatggtattataccaaaacttttattaatgttgaacccaaccattattttaagtataaatcccacttgacaatggtgtataaatgcgtaaatctggtgttgaaatcagttcgttcctcaaatttcctggttcaagtgatcctcccacctcagctccttgagtagccgggattccaagtgggtgtcaccatgcctggctaattaaaaacaaatcttatttgtctcaacatattgcccagtctggtctcgaactcctgggcacaagcgatcctcctgcctcagcctcccagaatgagttaacattttattttaaaattttgcattaatatgtttattttattttttatttttaaaatttttaacttttattttaaattcaggtggtacatgtgcaggtttgttacaagggtatattgtgtgatgttgaagtatacaattttatctttttaaattgctcttaatacatatttttaatttaaatttcaacttttattttaaatatagcaggtacacgcgcaggtttgttacatgggtgtattgcacccgggttgtgagcattgtacccaacaggtagttttttacaccattccctcctctccctccccctcctagcagtgcccagtgtctattgttctcatgtttatgccatgcgtgctcaatgtttatctcccacttaaaaatgagaacacgtggtatttggctttctgtccctgtgttagttgcctaggattatgtccccctgctgcatccatgttgcttcaaaggacattattttattcctttttatggatgcatagtattccatggggtatataaactatattttctttatccaacccaccactgacgggcacctaggttgatcccatgtctttggtattgtgaatagtgtggtggtgaatatacaagtgcatgtggcctttgggtataatgatctatttgtctttggatagataccctgtaatgggattgctgggtcaaatggtagctctgttttaagttctttgagaagtcttcaaactgctttccacaatgcctgaaatacggtgtatacgtgttttctttactctacagcctcaccatcagctgttgtttttttactctaattatagccattctgactggtgtgacatggcgtctcattgtggttttgatttgcatatcttgatgattagtgatgatgagcatttctccacagttttgttggccactaatatagtgcagttttaagttcatagcaaaatacagaagaaggtagaaagatattccctatcctccctggctccacacatgtccagccttcccccttatcaacgggtcccatcagaaatgtacatgtcctgtaattgatgaaccacattgacaggtcattatcactacaagtcagtattttccttaaggaatttttctcgctgatgcacatcctatggctatgggtttgtgcaaatatataatgacatatatccaccattacagtatcatgcagtgtatttcccttccctacaaatcttctggctttactgattcatctctctctctcccctaacctttggaagtcgatgacttttctacttttttcctttgtttgactgtaatacacttgaaattatttccccctttttggactgtaatatacttggaatcacgtatcatgtcatttgcaggtcagctccttttacttactaataagcatttaagtttcttccatgtcttttcgtggtttgatagtgtgttgtccataaacatgtagaatatattaatataaagtactttggagctgatcacatcactggccattcaggtttttcaattactgtttgttgaatgacagtgaccagtcagatgacaggaagtcttagaccccctgagaacacagaagatggactgaggatgtcagggtcaccgaggactgcactgggtgctctcatggagggctcagtaggggtgtcctctagttccagtgagcctggactgtgatgggcactcagagaagggtcctctctagcctagcagagcccctgctcacaggcctaccagctgtcccagcagctttccctcccaggtccttccgtggggcagacagagtctcactgcctgttagcccttcctacccacaagaccctcagcaaaagatccttattcagtgctcagggagaggtggggcagatagcagctggggccacacctgcatgaccagctcctcctcgctgaggcctacagcaggtaataaactcaatccatcccactggaccaaagggagctgtgtctaccatggcctggacccctctcgtgcttgtcctcactccctgcacatgtagggaaaaggcctagagacctggggcagttcccagcttgtgtcagcccctctggctcagacttgccaacagcttaaccctgacacctgctccaacaatgtaaatgtttgcatttccaggttccctcttccaggctgggctgacccaggtgtcctcactcccagcatcttcatgcagatcaaacactcacctgcactcagagcatatcggctttcatatcggtggcaaaaataccttcttttccctacagaatccagggagccctccaactatgttctgagattatgctcaggctaaaatgagtaccaggcctctggggtccccagacaattctctgggttgagaggctcctccagagtctcaagttatttggtcgtctctggccttcaccttgaggatggagcagatcatctctctcagatgggctgacagggcatggcttacactgtgctctaggccaatgggaaaatcccctctgcttgtgctgcctgggctcccactaggcccctgctgtttgtgacaacagccagcactggtggtgacgcttcagccatgtatgccctacggtgagagtctgcagcccttccacgcaactatcacttgcagaatgtctgcatcattgctaatagcacattctgagcctcctcacgtttctgtgggcaacaatttccttcccaagacgtgcacatgatacaggagatttatttaccaaataagtttattaggaatccaattataattagaagatattcatcagtgatcgggggaaatacctggtataattaaaatagaatttgatgaaaatataaataaagaactaaattatgaaggtgtgggcagagagtctggacaccctaagggagatggaaaaccattcatccttgccaggaatgaatgtctctgggatgcttctctaacaggaggaacctggagtgagaccaggaacctggagaactagcagctgggtgactggaaaggaaaccatctggggtggggttgggtctgcaaggcaggaggtgtctgggcagagaaagcagggctggggcggagggtcctgcctcatcccattctcctgctcactccttcctagatccctgtcagggcagtaaccatgagcaaggcttgaggctacttcttataaactgtggccctgggcacattccttagctcacctgagcctcagtttcttgatgagaaaaaatcgggacaatagcaaccaacctatctcagagggctgctgtgagaccctgagccactgtttctcaaactgcccctgagatcacctacaacagaatggctgtagggtgaagtttgagaaccgcagtataggtgaggtggtgcgtggggcaggccctcccacactgtaaagtgcagtgtggtgcggtaaaagctgatattcccgcaggcatcctcagagtgggcccaattagactcttgagcactgattccattcaaggtctgcggcttagagaggatggcaaagtgaggcaccaccaggagcttgtccctatgggctccaggccaaggacgtgcctggagatgactcctgccttgtggcgctgtcactgcctcactgtccacattccatcacgcctcagatcctggcttccaccctggtgaaaggaatctttcaatatcacccacccagccacagacgcttctctgcttctctggcaaggctgcaccccctggctaggtgggcagggccaggggctccttgagacagtctgcagccactgagctctccagcctccagggcagaggtacagtcccatggagcgtggctgatctgaaggcagttctggcctaaaaggggtcttgtcccttcctcgtcctcattgctcccaaggccaggttggcagcagtagcagcggggttggatgctattggatgggagaaggtgaatggactcggagtgcagaatcaagctgcggaagccaagggccttgaaggagggtcacacacaagggacaactgcagaggaaaataaaggaacactttgtgattagccctgcctgtggctgaaagcgcagtgcagaagcatagtaaggaaggactgggtggtctgggtttaagacctaggaaccgtctctgctcctccaagcctgaatgagccctataacctaagggtcctggaggtcttgaaaccttctgcggagaaggctccaggtccactgggccctgtgggtggaagagcagagtcacagccccgcactggggacctaacaggtgtggccttgctagggccccagaatgggaccagagtgggtgggagggggcagaagctctgagagcaccccctccttcctgaagcctgtgcttctgagacacatcccaggaccctctatgtggttccccatgtctctgtattttcattcagcttcgagtagctctccaaactgtgttccagggaacccccgtgttaacctgtgagggcctccaggaagggggtccaggtggggtatgcttggtgggctctgggtttccttacaggagctctcatataagtcctggtgcagcctgggaatctactactgagttggggcgggggcgggtctgagtccgaaacattcctgacctgcccctcaaagaaaggtcccactgaacagtctggaaagctgttttgctgagctcccgtcatcactcaatgaggcacgggcggagtgtggagggagtttccaacacacagtggatcccgcacaggtgtctctcctcgggtggctggggaggggagcacaagaaggcactgaggtcagagggcagctgccaccagcacctggcaccacagggcagtctggcctacagggtattttctaaacctggcatgtgaatgggttccatggggcacccagctgcctctaagaccataaggccttgttgtgagaatgggaattgcagcaggtcctgggaagctgccagacgcacacgggcaccatgtacagggcttctcagagatgggagcagggagcaggggacggagaagcgtggggtcaagagcgtggccctgagcagggggctgcagcgaagaccaaggggattcataagccagatccagggagggggtctcccagccccacctgctccactaaactcctctcctgccggagccacagctgtcaaggccgccttccttaaggcatcagggccactgcttgtgcacacagctaccatcagcagcacggattgagatggggtgtgagtgcaaactgggtctattccccagggcttcagggttggggcatccctgcccgtactgccagggtgtagggatagcagggagcactctgggcacgtgtatgcaggctgaagggagacgtattgggtttcggagagggaaagagggccccacaggtgcccagggacacggtaacgctctgacatcgctgcaccagcaaaggggccccagctctggataagataaaatgcattttaatagtttgaagtgccatgaggtgtctgcatggcactgcagcctgggtgagggaggacagggtcatcatacaaagtaggcggccagggctgacatcttgtccttgggccgtctggggttgggcttcccagggggcctcctggcccggccccgccctcgaccctgccttctccctggtccaccgcggtgcatggggtggcaggaggccgcatgcttcagctccaccagctcctggaagacggggtcacaaaagacgcagcccatgtgctgcgcctcatcgcccgggagtggggacttggccttgttgaagtccacatcaagcaaggcggcctcacagacactgcaggtgtcggcggacacccgcacgcggtgggcgttctcgaagcagtgcgctaccacgttgcacttgttgcaggccaccttccacttggggcccgaggtggggtccagcaccagcaccccgctctcacattccacgcactggccgatgcccagcatgctcagcgagtgctggcaggaggggtgcgtacactcgttgcagcccatgcctggcgggagaagggagccctgtaaaggcacgcccactgtgcccacctgccctctgctgcctgctcccaatgcctcaagctcctggatccctcgtcccagcagaaggaactcttcttggccttgctcttggggacagccttgctcatgtttcggctcctggctgccattacccctgttttctgcttacctgaaacctcctcaactttcaaggcccctcgctggcgccatcccagtgggtttcagctgactccatcccccctttgctttgctgccagcttgttactggtaatgccacatgaccctcatgtcactgggccacatgggaccaccctgtcagctactctggcggcagcaggagggcagggatggggtctcactcccggggcagcctgggtgcagactgaggcctgagggggctttctgcagagcacacggtgaatgtgggcagatgcctcactcccgctgattcctggtctggctcggtgctctgtcctgcctgcctggacatgcgctccctcctccagtaatgaggacgaggatgaggatggaggacagtggtggacgctgactgggggtgcccgctcaccgggtgggtcccccgactgctgcatcctcttgctgactcagctccagagggagcactgcacacctgcgcccaggtcctgagggtggactagggttgcctgctcgattctgacacagagagagggtggcaccactggctgaggcctaagcagtgccccagctacatccagggtctctcgtctcagtgccaatgagtgcaggaaaggccagggtgaggggtcccctcagagtccagcctggtgcaaggcaggggttggcactgaacagagactgcagctacctgtggacaggagggagcggctgcactcaccttgatgctgctgttcaacaatggattgctgttgcgcctaaccaactttaagacttggtgggcttgacacaacttaccttgtgataggcagatgtgaatgtgtggtcaacaggtatcttatggtcctccgctagggccaacagcactgcagaagttgttttacaaaacacatgcaattcattactgcagactgcacttagccctgctaagtgcagggctggagggcctgtgctgtgattctcccactggagctcactgcaaattccacatggcatcttttcttaccaccgacccctccagtcccctaaattctgccgagtcttatggcccaagcagcagggctgttttcactgcagccttgtcaggcagcagatgacttttctacgccaggctgcattcaaaggtggcagccttctgtagaccaacgacataggccagaagtggaacatgctgttcccaaaacctgaagagttctgccaggcattatgtttggacgatctgacccatcctgccttgaccacttaggcactcaaaactgtactcacgtgacagttccctgaatcttcatacagattatctcctaccctttatagtgcatgtttcttatgaaggcctccaacatgctagccatttcctactaaactaactcaactagcatgatgtcaacaacacagtcaatcaatgggatattttgtggggtgctcagatggcagaatgctcccacatcaataaaactcacccttatctaatcttcatgttctggtccccctctatcacccaccctcatgatccagtcccatgcctagtcccttgactcctgctggtacctgctggttaggtcttatggctcctctggtgtgtagtcccttttcttccccttttaaaaaatgttttgagacagggtcttttctgtcccctagactggagtgcagtgtcatgatcatggctcactgcagctttgacctcctggggtcaagtgatcctcatgtctcagtctcctgagtagctgggactacatgtgtgagccgccaagcctggctaattaaaaaaaattttttttttttttttgtagaagtgaatgttccgctatgttgcccaggttggtctcaaactgctaggctcaagtgatcttcctgccccaaactcttaggctcaagtgatcctcctgattttccttatccccgtgagcctcctgaagtgctggggttacagatgtgaggcacctcacccagccttttctctcttctcaaaatgagcacatctcctgctgtgttgtgctgggacttaaccctagttctaggccaagagggaaattgggcaagatggtgaagaaggcatattttgtcctagtgagagaggcctctgcaaacaaaggagtttagctctgaataggctgagtttagtccacttctgcaggctcaggggattaaggaaaatcagtgacttaagattttagaggcctcaatccaaataactctatcaatatatatgagggtgttggccgggcacggtggctcacgcctgtaatctcagcactttgggaggccgaggtgggtaaatcacttgaggtcaggagtttgagaccagcctggtcaacataaagaaaccccgtctctactaaaaatacaaaaaaagaaaaaaaaaaaaacaaaaaaaaacaaccctggcggggcatggtggcacacacctgtagtcccagctacttgggaggctgagactcaagaatctcttgaacctgggaggaggcagaggctgcagtgagccgagatcgtgccactgtgctccagcctgggcaacagagcaagactctgtctcaaaaacaccaaaaaaaaaaaaaaaaaaagaaaagaaaaaaccctgacttttctccagcagtctggatcaatcaccccaaacagtccagtgacccctgatggttgagcagcagcactagaaccccaaatttctaggggagacccagcttccagtttattaagttccatgcacttaattcttgttctgcttgattttgggtcagcagttacatgaactcacgtgtttctcaaccagtgttctggagatctggctcagtgcagggctgtggtttcaaagttattcaagcaatgccaccaaaagcctgtaccccagaatacctgccataggccatcctgtctatccctggagacagtcccttcttattgaagatgaagcactttggcccgtagctggttgccagagctttcagaaaagcgtcggagtaaaacaaccatctctgatgacaaaagacttaaaatggctgtgaagagctctattaattcctcaaatattcattgctctattttttatctccttttataactcctactgccaggctattggcctttctacttctatcctctccccgacattcccatcttagtaaatgactccacaagtacttcagctcccattcaaggaccttggattacccttgggtcctctctcttactcaacagcccatcctatgccaagtctcaccaattcttctctctctctacacacacacatatacaaacttatttgtaaacaattattttaaaaaatctctcttctgaggttccagctttcttcttcttttatttttttgagactgagtctcgctttgtcacccaggctggaatgcagtgacacgatcttggctcactgcaatctctgcctcctggtttcaagtgattctcatgcctcagcctcctgaggagctgggactacaggcatgcatcaccacgcccagctaatttttttgtatttttagtaaagacaggatttcactatgttggcctggctggtctcaaactcctgacctcagataatctgcccaccttggcctccaaagtgctagtattacacgatgagccactgtccccagcctctctctcttttttttttttttttttttttgagacagggtcttactctgtcgcccaggctagagtgcagtggtatgatcttggcttactgcagccatgatctcccaggctcaggccatcccacctcagcctcctgactagctgggaccacaggcatgctccaccatgcccagctaatttgtgtattttttttgtagatacagggtttcactatgttgcccaggctggtgtcaggctcctaggctccagtgatacccccacctcggcatcccaaagtactgggattacaggggtgagccaccacacccagtcacagctttctttttagagttcaccacagtttgagtgattatttggaatttttaagtggcaaaaattacaacaatatatttgtaaatgaaagagaattgtgaaatgtatttgaaattttaactttaagattttctttaaaatacccatattgaatgaagagtatcaaagtaactattgcttaaaaaatggggcttcatttgggttaaaacacaagaatcatgaacatgatcaaaattcttcaaagtgcttgcttggaatgatacagagaggattagcaaatacaaatagtttttttttgtttgtttgttttttttttttttttttttttttttttttttaagagatgcggtctcactatgttgctcaggctggtttcaaactcctgagctaaagcaatcctcctgtcttggcctccccaagtgctaggattacaggcattgagtcaccactgctggccaagatgctgatctttttgttgttgttgttgttgcctaggctggagtgcagtggcctgatctcagctcaccacaacctccgcctcccagattcaagcaattctcctgcctcagcctcctaagtagctgggattacaggcatgcgccaccacgcccggctactttttgtgtatttagtagagaggggtttctccatgttgcccaggttggtcttgaactcctgacctcaggtgatccacctgcctcaggctcccaaagtgctggtattacaggcatgagccaccgcgcccagtgatgctaatcttatgaaagacaaccaacaacaaattctgaatactaaagtgtgcgaaatgtatttaattcttttcatagcacagatgagttaacccacgatgtgttgtcccaggcactatggagtcatcttgaatttcatgttctaaacaaacacccttggcctggaggaatgcacctgcatatcacgacaggacctagtgtctcagatttagtccggcagctttgaatttggaaatcctctttggagcttcttctgacacagcatcttttctctctgggaaggtaggtgacacctgagaacagaggcatggtgtggcatcagagatggaggtaagaattatttttctaccacaatcccaggaaaagactctcctgttcctggtgagggtgagagctctggctgaggatgtcctctttcttctttcttctccagaggatttttcagtctctctgcaaatggctgcttcacagccagggttcatcgaaacccctggatcgtcatggccagtggtttgcgtctctccagcgccactccatacgagggtctttctgcatcctgctctcatggtggacttctgagggccatgctcctcatttgcagggctcacaaatattctgtaaatatccaccagtgttctgataacggggtgacccaggacaaactgaccgtctccagggttcaggtcccaggcatgtctagctccctctttcctttcactgaaaactaatgtcctgtttttttccgtatctatatggacctttctgggttcagtggtgtgggaaaaatagattgttggtgaagactcatcttcatctcctgaactgccatcattgcagtgttcagagtggggatggtgcttggaatcattcccttgaccttgccttcgaccttgcattagttttgactttaaaatgtccttatgaaaattcccccaagtacggaagcccatagtctcatcagagatcccaccttttccctgttcccctccatttttttttcttttttgaaatggagtctcactctgttgcccaggctggagtgcagtggcgtgatctcggctcactgcaacctccacctcccaggttcaagcgattctcctgcctcagcctcccgagtagctgggactacaggtgcccgccaccatgcccggccaattttttttatttttagtagagacggggtttcaccatattggccaggctggtctcgaaattctgatgttgtgatctgtctgccttggcctcccaaagtgttgggattacaggcatgaggcactgcacccagccccttcccctctgtttgtgaactccatcccaggatcatggttgagttcacccagcaggttttcttgcctctccagttcttccagtcgagcccacagttcctcatttgtaagtaagcatccttggacttgagatcattttcaaaacctgaggttttggattttgaatcaggtttatgtgcaatccagggttttctctttaattcagacttgttttgaacatgttttcttaggtcaacaagatctccatccccatcaccccatccctgcagatctgctgtgaatgcaactttagattcaaagtttctcctggcttttgtaaagtcatgtagtgctttcctcacacactccttcctatgctccactaaccccactgcttgctttgcagagcactggcaaaaccagttgtccccgaggagaagagtgattttgctggtatccacaagccttcctggtatagaaggcaagaggcccagttggcaccatgagctcgtaagacagcctattgggcaaggtttggagtcgctcttggagggtattacagtccccctttaccttttgccagtgtgcaatttcatcttggcacctagagatcatcttttcctgttctccttggggcctcataacctgttgaggatgcagctgtttgaaggtggccgaggaggctgcacggtggggcacacggtggggctccatggctcctggttctgcgtgtgcgctgtggtcggcactgctcaggctgctgcccccagtcatggcgactgcagtgcccaacttcctccagctgagtcctcatgagatccttcctgcaatcagtgctcccagctcctcagtcccttcaaaagataaatcattccggagatgggcggtggtgatgtagcatgacaatgtggctactttcaatgctaccgaactgcataccaaaaaatggttaaaatgctgaattttatgttatgtatattttaccacattaaaaaaatattagctgggtacagtggctcacacttgtagtcccagcactttgggaggctgaggcaggaggattgcttttagtccaggcatttgagatcagcctgggcaacacagtgaaacccccatctctacaaaaaaactcacaaaattagctggccaagttgattgtgtgcctgtaatctcagcatctctggaggtggaggtcgggggattgcttgagcccaggagttcaaggcctcagtgtactgtaatcacaccactgcactccagcctgggtggcagagcgagatccagtctccaaaataataatagtaataaataatagtaataataataaataaataagtgataataaataaaaatatccacttgggataattatcacaagaactttgctgtcatggttgtgattttttggaacaaattctcatggttctaactaaaccaaatcaaatacaacattgatttgaacgcccatgctcacagcagccttattcacaaaaaccacaaggtagaagcaacccaaatgtccatcgacagatgaatggatcaacaagatgtggtctctccacacaattcagccttaaaaaggaaggaaattccaacacatgcgacaacatgcaggaactttgaagactttatatatactaagggtacccaccccctacctcactgtattcatatgttgaaatctcaacccccaagctgatggtattagggtatgggattattagattcaaagtttgggacataattaggtcatgagggtggagctcccatgatgggagttgtgaccttataaaagggattccagaggcccctcttaccccttctgccacgtaacaatacaacaggaagtcagaagtctgtgaatgaaagagggccctcaccagaacccaaccatgctagcccttcatcttggacttccagcctccagagccatgaggtatcaatgtctgttgtttataaaccacccagaccatggtactctgttatggcagcccgacctcactaagacactaatcaaaacaaaccggtccacaaaaggacaaacactgtatgattccacttacatgaggtacctagagtagtcaaattcctacagacagagtagaatggtggtttccaggggctgaggggagagggaaatggagagttgtttaatggcatggagttttagttttgccaaataaaaaagttctggattagttggacaacaatgtgaatgtacttcatgcttctgagctgtacacttaaaaacggttgcctgggcatggtggctcatgcctgtaatcctagcacattgggaggccagggcagaggactgcttgagccgaggagttcaagaccagcctgggcaacatagcaagactctgtctctacaaaacatttttaaaaaaattcaccaggtgtggtggtgcacacctgtagtcccagctacttgggagtctcaggtgggaggactgcttgagtctggatgttcgaggctgcagtgagctgtgatcacaccactgcactccagcctgggcaacacatagtgaagccgtatctttaaaaaaaacaatggtgagactgggtgcgttggctcacacctataatcccagcaccatgggaggctgaggtgggtggattgtttgagcccaggagtttgagaccagcctgggcaatgtagcaagaccctgtctccacaaaaagttagctgggcatgatggtgcatgtctgtggtcccagctacttgggaggctgaggtgaaaggattacttgagcctaaaagattgaggctgcagtgagctgtgattatgccactatactccagcctaggtggcagagtgagaccttgtctcaaaaaaaaaaaaaaatggataaggtggtaagttttatgttatgtgtattttatgttttttttattttttaaagaaacagggtcttgctatgttgcccaggctagagtgcaatggctattcacatgtgtgatcagagtgtactacagcttccaactcctcagctggagttgaggtgattctgcctcagcctcccgagtagctgagaccacaggtgtgcacagctttgcctggctccattttactacactacagtgtctctctttttacatggttgttgcagtaaaagaaaattcagtgtatatagaaacatcacaagcaattgttttaagattatatgtaaagtggaaataagttgtagactcatatagttgtcaataggttttctaacataagaactttgggtggggcacttgagaactgattcagatggaagatggctctaggctggtggaacagtgttgagaattcctgaatgtgtagtattcctagacctctgtccaccaaattaaagcaggtcccccatcaccatgatcctacagggggcatcccccttagtaacccatggaatctggcccggcctctttctctagcctaaattgagacattctcctccttgtttctctaggcctcagccacactggccttcttctatttccaaacacacaccaagctctctcctgaaacacagccttcccacacaccgcatctctgcctagttcatacactgccggcaaattgtgtattggggctgggcccttcccactgttcagctgtcatcctatttttttcctttgtcaggggtcctttgaaaactacgtattccagaccaggtgcctggacattctctcttatgacacttattaaaacatgttgttggctgggtgcggtggctcacgcctgtaatcccagcactttgggaggccgaggcaggtggattgcctgagctcaggagtttgagaccagctgggcaacatggtgaaaccccgtctctattaaaatataaaaaatcagccgggcatggcagtgtgtgcctgtagtcccagctactcgggaggctgaggcaggagaattgcttgaacctgggaggcggaggttgcagtgagctgagattgcaccactgcactgaagcctgggagactctgtctccaaaaaaaacaacaacaaaaccaaacaaaaccaaaacaaaagaataaaaaaaaatgttgttgtcattattttcccgctagactcccacaagattccccactagactctaagcttcatgggaggaggggctatgcacattcacagtgtctgctcttaccagagagtctcacagagcagccctaacaggttagaccaaagaacaggtcatataaaaacccaagttccaatttctcctgagatgtttttctcctaaaaaccaagttaagaactctaggcctctactgggaagctgcctccccattcagacagggtctccccattaccacaatcccttctagtcctctcttctacttgcctccctaggtgatcattgcaggcatctgagtttgtaaacccgagtttacaaaaggggattagagaaatgcccacatcaaatgatctcattcacccatttctcagattctaggtcctgatggttggcacatgttgcaatgagttggatggggggagtccagccaggacctcagggtagccacagacttcttcaatttccaccctctaaggtttggtcctcagattggaattatgtttcctcaattctctgcagacaggaagtgttgagatctgactcttagtagtaatttaaatgagagaaagagaggaggagggaggtatttttatatcctatttgtatctaaataccagaaaaggtagggagtgggggcttacacctgtaatcccgacactttgggaggccaagacgggagaatctcttgagcccaagagtttgagaatagcttgggcaacgtggcatgaccctatctctacaaaaaatacaaaaattagttggacatggtggcatgtggctgtagtcccagctatttgggaggctgacatgggaggattgttttagcctaggaggtcaaggctgcagttaactgtgattgtaccactgcactccagcctgggcgacagagcaagactgtctcaaaacaaacaaacaaataaacaaacaaacagaaaaacaaacaacccgggaaaatggtactttgggaacaaggaccttggtcaacccaattccttattgaaggaaataacgtatacagtggtccatttcttttttttttttttttgagacggagtctttctctgtcgccaggcttgagtgctgtggcgtgatctcggctcactgcaaccaccgactccctggttcaagcgattctcctgcctcagcctcccaagtagctgggattacaggcatgcaccaccatgcccagaacatttttgtatttttagtagagatggggtttcacaatgctggccaggatggtctcaaactcctgacctcgtgattcacctgcctcgacctcccaaagtgcgtgctgggattacaggtgtgagccactgcacccagcctacagtggtccgtttctaagacaaaatgctttgaattggcttaggtcagcaacctacagaagaaacatgatacactaggtccctgcttggatagccagccaatgcctgcttgtcagcctcccccttccccaccttcgccccttagttgccttcacctgaaccaaagtagtttagtctaagatgaaagtttactagcctgcaaaatagcttgttttgtctgttcttagcctgcccagctacttaggtcataagtctaacacttgaagagcccctaagctaactaagattacaatgcattgtgggctgcaacaaaatgcagcaaaacgaccctaaaataaacaaaaaacaaaaaactcctggcgctcccacccaacaatcaacaggcgagaagtttatgaccccgtagtactcagcctatgaggaactgggggagggacctgtgcactaggggataaactgcttgttgaaagtgtgctgggtgtgcctgtcagacacctgatcttgcaagactgtcattaaaagtctcactttcactgttctccgggtctccgagtccattctttgggttgggatgggcgagactgtttctcacattatgaaaagctgaaggttaagtgaacttggggaatactgcctcctgctggctggatgtcatggaagcctggcccatcagcagagaatgataagctggagttctggagggtctgatttccaaggaatcacccccttggaagctcctctaatacaccctgatgagattaacctgattaggtccattgtttgataaaaagaggaggaagtttaatcacttccacattctttgcccacgactaaccctgattggatttggggctatggttcaaatgtatgaccgattgatttttttcacttcttctgttggacttttgaaaaaaagttctctgaaaaggaatttagaggaaagagacttattccagtgaacagttacagtttgcaaacccaacagacacaacttttggtacaaaaggaagttacattccagagaacaaggggaggctttgtcttttctagagaaaattcccgctcagaatcccactcaggtctgcttatgcaaatgaaagattcaaactttttagttctgattacttggctctagctgggttctgattagtcaaagcaggtcacagtctactggtggcgtaaacaggaacaggcagctatgtaagtcccaaagtttttccagaaactcaaagtatgtgtgtgacctctggtcagcaaataaccacttgtctcaaatttaaattcaggcccaggattcatcttgaggaattggctctttcagggttcagagaccaatcaaaatgtctatcagaatggatgtgttaaaaggcaaataatgggcagggcatggtggctcaagcctgtaatcccagtactttgggaggccgaggcaggtggatcacctgagctcaggagttcgagaccagcctcgccaacgtgatgaaaccccgtctctactaaaaatacaaaaaaaattagctgggcgtggtggtgtgcgcctgtaatcccagctacttgggaagctgaggcagaagaatctcttgaaccctgggggcggaggttgcagtgagccaagatcatgccactgcactccagcctgggtgataagagcaagactctgtctaaaaaaaaaaaaaacagcaaataacgttgtcctgtgccatgagccacatactcaaatatttacacaggtccaggggaagtaaagagtaaatatggccaccaggcgcggtggctcacgcctgtaatcccagcactttggcggctgaggcgggtggatcacgaggtcaggagatcgagaccatcctggctaacacggtgaaaccccgtctctactaaaaaatacaaaaaaattagccaggcgtggtggcgggcacctgtagtcccagctacttgggaagctgaggcaggagaatggtgtgaacccgggaggcggagcttgcagtgagccgagataatgccactgcactctagcctgggcgacagggtgagactgtctcaaaaaaaaaaaaaaaagagtaaatatggcctgatgtgaaaaaaaattataaccaccagaatttcctaaaatgtattttattgatctatagtgttattgcacaacatccacaaatatctatgatgacaattgtttaaaattcaagttaaaatacaaaatttaaaaaagtttacctacttttacgttgttaatttatgactctttgggtttgaaatgagatttgatgtcattgtatttatagatattccttgacttcttgtgttatgtaccaataagcacattgttaagttgaaaacatcataaataaaaaatgtgtagctgggccaggagctatggctcatgcctataatcccaacactttgggatgccgaggcaggaggatcacttgagctcaagagttcaagaccagcctgggcgacaaagcaagacccccatctccacaaaaaattaaaaaattagccagttgtggtgctgcatgcctggggtcccagctacttgggaggctgaggcaggaggatcatttgaacccaggatgtcgaggctgaagtgagctatgacggtgtcactatgctccagtctgggtaacataatgagaccttatttttaaaagaacacacaatgagtagctgagtagggctgcggctcactgccactgccagtgtttgaagaacagttcccactgaatgcatctcaattttgcactgtaatcaagtagaaaaactgtaagtccaatcattgtaagtctgggaccatcttgtccatagtcttatgacagaatactgtttaaaagtgtagatctatccgaatgttgatgaatttattgtgaaatgcttccccttgtgttgcttctatgtgatctatgtgcagcagtggacattttttttttaagtgaaaaacaaatcatgcccctcccttcattctctcccccgtgatgtttcccttagagaacattcctcccttcccttcccagtccccacctcagagatggggcaactcctccctttttatcacacttcttccactctgaggctctaggcaatcagttctcggtcactcccacccatgtgaaggtttttttttttttttttttttttgagttggagtctcgctctgtcgcctaggctggagtgcagtggtgcaatctcggctcactgcaagctccgcctcccgggttcacgccattctcctgcctcagcctcccgagtagctaggactacaggcacctgccaccacgcctggctaatttttttgtatttttagtagagatggggtttcaccatgttagccaggatggtctcgatctcctgacctcgtgatccgcctgccttggcctcccaaagtgctgggattataggcgtgagccatcgcgcctggccccgtatgaaggtttttgatgatgcttgctagaatggacccagataattttcgtgtggacagaaggtagatttttagtagctcttgttagaggtcatgtaggagattgtctcagcttgagctgctattgcaaataccgatactgtagactgggtggcttgaaaacaccagaaatgcattcctcagagttgtggaggctggatgtccaagataggacaggtctgagatcagggtgccagcatgcttcagttctggtaggaatcctcttccaggctacagactgccaacttctcgtgtcttcgtgtggcagaaaaagggctaaaaagatctctgggattttttttttttttttttgagacagagtctcactctgttgcccaggctggagtgtagtggtgtgagtggcatgatcttggtatactgcagtctccacctcccgggttcaggcaattttcgtgtctcagcctcccgagtagctgggactataggcgtgtgtgaccatgcccgactaattttggtatttttagtagagactgggtttcaccatgtttgccaggctggtcttgaactcttggcctgaagtcatgtgtctgccttggcctcccaaagtgctggggttgcaggcacgagccaccgtgcccagcagggcctcttttgtaaaggcactaatcccattcgtgaggttctgccctcatgacctaattacctcctacaggtcccatgtctgagcaccatcacactggcatttaggatttcagcttatgaattttgggaggacacaaacattcagttcataacagcattgtgttgtcacccacttttttttttttggtaggaacagtgtgtcgaactctggtctcaagtgatcctgctgcgtcagcctcccaaagctttgggattacaggcacgcactgccaaggccagccacatccatattcttaatctccaccatggcctcatgagcctggtcccctgtcagtgggctagggcctcgacatgggtaatacgcatattagctgaggttcaggaacccaactgacttgtgtaagaatttccagctggccccgcagaacaagaggctaaagagtggggagcagtgctagtgttgccactgctacagctctcgggcagtattcactaccctcatcctgtatgtgtgcccaggtgctgggtgagcatttcactccacacgagaggcatcatgcattccttcattcgttcgttcatgccgttatactatagtgaacaataaactcttgaggaatgtcgggtttaggggagccagtcccctgttcagttgaaaatctgcctggctatgtataaattttgactcccccaaaacttaactactaatagcctgctgttgactcgaagccttactgatgatatcaacagtcaattaacacatactttgaattttatacgtattatgtactgtatgcatttttttttctttgagatggagtctcactttgtggccctggttggagtgcagtggcaccatctctgctcactgcaacctcccagatttaagtgattctcctgcctcagcctcccaagtagctgggattacaggcatgtgccaccaagcctggttaatttttgtatttttagtagagatggggtttcaccatgttggccaggctagtctcaaactcctgacctcaagtgatccacctgcttcggcctcccaaagtgctgggattacaggcgtgagccactgcacccttcctgtactgtattcttataataaagtaagctagagaaaagaaaacgttattaagataatcttaaggaagataaaatctatttactattcattaggtagaaacagatggattatcctacaggaggaggaggaagaggagggggttggttttacagtctcaggggcgaaagaggcataagaaaatctgcaaataagtggacccacgaagttcaaattcctgttgttcacagttagtggtacacaggagacactaggtaagctaaaggttgggctgggcatggtggctcacacctgtaatctcagcactgtgggaggtcaaggcgggaggatcgcttgaggccaggagtttgagaccagcctggccaacatggtgaaatgctgtctctactaaaaatacaaaaagtagctgggcattgtggcatgtgcctgtaatcccagctacttgggaggctgaggcacaagaatcacttgaacctggaaggcagaggttgcagtgagccaaaatagtgccacttcactccagcctgggtgacagagtgagactgtctcaaaaaaaaacaaacaaaccaaaaagattagctaaaggttgaactttcagtgatgaactaaacagaaacaatctcatagagattgtggacaggagaagaaacaagcacaggtgcagttaaaacccgtgataaatgccccggcagaaacaagtgttaggccaggcgtgatggctcatgtctgtaatcccaacactgtgggaggccaagacaggaggactgcttgaggccgggggtttcaagcctgcagtgagctatgattacaccactgctctcctgcctgggcggtagagaccctgcttaaggaaaaaaaaaagaaaggctgggcgccgtggctcacgcctgtaatcccagcactttgggaggccgaggtgggcggattacgaggtcaggagatcgagacgatcctggctaacacagtgaaaccccgtctctactaaaaatacaaaaaaaattagcagggcgcggtggcaggcgcctgtagtcccagctactcgggaggctgaagcaggagaatggcgtgaacttgggaggtggagcttgcagtgagctgagattgcgccactgcactccagcctcggcgacagagcaagactctgtctcaaaaaacgaacaaacaaaaaaacaaaacaaaacaaaacaaaaacctaaaccaaaaccaaaacgcagcatagtccatgagagaggaagagcagggcaggcctactcacctggggctgtcggggaggctgcccaggaagggactctgaagtgagcacctggaggaaggaggttagttctgagggactggaattcatcctggcattgggatcacgggcaaaggtcctgtggtgacaaggagactggtgcgagcctggcttagcaccatgtgagagcagaggggtggaaaggcactaggtaagcatgccttcggatgtgaaatgagggagacggggactgggggaccctgacatgagggaggaggaaaggagatgggaagaatgggtgaccagagggaccactagaccaccgagggtgagagcttgctaatatcagagccatgtgtaggagaatgaagtgcaatcttggatagacctccagtgcaggtggtccagccatcaatgaccataaccacatgcatgattgtaggtggaaccagaagaaccacccaggcaactcacagaactggggaactaatcaagtcttgttttaaatgactacattacgggtggtttgccacgtagcagtggatcgctgaaacagtttaaaatatctattcagccgggcgtgcggtgggtagctcacacctgtaatcccagcattttaggaagctgaggcaggaggatctctcgaacgcaggaatttgagaccagccttgagcaaaatggcaagaccctgtctccacaaaaagtaaaaaaaattagctgggtgtggtagcatgtgcttgtagtcccagctacttgggaggctgggacaggagaattgtttgagcccaggagttcggaggctgcagtgagctgtgactgcaccgctacactccagcctggacaacagagtgaaaccttgtctctaaaaaaaaaaaaaaaatctacaaaccaggcaggagcactgaatagctcctgtctcccctgagacccttgtagaccttgaggtctgttacagagctcaccaaccttctcttggtctagaattatctaaaaagagttgagtgcagccagaaaggactgaatacatggtgttcttcaatcccatcaaactgctgtgccctgcagatgatccctgagtccaggtgttggtgggttgaggacaaggctgagggaacagaggtgggaacagtggcccaggaccaggagaatgcagagttcagagtgcatgacctgcatctaactctagatgctccaggggtctgagaccatctccagcagggtctggaaggcccagtcattccccagcacgcacagtcaccactggatactatcttgctctgtgagtgatgcaaaggtcctgggtcagtgaagcctgtgaaacaaagttgggaccagagtgtctctacggttgagggctgggcttatttgctctctaagtataattgtaagagcaaatagaaacacctatcctctctgagcttaaaaggatcaaaaagctctgacagtgtcagtggtagggctagttcaggggctgcagtagtgctggtgcccacaggtggaaccttctcctgccctgattcccaaggactggtgctctcggaggggtctgggaggtatatttctctttcacaaatacgtgcacaacacatgaatgagctactggatgagggaataaatgaatgaatgagtgaaaaaagcttcctttctcctctccaggagttagcaatcactggttagttccccactgcccaccagcctgtgcagaggagggaggagcaacaggtcatagatgtggttgcagctgttactggacagagtggtcaagacatcctgtgtctgcagaggccctccccagccctcacctggacagtggagctgttggccagagaggcagtgggaagaagggtggggctcccagagtcgacccagcgggctgaaactggtgcagtctgcgcctcaccaggcagagaatggatgtggggcagcttgacaccgagcaggggctcatctgagcctcaggggtggttgctctatcaaagtgtttgcaagtaaacagtcccagtgcacacccagctgctcagtgccacctcgtgcacccagggccacttcagccttgatcacaggcctgcacaggttccaggggaggagacactccagctttttgagggagggtgagcatgtgggatcagagactttaagtccaaatttccccttaatttttttttaaatcttgcaggtagtatgcaaacatacatttaatgtattatttttattctcatttatttttttgaggcagggtctccctctgttggccaggctggagggcagtggcgagatcttggcttgctgcagcctcaactcaacctcccaagctcaagtgattttcccacctcagcctcccaagtagttgggactgcaggtgcctgtccgccatgaccagctaatttttaaattttttttgtagagatggggttttgccatgttgctcaggctagactcgaactcctgagctcaagtgatcctcccaccttggcctcccaaagtgctgggattataggtgtgagacactgcatccggctcccaaatttcccctttttataaggacaccagttgtactgaccggggccccacctctatgacctcatctaaccttcattaactccttaaaggccctatctccaaatacaggcacactgggggttagggcttcaacctatggatttgggggatgcaattcagtctatcacagtgccaagctgcacctgctcggtgagccagaacaggggtggggaaggcaccaggccctggtgcttctttcccatgcctgagtcactctacttggttctaggagggagaggagcatgggctgaaggcagtgctgcaacatggaaggggcagaacatcccaacccgctctgggcccccagtgtcttctgctgtacaaagcaggtgttttcaccccccgaggatgtgtcctcccttcctggctcaccaagcatttaaatgtagacagaaaatttatttatctggggtgcggtttcctcagggggaagttgaggtcacgacccctgaggtaccttaacccaaaggcctccagggcactggccccagagtctccagcaggtgcttcctccctgaatgcttccatatggcaagatcagagccacaaatgctgccccgacactgttccggtaaccgacgttgcagacccaagaaagtctgggatggtagtggccaggaacggggtgtgccacggccccacctctcagagcagggaggaggatgctgggccagcccttggggaccccaggcaccgtggccacaggagtcagagctctgcatgtctgcaccatgtcctgggctcctgtcctgctcatgctgtttgtctactgcacaggtgagggaacccccagatcccaaagactcctgccccttccttcatcctgccctgcccccacggcccacatgcatctgtgtcaccaggttgtggtcctcagccggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtgggaggaagaaatggaacccactgcagccaggacacgtgtcccttgaactgaagacagcagaggcacgcatccccttggagagactgtcatggaagagggtggagccgccgcccgaagcgccgaggaggctgagccactcagcatctcctggtcctgcagtgttgctgtaaatccccattggagactgcattagggaattaaagctgcttgtcactttttgctgagtttggtctgactgttgtgcgacttcgtagtaccagccttgggcaaaggcccggggccccgggagactggcagatcactgtggtgagcactcacctgagtccttacttttgtgggccatgggaggcaaggggttgaccgaagcaccctggaggggcatccatgcccaggacaggaccctctggtgtcatctgattctgcccagcggttacagggcaaacaagcttagaaagcacctggtctgggcctccagggagaacaggagccaggtaataggcctagagtgggttctccaccttggtcctatcgacgttttgggctggacagttcttggttgtggggctgtcctgcggattgttgaatggtgagtggttatctgtggcctctacccaccagatgccccttcccagttgtgacaaacaaaaatgtctccagacattgccaaatgtccccaggtggtaaactcacactgattgtgaaccactggtctagatgagcaagtaaatgcatttacttatttgtacaagagagtggcaggtgtcggcaaacatgttctttttttcctttttttagggataaagtcttgctctgtggtccaggctggagtgcagtggtgcaatcatagctcaccgcagcttcaaactcccaggctcaagtgattgtcctgtctcagcctcctgagcagctgagactacaggcgtgcatcaccatgcttggctatttatttagttttatttttggagagatgaatgtctcactatgttgctcaagctgatctcaaactcctgagctcgagtgatccccctgcttgggcctcctaaagtgctgggattagaggcgtgagccactgcacccagcccattttctataaagagccaggtggtaaatatttttggctttgtgggctatgcgatctctgtcacaactgttcaattctgtcctagtagcaagaaagcagccacagacaaacatgtcaacaaagaggcgtggctgtgttcttataaagctgtatttacagaaacagatggggctacactgggctgggtatggcgcccaggctgtagtttgctgagccctgctcgggagcactccagctcctgtctccaggttttaagcaagccatgcttggtgggataatcagagtcccccctcaacttatcttgcctgtgaccccaggcagaagcctctggacccatggagatacctagaggcatgaaggacgtggtctcactgagactgtgttggactgtctgggtgaagtagcaatggggagctccctgcagccccggcccacagcaaggccccctgagcccgtgggtggtgggtctgagtgtgccttgcagagagggactctctacactgggtgtccacacaacctgtagacatgcctcactcagagaggtgccgggcaaaccatctcccttgtaaccccaacttgcctgggaacgtgcattcaccccagctaaaaagatcctgaggcatctccccagagaggtggacacatgtcagtatcagcgttccatgtgtggtcatgagtccctctcttgttaaacagtggtctccagcactttgggaggccgaggcgggtggatcacctgaggtcaggagttagagaccagcctacccaacatggtgaaatctcatctctactaaaaatacaaaaattagctgggtgtgttggcacatgcccgtaatcccagctacttgggaggctgaggcaggagaattgcttgaacccaggaggcagaggttgcagtgagccgagatcatgccactgcactccagcctgggtgacagagcgagactccatctcacaaaaaaaaaaaaaaaaaaaaaagagacagtgatctcagcttatgccatactctatgcactgggttcttcctgcgtcaggcttttacccctgggccaggcccacattttaaaacattattatttacttgtttattattttattttagagataggatcttgctatgctgcccaggctggactgctgtggctattcacaggttcaattcatgatgctctacagccttgaactcctgggctccagcgatcctcctgtctcagcctgctgagtggctgaactacacgtgtgagtcactgcacctggccatggcccacagttttaaagaccagctagatggttccagaggaactctgtcttctgcttgtaacccgtccctctcttgcctccatccttcatgattctgggattccatgctatgagaagagatctagaaagccgggagctgagttggactcctgtatcatcctcatgcccccaccccaccagctcaatggaaaatgagacctggaactcaggcttgaggccagactgagtgtgagtcttagctctggaggagtcacttaaaatctaagccaacatttccaatgttgcatgtaaaggggataatcatagaactgattaacttatataaaaagtttttatctggccaggcgtggtggctcatgcctgtaatcccagcactttgggaggccgaggcgggcagatcacctaaggtcaggagtttgaggccatcctgggcaacatggtgaaaccccgtctctaccaaaaatacaaaaattagctgggcatggtggcgggtgcctctgatcccagctacttgggaggctaaggcagaagaattgcttgaacctgggaggcggaggttgtagtgaaccgaaatcgcaccacatcactccagcctgggtgacagagcaagactgtctctcaaaaacaaacaaacaaacaaacaaaaaggttttatccatcatgagtgctcaacaaaataatagtatcatgatttccccatcagtcacctgcctggccttccctgttgtcaaatcctttcctttagtctgagtcatttctcaccttgaccattatctggtctccttcccatccatcctcctgctgcatgcagtctatacccaccactcctcatctttgttgctcctagatccagccttgcatgcattcctcctctctaaccctttattgtctcccacactctaaagaacatatgcaagccacatctgtaatttccaattttctagtggctacattatttttaaacagtaaaaacaaatagatgaaatgattttttaatgatatattctatttaacataataaatccccaatattaccaattcaacctataatcaatataaaaattagttactagatagtttaaacttgtttttcttttgtattcacacttcaaaatctggtatgtattttatattcatgtcttggataatttgctcaagtggataatctggtcagccaagtggtcaagagctacatatgccttgtgaagagaccactttggttgaggggatgcaattcagcctccttcccatgacacagcctttgaaggctggctcaggcttggtcccaagtcccatttcttgtgcaccctctctccctgtttctgccatgttaagccaactgcaactgatcaaacacccgagtctcttggttgcttctaaacctttgcccaagctgtttactgccaggacttcctgtccctttgttgtggcctccatctggctgcactgactcggggctccacaactgtctcaaatctcactccttgggcaagacttccccgagctcttcatgcagttattaacttcctccactgtgcaaacagcatgttttcctaactatatttagcttctactgcacagttataaatttatttagcaaagctccctcccctactaatctgcagattctcagtgggcaggatctactcaacccattgatgtgcctgataaacacttggcaattagacagttgaatgaacaaatgaatgaatgtgtaactgaatgaattttcgggttccaaggaccctgacattctgggatcccattaggtggctggggtcaccaccttagagaattgtgattccctaagaagggagaaccagcccagaccttctcgatcatattagtgactggccacatttcctctcctttctgattctctctctcccccacacccttactgcatgacagtgatgagaaaatccacttgatcaaccaaactacaactttcggcctcatccctatccctcccttgccttctgaccagggccacagtcaccctgtgggttcttccttttgagtgtctctcactcccttcctcctccatatctctgagaccagcctccagccctgctggcctgctctgctgccttctggctctttgttgaacccaagaccagggtttatatatgttaaatataaatatatttttccatatgaaatgtaaacatattttaaacattaaatataaatatacatcttagatatggcctgtgttggaatgtgtaatagattgagtatataatgtctattcaatataaaatttatatttatatatgcagtaatgattcaggttgattgtagttaagaaaaacaagctccaaattcgagagaaatatgtaagaagagagacaggaagaaaaaataatgaggcaggtaaatgcaacagacaattcgagacccacaagtgcagagcaggcttcccagacccggataatgtctcctgggctgataggaagccctcaaccccccaagtccttctcagccataaaccgcctgagcacagagccacagggaccgtgttggggctgggcctctcgactttagttcctctcattctgtgcaaaaggaaaaacaattcagaatctacagaggtttagatgtgtgtagatgtggacagagaagtcctggcacggtggttcactgcccaagaagacagtgagtccctggagggatagaagaatatacatcatgctaatatatgtcatcccagtactttgggaggccgaggcgggtggatcacttgaggtcaagagttcgagaccagcctggccaacatggtgaatccccgtctctactaaaaatacagaaattagttggctgtgggggtcgatgcctgtgatcccagatactcgggagacagaggcaggacgaactgcttgaacctgggaggaggaggttgcagtgagctgagatcatgccattgtactccagcctgggggacagagcaagatcccatctcaaagaaaaaagaaaaagaagttgtgagtgctaagttctctctggattttcaggaggccagttctccagtccacagtggcctgggaggacaggggttcctgagggtgaacagagcctgtgcccggtcaggtaggatcgcatgtccctgaggttcagaacccaggagcatggggagggtccagggggttcctgctgcatggagggaagaccctctttccacaggggccccggagagcgagaggaaggaggagggcaggtcagtgagtgtgacggggtcacagtggagagggaagcagaaagaagtgtccccacaacaagacacacacagtgtctacgctgaagctacagagagggcctctccacctgtgtctgccgcaaagcagtggggcgtcttctggcagcccagagtcacctccagatcccacctgcaccatgcttcctgcagggactgcctgtcttcctaatacactgtcttctgaccagagtcttccagacaaatcactggttgctatatatatatatatatatatttttaatagctaatatcttacactgatatatttatattatatataaatatttttgtactttatgtttaggctatattacagatgtagttagttagctatttatgttatatataatataaacatgatgtagattcttatatttctctggggactcactgtcttcttaatacactgtcttctgaccaaattcttccagacaaatcagctgttgctatatatatatatatatgtgctatatatatatgtgctatatatatatgtgctatatattttattgcatagaatatattatatattaattatataatatacattatacattacatattatatataatatattatattattatgctatatcttatatattatatatgttatatatgtatatatattatatatacacatacatacactcatgtatattttaatagctaatatcttacactggtatatttatattacatatgtttatatacaaatatttttgtactttatgtttatgctatatatacagatgtaattagttgtttatgttatatgtaatataaacatgatgtatattcttattttcctgtgaggacccactgtcttcttaatacactgtcttctgaccaatgtcttccacacaaatcagctgttactatatatatatataatatttatatacacatatacacatacatacacacatatgtatattttaatagctaatatcttacactgatatatttatattacatatagttatatactaatatttttgtactttatgtttatactatatatacagatgtcgttaggtatttatgttatatataatatattaacatgatgtatattcttatattcttctggggactcactgtcttcttaatacactgtcttctgaccagaatattccagacaaatcactggttgctatatatatatttttaatagctaatatcttacactgatgtatttatattacatatagttatatacaaatatttttgtacttttgtttatactatatatacagatgtagttagctatttatgttatatataatatatcaacatgatgtatattcttatattcctctggggactcacagtcttcttaatacactgtcttctgaccaaactcttccagacaaatcagctgttgcaatatatatatatatatatatatttattttttaatagctagtatcttacactgtggctcatgcctgtaatcccagcactttgggagaccaaggcaggtggatcacctgaggtcaggagtttgagaccatcctggctaacacagtgaaactgcatctctactaaaaatacaaaaattgattgggtgtggtggtgcatgcctgtaatcccagctactcgggaggctgaggcaggagaatcgcttgaacccaggaggcagacgttgcagtgagccaagatcgtgtcgctgcactccagcctgggcaacagagtgagactccatctcacacacacaaaacatcttacactgatgtatttacattacgtgtagctgtatataaatatttttgtacttacattctgtgtacttatattctatatattataaaacattatataaaattatacatgtataataaaatgttacataaaaattttaatataataccattttactacatatatttctaaatttaatataatgaaattttatatataataatgtataacatttctaaacttattataatacaatgatatataattattttctcatattataattatacataaggtaatttattgtaaataaaattttatataatctacgtttattataataaaattttattacatataacacatttctaaatttaatacaataaaatactatgtataataatttataacatttcaaaatttattatataattttattatacaattattttatacataattatatatagtatataattgtatttatagaaatataattatgcatatacaatatgtaattttatttttacatagtatatatacataattatgtattaacaaatataataatatcaatttatatacttatttacattaagttatatattatataaatgatgttatatgttatatgttacatatatttttgcttaatatattaaatttaatctataaaattatgtattacaaataaaagtgtattttacatatacactacatataactttatttatataaaaatataaaagtcatatggttaagttaataaaatatatttatatcaatctattcatataaaatatacacaatgcatatttatataaatacaaagtatataaaacttttaccagtaggatgcaaagagttgctgaccgtctgcagaaatcctgaacctctggaagcagaataaaatcttacctcccagtctgctttgaaaggaacagtaaagcagtcccgaaccccaaacccatcctaaggggagatgggggagttgggatggacgcgttgaccagtgaggactttcctttgctggttttgaggtgtcttagcccagaagctaagacgggaagtgattctggagcaggtgagctgatcacaagcctgagccaagaatccatggagctcataaatagcagaagccgggaccctgtgcaaatccttctgaaatatcccccgtttactgggctcctaggggtggggaagaaaaattccctgacatttcggcctcagggaaagagagagagaccccactggccggaagcctctgctatttttcagaagacagctggggcatcactctttcccaaatgacggtgattttcagagtggttcactttttggagagacatttctgccctggagatccatacatattgaacccaaacgaatattttttaattaaaaaaaattaaacattagaaagttcaatattgaggcagctacgagtttgaattcctcatttttcctagatgcatgttgtcaaaatctgtattgcatttagtaactacttatgtgtctaatgtatataaggttacacaatgtttttttctgctcctcagggtcagaatttgaaataaaagttttggaaagaaaaaacactcttgtctgtttgtgcaaaaataaaagaacccatattttaagaatattttaaaataaatacaaattttgtgtgggagggttgcttataagaattcttcatatcctaaatcaaagacagatcttgttattaaccagaaaacaaaatgtgtgtgtataaatgtacaacactcttacactcacacaaacacaggcacacacacacattcacgcactcactgatgtactcacacaaacacaggcattcatgtataaatacacacataagcgtgtatttatagaaatataattacacacatacaatatataattttatttttacatagtatatacacatcattatgtattaacaaatataataagatcaattttattatatacttatttacataaagttatatattatataaatgatgttatatggcatgtatatatcacatataactttgcttagtatataaaatttaatctataaaattatgtattacaaataaaagtatattttacatataaactatatataactttatttatatgaactataaaaatcatatgtttataataaaatatatttatttatatcaatatattaatataaagtatacacaatgtatatttatacaaaaatttttaattaaaaaatattcatttgggttcaatatgtatggatcgccagggcagaaacgtctcttcaaaaggtgagccgttctcaaaatcaccgtcacttgggaaagagtgatgccccacctgttttctgagaaacagcagaggccagtggggtgtctctctctttctctgaggccgaaatgtcagggaatttttcttccccaccactaggagctctgtaaaccggggatatttcagaaggatttgcacagggtcccggcttctgttgtaaatgagctccatggattctcggctcaggcttgtgatcagctcacctgctccagaatcactgacacaaatgcaaccacacacttacacaaacacacatcaacaccaagacagacagaagcacaaaacacactcatagaaacacatggacacacaaagacatgcacactcacacaaacgcagggacacacacacaaacacaattacaaaaatgtggggtttttttgcacacgtgggtgcacatgcacattgacatgctcacaaagcacacaaacacgtatacatacaaagacactcataaacagaatcatgaaaacactctcatataaacacgtggatggctactcacccacatagacactcacatatgtcacacgcactcatacacacactcagaatcacacaagcacacacaaacacacaaatacagtcacacactcatgcaaacacagtcacaaaaagactcacataatcatgtggacacacaaacataaaaattcacacactggggccgggcaaggtggctcacgcctgtactcccagaactttgggaggccgaggcgggcagataacttgaggtcgggagttccagaccagcctggccaacatggtgaaaccccgtctctactcaaaaatacaaaaattagccagatgtggtggcgtatacctgtaatcccagctactcaggaggctgaggcaggagaatcatttgaacccgggaggcagaggttgcagtgagccaagatcacgccactgcactccagcctgggcgacagagcgagactccgtatcaaaaaagaaaaattagccagatgtggtggtgggtgcctgtaatcccagttactcaggaggctgaggcagaagaatcttttgaacctgggaggcggaggttgctttgagctgagattgtgcctttgcactccagtatgggtgacagagcgagactccatctcaaaaaaacaaaaaaaaagaatttatacattgccatacagattcacagacatacactcatattcacaaacacacaaatacgataaacgcaggggcacacacaaacaccatcacaaaaacacacttccataaaacacaggaatgcacgctcacacagaaacacgcatggaaacacacgttatcttacagattcacagacacactcatcatcacataaacaggcacacacacacagccacacaagcacacacccacacccacatcaacacacacactcccacacggcacccacgcgctcacgcacataggtagaacaggcctgcattacctgataacgcagttagatcagacgtgatgctgcctgccgaggagacctggaggcttcccatgaatgggctttcggatgagaggtctctgggtgcatttggtgacaccccaggcagtgggggagacgtccaggctggaaggccagccacagccagctctgcccaaggatgccacgtccatttgcttcagtaggatatgcaccctggaaacccaggttcctgcctctccaggaaaccccactgaggtcagcacatcccccaaggtttagaaggggtctctgggtgcatttggtgacaccccaggcagtgggggggacatccagcctggaaggccagccacagccagctctgcccatggatgccacgtccagttgcttcagtaggatctgcatcctgtaaaccctggttcctgcctctccaggacacgccattaaggtaagcacactccccaggtttagaaggggtctctcggtgaaatgtggtgacaccccaggcagaaggggggacgccacagccagttctgcccacggatgtcacgtccatttgcttcagtaggatctgcaccttggaaacccaggttcctgcctctccaggacaccccactgacgttaacacaccctccaggtttacaagcggtctctgggtacatttggtgacaccgcaggcagaggggggacgccacagccagctctgcccgcggatgccgcgtccatttgcttcagtaggatctgcaccctgtaaaccctggttcctccctctctaggacaccccactgaggtcagcagcccccaccccccacccccaggtttgtccagcttcgctgtctggggagagacacagaaagaccacattcggtggaattctggctataaccttttgtagccggcaagaaggatcaccaagctgtcccgttaccttgctggagcgatcactggtttcacgcttggcccccgtgcagttagtgcctgggccaggctcgattcctggagctcaggtgaaatttgggcttggagctcacgcctgcaccatccagaaagcagaaggcagccggcccgggctgtacggttcgtagaatcagagagaacactgcttgccttcatgtctgtaccacaataaatctgccaactgcggtcaaagtctctggattcctgccccctcattttattttgtctattacggagtggaaggagtgagaaagattttgcttcctattttgttttgcaaagcgcttctaagaaaaacaacccgtgttctgaaaacgagattctgagtgtcccctgggcgcgatgaaaacaaactttgggaatccaagggcctgagaggcagagtgaatgtcatttgcatttccctgcgaatgacaaagtcactttttatttattattattattatagattcaggggatccacgggcagctttgtgacctggggatattgtatgatgctgaggtttggggtatgaatcatcccgtcacccaggcactgagcattgtacattcctgaggtatataatgtgtactaaaaataaaatgtatatttatatatgcactaatgattcaacttgattcctcgtaattaagaaaaacaaaccccaaattctagaggagttctagaaatatataagaagagggccaggcgcagtggctcatgcctgtaatcctagcactttgggaggccgaggcagacagatcacctgaggtcaggagttcgagaccagcctggccaacatggtgaaaccccgtctctgctaaaaatacaaaaattagccaggcgtggtggcaagtgcctgtagtcccagctacttgggaggctgaggtagaagaattgcttgaatccaggaggcagaagttgcagggagccgagactgcaccactgcactccagcctgggtcacagagcgagactccatctcaaaaaaaaaaaaaaaaaaaaaaaaaaaaaaaaaaaaagagagagagagaaaacaaacaagcaagaaaatgcaacagaaaaatccgtgacccaaagctctctccagttgctgctttctgccggaaattcaaagaacctcagggtagtttttcaacccttgtacccccgcccctgcttcctgctctattagtcctgagggtctgtggtgccgctccatcatgtccaggtgcaggcaatgtttagctcccacctataagcgagaacatgtggtatttgattttctgttcctggcattaattcactaagcatagtgccctttggcttcatccatgttgatgcaaagggcatgattttattcttgttcatggctctgtagtattccatgatgcggaaggaccacatttgttttatctaattgagaacatgtggtatttgattttctgtttctggcattaattctctaaacataatgcccttcggcttcatccatgttgatgcaaagggcgtgattttattcttgttcatggctgtgtagtattccatgatgtggaaggaccacattttctttatctagtggagaacatgcggtatttgattttctgttcctcgtattgattcactaagcataatgccctctggctgcatccatgtggctgcaaagacatgattttatttttttcatcactgtgtagtattccgtggtgtaggagggccacatttgctttatccagttgagaacatgtagtatttcattttctgttcctggcattaattcactacgcataatgtccttcagctgcatccatgtggctgcaaaggacatgatattattctttttcatggctgtgtagtattccatgatgcagaaagaccacatttgctttatctagtggagaacatgtggtattcgattttcttttcctggcgttaattcactaagcataattcccttcagctgtgtccatgtggctgcaaagatgtgattttattctttttcatggctgtgcagtattccatggcatagaagggccacaattgctttatccagtcaagaacatgtggtatttgattttctgttcttgtgttaattcattaagcataatgccctccagctacatccatgtggctgcaaaggacatgattttattctttttcatggctgtgtagtattcgatgctgtagaagaaccacttttgctttatccggtaccccactgatgggcaactaggttgattccatgactttcctattgtaagtcgtgctgtgatgaaccttacagggctgggcactgtaatcccagcactctggagggccgaggtgggcagatcacctgaggtcaggagttcgagaccagcctggtcaacatggtgaaaccccatctctactaaaaatacaaaaattagccaggcatggtggcgcatgcctgtaatcccagctgctcaggaggctgaggcaggagaatcacttgaaccaggaggcggaggttgcagtgagccgagattgcgactgcactccagcatgggcaatagagcgagactccgtctcaaaaaacaaaaacaaacaaacaaaaaaaaaaaggaagtttaccatgcatgtgtctttttggtagaatgacttcttttcctttgggtagatgcccagtcttggaattgctggcgcaaatggtggagcagtttagattcaggaggtacatgtacaggtttcttacatgggtacgatgtgtgatgctgaggtctggggtatgagtgatcccatcacccaagtagtgagcataataccccacagttggttttttcaactcttgtccttctaccttcctctctccccctaactagaccccagtatctcttcccttctctgtgtctacgtatacacaacatttagctcccacttataagtgagaacacgcagcattctgttaatttacttaagataatggcctccacactgttcacaatagcaaagatgtggaaccaacccaaatgctcatcagtgatagattggataaagaaaatgtagcacatagacactgtggaatactatgcagccatgaaaaaggatgagttcatgtcctttgcagggacatggatgaagctggaaaccctcatgttcagcaaagtgacacaggaacagaaaaccaaacactgcatgttctcactcataagtgggaagtgaacaatgagaacacatcgacccagagaggggaacatcacacactggggcctgttgcaggagggggggactggaggagggacagcattatgagaaatatctaatgtagatgatgggttgataggtgcagcaaaccgctatggcacatgtatatctatgtaacaaccctgcatgttctgcacatataccccagaacttaaagtagaatagaaaaaataaaaaataataaaaataattaaaaaagataatggcctccagctacatccgtgttgctgaaaaaaaaaaacaccaaaaacatgattttgttccttttcagggttgtgtagtattccatggtgtagatgtacggcattttctcgagggtggagggtgggaggagggagaagatcagcaaaaacaacctgtggctgggtgtggcagctcacacctgtattctcagcactttgggaggctgaggtgggtggatcacctgaggtcaggagtttgagatcagcctggccaacatggcaaaactctatctctactaaaagtacaaaaattagacaggcacggtggtgcacgcctgtaatcctggctcctctgtaggttgaggcaggaaaatctcttgaacccaagaggcggacattgcagtgagccgagatcatgccactgccctccagcctgggccacagagtgggactccatctcaaaaaataatcataaaaataataataataacctgctaggcttaggacctaggttgattccattacaaaaaaaaaagaaaaaagaaaaaactaactttttaaaagaaggatctccctgttcaaaaacaaaaccaatgccctgtcaggaaagatgttctgtgtttctggtaaagctggaaggaacctacaggaaggagtcaccccataaaactagtggagcagcattgccttttggggtgagggctgcttctgttaggccaccaggatgagtaccttcctggggagtgtggttcatcctataccatccaggaagcaattcctgcccccaaatcacccgccagcttctgccctgtaagtaaaatccccagcaagcgggcagcaaggagctacttgccttggaaggcagccgaagtctctgtccaccacccagactgtgtcctctgggcaaggccagggcttccaattggatggttttcacattagcggctgctgtttagaatcatcaacattggccaggcgcggtggctcacgcctgtcatctcagcactttgggaagctgaggcgggcggatcacaaggtcagggaccagcctggccaacatggtgaaaccctgtctcaactaaaaaaaaaatacaaaaattagcttggtgtggctgggcatggtggctcatccctgtaatcccagcactttgggaggccgaggcgggcggatcatgaggtcaggagatcaacaccatcctggctaacacggtgaaaccccgtctctactaaaaatacaaaaaattagccaggcacggtggcaggcacctgcagtcccagctactcgtgaggctgaggcaggagaatggcgtgaacctgagaggcagggtttgcagtgagcccagattgcaccactgcactccagcctgggtgatatagagtgagactctgtctcaaaaaaaataaaaaaataaaaaattagcctggtgtggtggtcggcacctgtaatcccagctactcaggaggctgaggcaggagaattgcttggaccccggaggcagaggttgcagtgagccgagatcgcgccattgcactccagcctagacaacagagcaagactctgttgcaaaaaaaaaaaaaaaaaaaaagaatcatcaacattgccttggcccaatctcttgtcaaatatttaccactggacctccatgttctagtttcaaagctctgctggccacagtggctcatgtctgtaatcccagcactttgggaggctgaggtaggaggactgcttgaacccaggagcatgaatccatcctaggcaacatagtgataatagtgtcaaatcagagccagtgtctggtaattccccaaatatctgagaattttcttttctttaagtcatagtcatcctggcagaaggctgtaggtccctttggggaagactgggaaaaagataaacaatgtaaatttttggcaatgtagcagcgtacttccccaagatcacccagcctccccttcacttaaggggttgtgggcctgtgaactggctcaagtctgggaattgattgagggttttagatctgtgtttcattaatttgagttagtcttttattcagttgacctagaattcttcattttttaaagaacaactaagactttggtacagcccattagctctccctgtggataccatggattacacaatgccgtgggtgtctgtgagtcaaaccattctgactgctgctttgacactgctttccactgtggtgaccacacccaccttatcttcggtgattaaggacagcccatgttccctgccaccctaggattcaattatcctcattttacttaaagatcccagtccagtggctgcagttcctgctgtaacattttgcctactgagagcacaagctcaaagctcttccaggatactgggctcctctcacaatattctttctcatgatcgtcgtgaggagtatgttctgtagaccctccagtgtgagtgagcaggtctgacataataaatccagtctccgtgagtttttgcatacctttctgtacacataaaccaaggaagttgtggcatctcaactttatgtaccttaggtaaactctgattctgtttcagccaaccaaccaagtcaccaaacaaataagcaaacagccaaccaatcaaccaacaagcaagcaacaaaccaaccaaacaaccaagcaaggaagcaagcaccaagcaagcaagcaaccaaccaaccaagtaaccgatcaaaccaacccttggagccctttctaaagctttgacttacaaccctgagtccagaatctctgtttagtgggccaacattaataaatgtagccgaatccaactttatgttacttccaccatggtgccactcacttaatatccattcccacgtatattctccagatttccttctgtataaattgcgtgtgtgtgtgtgcgggtgtatgtgtgtagaaagagagcatcaactgaaaaatcacaaaattttataaatttagaaaagagagctttatttcttataaaggtttgcagtccgcaaggtggccattatgacaggctgggaagtgtggcctacagccaaggccagaggcaggcatttccagggagggaaggagaggacaggaatttgagccaaatgagttggctacatatacatactcaataggatatcagaggagctacatcattttatgagaatactcataaaagaggtcctaacgcatgcatattcaataaacatgcatgttcattctggggtggagacttgacatttaaatgtattataattaggccctacacatcaaaaagtgaagcagggacataaaggtactcagcctctgtaaaggctcagcctctgtaaaggcacagcctctaaaactggccagaaccagtccatggaggatggtctcttatcaggagaaagttactgaaatcagtcccttgtccagagaaagctgtcgttaaggttagtggggcaggagatcagttactcagcgtctgtgaactgggtgagttgtaattgttttaatcttgcttctctcacagccagtgcttgcttggctgctagagaaaaataaaacccatgtggtagttagaatctagttaattctttaagagtagggtacaagacttaaccctcgcctggcatggccctaggccctgtttataatttgaggtcttattgccacaaagagtctgttctgtcagtctcatgatctctattttaacattaatgctgctcagttgttgggtctaaaccataagagggagggaggtacagggaggtatgtctgacctcctgtcctgtcatggccgagaactgaattttaagatttatttgaggttccgttggccaacagggggtctgttaagtcgggtggggggcttaggattttattttttgttctcaagggagataaaataatttaatccattggcctctgtgactgtgggactaacatggctatgatctgtcggacagacttcaggctggcacccaggcaaaattctatgctgtagtaaatgcatcatgcacatttgtaacaacacgtacataacaatgtcacaaaatactttcacggtgacaactagattagtgttttattgaatagctgatgacataaactgtctcatttggtgccaagactgaccatcaccagcataccaaggtcatcactgatcagaggtctaacccaaggagggggtcatgtgcaggcccagcggtggggaggaaagatgctgcagaggagatggatgcccacagaggcccctgagcggataccatgctcactaagtggtaagtatagactcaacgtaggctgtaagctctccccctgtgtaaatgggaccccgtacacttgagagtcaagggtctgtttgggtggcagggatagccacttctgaaggtagaaaggaaaataagccaccaaattggtacctttctgtgaaatggacatcgtgctcagaatctccattttccccacaacctggaggagtaagtactgtcatctgcattttgtagctgaggaatctgactcaacaaaattaaattactcgcctaagcaattagcaatcaaccaagtctttctgactcagaaacccagctattgcctgttcatatccagcccctgtattggggtcaagatctggcctgttctcaatgcagcaagatccaggcagatcacactggactcccagcactgaatctggctcgaggggacatcaaatttgactgggtcatggggctcaggagcatcactctcaaaaatagcagtacaggaagaggcaatggccctaaacagcatttgcaggcagatcccatgttaatcgtaagggtcaggactctctcacttttctgtctctctctctgtctctcctctagggctgaccccacatcggacaccactgcatccatgtccatcacaacacagctgccttttcttctgcctgcttatgggaaagtcccctcctctcctccgtttccttctcttcctgccctatcacactgtgcacttctccctttccttaaagaaccaccatcaactttaggaggagggaaaggggtggctctgggaggaaaagccagaatcccctctagccagcagagagagaggaatggctgcatgttttctcccccaatccaaggcactaggttttggctaggttgcaggttccaagctgctctcctgctgtgtcggtgagttctggttaacctgcaacctcctgatgtggccactgcagttcatcgagtcttcagggactccccatggcctggagtactttgccttgcttacatgggagaggagaatggatttatagagaacatcatctaaatccaacttgaccattgtgtggccacacttgctagattgctatagtctaaatctagcattgtagaaagacgggggagcttggagctgcacaaacccaggtctggaacgggctccttaccttggaaggtgaatgatcctggtaggactcttagcctccctgggcctcagtttctttatctgtttcatgggaatgaggatctcggctggttggttgggtgatgcgggggctgtgtgaaaacagcttgtcaatacaagctgaaatagaaatatttctccacagagtatgaagatcaaatgagagaatacatttaaattaaatggaaaattaaaatggcaaaaaaggcaaagctgtattgaaagttccgagcttctctataaggagctttttgactatgtaagaatcctgtactcgttccccctaaatataaaaaaaaaatgttgaaggaggcagaagggagagtgatgcacgatgggcgaggacttcacctgctgttgctggctttgaggatggaggaaggaggccacaaacctagaagctggagcccctagaagctagaaaaggcagggacccgattcatcccttgagcctccagaagggacatagccctgccagcaccttgactttagcccagtgagatcctcttaggacttttggcaaccagaactataagacagaaatggaagccactgagtctgtagctgtttgttgcagcagcaatagaaaactaatgcagagcccaagaaatcactggtgatgagatggggaagtgggctcaggaggtctggatctgtgatgagatggggaaagtgggctcaggaggtctggatctgtgatgagatgggggaagtgggctcaggaggtctggatctgagttggggatctggagtggaaggggaattcatttgttcattgtctatccttttgcattaattgaatttttttctatacatacatgtgaattttcacaataaaagttttttccaaaataaaataaaagaaacaaaaggggctttttgcaacccaattcctatctatgtctgagtccacttgtattgaatgagtctttctgctaacgtccttatatttgggtgactatctgaatgtcagtgaccaatcagagcagaggcagaccttggagtgggcagggcatcctgagggccctgattcctgccataaggcataaccctttaggtgccagaccatggggaggtccaggggttgcaggggagggctgtgcatctgcaatggctctcagggggctcccggtggtggcaattggtgaatctgcatggtggtgtttcagtattgtcacaaccctgctgtctctcatgctctcaaaaagcatttctcttacctgtgacagacttcctatacctaacagcttgcaaaaatgttccagattaatgagaataatctctcggagccatacctccctgcttggggtctcagtttccccaaatgtctccagacaagttaggctagaaggcccctgagtctcagcccctctatagccctcctgtcacccagacctgatctgggtcttgcaccctgggtgcagcatgacaggggtgggcaggggctggctctgggccagaggaccctttctgatggacttcagctgttggccttccaggggagactgatcaacctcacaagagtcatatggtgagtagcggtgggcaaatccatccccctcatcttagatttatggggagacagagacaaagaggagacactccaggaagacctgcaggtgggagtaccaggttgaaaccaaggacaccttcctggaggagctgccgtttgagccagctctgagaacaggtggagacaggactggagaggaggaggttgtgccctatgagcaaagactggccaccaccccatctaacacccccacagggcccctgtggcatccctgtccagtccctgtcaccacccagtttttccctctggacccaggaattcaaagtaagcaaggaggtccgctgctccagttggctgcaaataattacaaccttgagcccaagcagcactttgggtcctggtttgggaccatgaagcggctcggtgagactgagaggtaaggccagggcaggaattgggatagtaggattgaactctccctgggggccagcctcagaaagcctgtggccatggcctcttggccaacatcagatcctgtggtctggcaatgcctggggtacccagacctcactctggacaggccctgggagggggccctggtgagattcctggcagcctcacagccactcttctgtccatagctacaacctgtcatgccagctggaggctccatcccagttggctgggagcataaagtccaggaagatagacatcacccaccacaggggccagtcagggcctgaaccagggcgggcagaggttggctgccttgggatatgggtgggctcagggagtcagacagcaagggactagcctcccatcctactgctgagcagccctgtgactggggagagtcaccttacttctctgggcctcagtttccccctctgtggagtgacactaaatgatctctctggagacggggatcaatagggtactggtgattgaccaggcactcagcacatgcctggagcacacagtgcagggctgtggtggggaggtgggctgagttcctagggagtcacccatgtgtgcctgccgttctgaccagccaccaggccctcagggcagagcccactaccagcagcagctcacaccccaagaccagctcagaggcggcccctacctcagcagcagggacatcacagacactttgagctggcactagggtggcttctccagctcccacggggagaggggtcccagctgagtcccactcacgtggagtctcatgcccatgaaagtgccattcaccactggccaggctcatgaggccgcatgagaggggggtcactggggaggagatatcgggggaacagagagggtggttgaatttttgtataataggcagtgcaagtgtttaccgtttggcaggggaaaggtttgttattattagcaatgctacacttcaatattacactaaaatccagtttctctataacctgggagttgctcttttgttctttcttttcccatcttaattaaaatgagatgcagactctcacggtccacagtcgattaagaaatcttgcacggccatcaggttatgtcttggagagcagagtttcagtaccatcagcctggcaaggagctgggcctgctcctcagagctcccgggactgcgagaattggcatgttcacaaggcaccgtcacagcctctgaaacacgctgtctttaaagatgtttgcaggctggacgcggtggctcactcctgtaatcccagcactttgggaggcagaagcgggtggctcacttgaggtcaggagttcgagaccaacatggcaaaaccccatctctactaaaaatacaaaaaattagccaggtgtggtggcaggtgcctgtaattccagctactcaggaggctgaggtaggagaactgcttgaacccaggaggtggaggttgcaatgagcagagatcacaccactgcactccagtctgggcaacaagagcaaaacttcatctcaaaaaaaaaaaaaaaaaaaaaaaacacaaaacacaaagacatttgcaaggaccatgtcctcacccagaatggtgcctgcctttctacagtttttcaggaaaaggaaacattttctgcttctctcgctgaggttttttttaaccacccattaggaacctatagatttcaggatcgaacactgggattccctcagcactaaaggaggacaattgcaaacagagctgaaagtgcaatgtggaaaggtcaggctgaggaaggttcttagccagtagaccaagggcaggaaggacactgcctcctcagtctcccactagggaacttgtgattcttgtcccctgacctcagaattccttgtcatgtttgttttgtctccaagggaagggtttgaattacagaatttaaggctagagtgggcctcgtgcagttaacattaaccctctctctccttcgctggccaaggtgaagtccggaaacatgtagttctgacgtccactctctcgggggatcaccagttcacccatctcacccggcaagctgggacctagtttggcgacaggcatcttccacccacctgggaggcagggttcaacactctgcctctgaccttgtttccttcttctgccacctgcttaggcagccagaaggggttgtccagccagcacctgggctttggcgctcctcaagcaggtggaggaagtttcaggcacctggctcctcaggtgtctgccatccaggtgctcttcaggcctgcccagcagagctctcttgatccagctagaactggccagaactgactcactcaggaatgtgtagactttggcatcaggggctgctttaatttgcacaatttccaaatacctcttttttcttctttttctgatgagtcatcttcctagactttcattttaaagagatagatagttatcaggttccagagaagacatggtagaacatttatatctcaaagacacagagctgagacttcagttttagatactataatttgcctaaaccaaaaaggaaggtgtaggtaaagttctagtcaagacaggatggccaggaaaaacaccttaaaccaagggatggcttgctttgctgatttaagccaatggcttctttatcataagacttcccagtgatttagtcctccctctcttccagtgcacagagacatacccctccttacaaataaaaatgttctttatagatgtaaatttattttacaaaaatgtttcaaaataaccagatgaaaatcatccttatgccagaaagacttgttttttttttcattactagaaatgaaacagtaagtatttgttgtattgacatacttaggcttagacctgtgtttaacaagaaagcctaataatagcactgtggttagactgtagcctatttttccaaaccatcattttattattaaggaaacgaaggaccaaatacctttcattcatctgatatgatcctttaaaacacattccactaacaagtcccatttggaacagctgaaaatcttttaataaaactttttaaagatgagctcatggcttagtgtaaatttcacaagcttaattaggtcaaatggaaggaactcagatgagtagttgcccaatcagagcccattatttgtaagtcatcagacccctccatgaccttaaaactccactctgacctgattattgcaaacctatatacaaaaaagtgaaaggattaattttcattcatcaacctctcaatcccagattttcaaagaaaaaacctatgtaaggaatacttaccaaaaccagacaggaaaattagagcctgcatactttagagtcaaatttgttccactacagccaggtcgcatacaattacatcatttggttcttcatacactctagaactgactaggacagagtttagcatagaagaactgtaagaaataggttctgaaacatagaaattgcaaagttcaaaaggctatgaaaaaaactaatgtaaatgagagactcccctcactttgttttaaagaaatagacccatcagagaaatgcaaatcaaaaccacaatgagataccatctcacaccagttagaatggtgatcattaaaaagtcaggaaacaacaggtgctagagaggatgtggagaaataggaacacttttacactgttggtgggactgtaaactagttcaaccattgtggaagacagtgtggccattcctcagggatctagaactagaaataccatttgacccagccatcccactactgggtatatacccaaaggattataaatcgtgctgctataaagacacatgcacacgtatgtttattgcggcactattcacaatagcaaagacttggaaccaacccaaatgtccaacaatgatagactggatgaagaaaatgtggcacatatacaccatagaatactatgcatccataaaaaatgatgagttcatgtcctttgtagggacacggatgaagttggaaaccatcattctcagcaaactatggcaaggacaaaaaaacaaacaccgcatgttctcactcataggtgggaattgaacaatgagaacacttggacacaggaaagggaaaatcacacaccaggcctgttgtggggtggggggaggggggagggatagcattaggagatatgcctaatataaatgatgagttaatgggtgcagcacaccaacatggcacatgtatacatatgcaacaaacctgcacattgtgcatgtgtaccctagaatttaaagtataataaaaaaaataaaaaaataaaaaaataaatagatgttctgtaaaaatatacacaatttttacagacaaatacatttataagttgtttttatcttaaaaattggggatatttcatatttataactaattattgaaccttaagttttcttggccatttataggctaataaactaagaatcatgtaaactaagccaaagtagaatagacataaaagtcctaacacttcaacttcctatccttcaagaagtatacctcgcaaagctcatttgagagaggaaaagctttcctccaccctctgttttacagcgctgaggtttctcatcacatttctatgacttatagcttaaatccatgttacatggtcactggcattgttagtgcttctcttttaatactgtagaaattaatcaatttggtggcgtatttaattaattctatcactagaggattgtaaaattacatatatgaatacctcactttagagaccacttaattttttttccaaggggatatttgactatatttcacttgtgtcttatttaatgattttataatttaaaccctaaattataaatctagaatttagagagtatatttccccactggattacatttttggaattattatatgtgcacaaatattacaaaatcactgtagacacctgaaaactatattatcttttaaaagcaatatttacattaaactggtataacaaaattgtttggtgcattttttccagtacattttgtatatattacatgtttaacctttttttattcagcaaataatttttgagtatctactaagtgctaggttctgcattactaattgaatttaaagagtgaaataacagacatggtctcagacaataaaaattaacattaggtcacctatttacatattttaaaatggtaattatgaaaactttgagattttaaactagataacattataataatacacttgatgttgttaatatttgccagtgagcaaaaaagaaaataaaaagatggttttattcaatatacactttaaaattgcagaaaatagtcaagtttctctgctttgcagtttaatgtctatgtgtttttctctgcaacttggcttttgtggagtgaaacaattattcttccagcccaataaaggcagaagagtaacaataaatctaatattttaaatgcttatcaaaagatagtaaacatattatttcagaatactgagttcaataagttgacctacaaaaaaagccaaactgacagtattactgaataaggaaaggcccaaagagacaaaatactttttattttgtaacctcggtatgatacaacttaccctaactataaagaccctaaattaccaagatgggtgcttataatatggagagtaaaaaaagtcatttcacttttagcttttttatttctctcagaataaaaagtgtataaggagtttataaagaagttgatactataagttagtactacaaagacagcacttttcaagaaaagacttttttctctcttacaaatatcatgttagcagtatttgttttctccagaaataatgaggaaataaaaacataagtatgtgggtaattagtgtagtttcttaaagaaatgagttaggcaacaggctaataatgtatacttcgctggcttttgaatgccaacaatcatattctttataaggcacagagaagatttttctgaagaataagtatgtgaacctgaaaagtaatcgccacttggtagtgacaatatggatagggtgaagggcgtcatcaagaagcaatgaaaagatacatttgcagttaaatttgaaaaccatgatgtttaatacatatagtaataaagaatactttctcctatttcaaaattattttagaattaagatagaagctaaaatacctagggataatgatatgactatcaaaaattaaaaattaaaggacattttgagtattataagttaagaatgagaacttattacccaaagaacaggggataattcattatgctccatatccattgaattaaaagacaggcccattacctggataatttgaaagtttaattttatttaaaagtcttgtttcattcatcaagctaaaggattagctcccagaaatattctaggattgcatatccccaactctgtaggaagtatagaaagaatgttataagggccaccatctaaacattattatgtaaataatttagtaccattccatttgcctttgtagatttaaaaatgtaaatggctttctcatattaggaaacatcacttttcaaaacccagataaacatagtatattgcaagagaataattattttctttattaaaaaatactggatgctaagtccaaaagacataaattattttatactaataactactaacattttattcattaaaatataaaggtcaaagattttaaaatgatctttaaatgattaataacatgttgatctttttcttctttctgtaaacctttttgagtcttaacaatactaaactatacaagcaatattaaatagtatataaacggattaaaatattcaaatttactagaatgtggacattggaaagaatgaaaataaacagaagcataaagcagcagatataaaattaagaaagcaactaagagtgtttaaagtacatattcatctgtagtctaatgtctaccataaacaatgactcttctcagtaaaacacaaattgttcatgaagggaaaaagcatgttgtattagagaatattcaacataatttttttagtactaacttgtgcctggagtattattggtttttccattatgaacttatgcacttgataatttttttcataaaaattgtatgtacaactccattcaaaagcagtttttggtgggttttttttttttttttgagatgagttttgctcttttcacccaggctggagtgcaatggtgcgaatttggctcacagcaacctagcaacctttgcctcctaggctcaggtgattctcttgcctcagcctctcgagtggttagaactacaagcatgcaccaccatgcctggctaattttgtgtttttagtagagacatggttttgccatgttgaccaggctggtcttgaactcctgacctgaggtaatccgcccaccttggcctcccaaagtgctgggtatgggcaagagccaccatacctggcctcaaaagcagtttttaaaagcaaacacaatataacaccaaagttgaaaaatctatgctcacccaaggatgccaggtttaataaattatttatagaatactgcatcaaaaataagacaataacccaaaatataccattaaagatgtatccactcctacaactagagataattaatctatctggtagcaaatgatacttcaatcagtttcagcatgtctgaaatctttaaggacaaaagtgataaaacatgacttcattcttcattagactcttagaacacttgaaggaaaataatttctgaagcacaaagaggtaaagaggtgtaatctttcaaaaagatattcagtgttcaaaatccaagagtgcaatatcaggctgggtgcggtggcttatgcctgtaatcccagcactttgggaggccatggtgggtggatcacctgaggtcaggagttcgagtccagccaggcatggactctggctgtactaaaaacacaaaaattagccaggcatggtggtgtgcacctgtagtcctagctacttgtggggctgagacaggagaatcgcttgaacctgggaggtggaggttgcagtgaaccgagatcatgccacctcactccagcatcagtaacagaatgagattccatctcaaaaaaagaaaagagtgtaatatcggtatacacagataatatactgaatgaaacaaatagaataatttgaagaggtatcttgatgaacaaggagtcattagaaaggttgtattcatgtctttgaaggaaattgcaatgtgagaaattaatactttgactactatactaaaagtttattgctaacatgtattgagttattaacgtgtgttaggcagagtgccatataatttacaagtgttatctcatttattgcaggtgaaatgtaatttcgaactctggaagtataaatgaattagatagaaaaaaattctatttaaatggccaccagtaaatcggtatctaggaacagggtgatacagtgcccaagttttctattcttactaaatgttgtgtttcattttcaatgttttcttggatattgctcttttttggtgattttgatttttttttattttagaaaactaataaattgactcttcttggtactgactcgggttttatagaagaaaaagtaaattctgtacatttacctttacctcatctttttctcttttaaatttactatattttttattttttttgtaattttattttatttttctatgattattatttttattattattatactttaagttttagggtacatgtgcacattgtgcaggttagttacatatgtatacatgtgccatgctggtgcgctgcacccactaactcgtcatctagcattaggtatatctcccaatgctatccctcccacctccccccaccccacaacagtccccagagtgtgatattccccttcctgtgtccatgtgatctcattgttcaattcccacctatgagtgagaatatgcagtgtttggttttttgttcttgcgatagtttactgagtatgatgatttccaatttcatccacatccctacaaaggacatgaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttccgatttctccacatcctctctagcacctgttgtttcctgactttttaatgattgccattctaactggtgtgagatggtatctcattgtggttttgatttgcatttctctgatggccagtgatggtgagcattttttcgtgtgttttttggctgcataaatgtcttcttttgagaagtgtctgttcatgtccttcgcccactttttgatggggttgtttttttcttgtaactttgttggagttcattgtagattctggatattagccctttgtcagatgagtaggttgcgaacattttctcccattttgtaggttgcctgttcactctgatggcagtttcttttgctgtgcagaagctctttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtgtaaggtgtaaggaagggatccagtttcagctttctacatatggctagccagttttcccagcaccatttattaaatagggaatcttttccccattgcttgtttttctcaggtttgtcaaagatcagatagttgtagatatgtggcgttatttctgagggctctgttctgttccattgatctatatctctgttttggtaccagtaccatactgttttggttactgtagccttgtagtatagtttgaagtcaggtagtgtgatacctccagctttgttcttttggcttaggattgacttggcgatgtgggctattttttggttccatatgaactttaaagtagttttttccaattctgtgaagaaaggcattggtagcttgagggggatggcattgaatctgtaaattaccttggggagtatggccattttcacgatattgattcttcctacccatgagcatggaatgttcttccatttgtttgtatcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttcgtacattgattttgtatcctgagactttgctgaagttgcttatcagcttaaggagattttgggctgagacgatggggttttctagatatacaatcatgtcatctgcaaagagggacaatttgacttcctcttttcctaattgaataccctttatttccttctcctgcctaactgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgcatattgaaccagccttgcatcccagggatgaagcccacttgatcatggtggataagctttttgatgtgctgctggattcattttgccagtattttattgaggatttttgcatcaatgttcatcaaggatattggtctaaaattctctttttttgttgtgtctctgcctggctttggtatcagaatgatgctggcctcataaaaagagttagggaggattccctctttttctattgattggaatagtttcagaaggaatggtaccagctcctccttctacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcctctttatcattttttattgcgtctatttgattcttctcttttttctttattagtcttgctagcggtctatcaattttgttgatcctttcaaaaaaccagctcctggattcactaattttttgaatggtttttttgtgtctctatttccttcagttctgctctgattttaattatttcttgccttctgctagcttttgaatgtgtttgctcttgcttttctagttcttttaattgtgaggttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagtaggttgttcagtttccatgtagttgaatggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctactaggtccgcttggtgcagagctgagttcaattcctgggtatccttgttgactttctgtctcgttgatctgcctaatgttgacagtggggtgttaaagtctgccattattaatgtgtgggagtctaaagtctctttgtaggtcactcaggacttgctttatgaatcttggtgctcctgtagtgggtgcatatatatttaggatagttagctcttcttgttgaattgatccctttaccattatgtaatggccttctttgtctcttttgatctttgttggtttaaagtctgttttatcatagactaggattgcaacccctgcctttttttgttttccatttgcttggtagatgttcctccatccttttattttgagcctatgtgtgtctctgcatgtgagatgggtttcctgaatatagcacactgatgggtcttgactctttatccaattttccagtctgtgtcttttaattggagcatttagtccatttacatttaaagttaatattgttatgtgtgaatttgatcctgtcattatgatgttagctggttattttgcttgttagttgatgcagtttcttcctagtcttgatggtctttacattttggcatgattttgcagtggctggtactggttgttcctttccatgtttagcgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatatgaacgttggcctgccttgctagattggggaagttctcctggataatatcctgcagagtgttttccaacttggttccattctccccatcactttcaggtacaccaatcagacatagatttggtcttttcagatagtcccatatttcttggaggctttgctcattccttttaattctgttttctctaaacttcccttcttgcttcatttcattcgtttcatcttccatcgctgatactctttcttccagttgatcacattagctcctgaggctttgcattcttcacgtagttctggagacttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttctgttgctggtaaggaactgcgttcctttggaggaggagagcgctctgctttttagagtttccagtttttctgttctgttttttccccatgtttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtatcagtgtgcccctgctggggggtgcctcccagttaggctgctctggggtcaggggtcagggacccacttgaggaggcagtctgcccgttctcagatctccagctgcgtgctgggagaacaactgctctcttcaaagctgtcagacagggacatttaagtctgcagagattactgctgtctttttgtctgtgccctgcccccagaggtggagcctacagaggcaggcaggcctccttgagctgtggtgggctccacccagttcgagcttcccggctgctttgtttacctaagcaagcctgggcaatggtgggcgcccctcccccagcctcgctgccgccttgcagtttgatctcagactgctgtgctagcaatcagcgagactccgtgggcgtaggaccctccgagccaggtgcaggatataatctcgtggtgcgccgttttttaagtccatcggaaaagcgcagtattcgggtgggagttacccgattttccaggtgccgtccatcacccctttctttgactcggaaagggaactccctgaccccttgcgcttcccaagtgaggcaattcctcgccctgctttggctcgcgcacggtgcgcgcacccactgacctgtgcccactgtctggcactccctagtgagatgaacccggtacctcagatggaaatgcagaaatcaccgtcttctgtgtcgctcacgctgggagctgtagactggagctgttcctatttggccatcttggctcctcccccttaaatttactttaattgacatataataaatgtacatgttatggggtacagagtgatattttgatatatttatacgatgtgtaaagatcaagtcagagtcattatcatatccattacctaaatcatgtattatttctttgcagtgagaatattcaaaatcttttattttagttatttgaaaacacacaataaattcccattaactacagtcacccaacagtgctgtagagaactagaacttcttccttctctccagctgtaattttgtatgtattaaccacatttttcttatactcttctttctcctactctttccaggatatggtaaccaaaactctactatctacttctacgggattaaaaattttagcttccatacataagtgagaacacgtagttatgtggtgtttatgtttctatgccaggcttatttcacctaacataatgccctccacttgcattcttgttgccacaaataacaggattttgttctttattatgactaaataatattccattatatatgtatgtcacatttctttatccattcatctgttgatggacacttttgttgattccatatcttggctattgtgaatagtactgtaataaacatgggggtgcaggtaactctttgatatactgattttctttcctttggatatatactgaaaaccatatgattaaattaataaacacaataaaagcgtttggcaaaattaaatattcttacatgacaaaaaacctctcaacaatttagtatagaaaatatatgccttaacacagaaggacataaaggacaaatctacagctaagatcatactgagtgtggaaaacgtgaaagattttactgtgaacaagaaaaagattttactggaacaggaaaaggatgcctattctcaccaatcatatttcacatagtgaaagtcttagccaggacaattaggtgagagaaagaaataaaggacatctgaattggaaaggagacagtcaaactgtccctgtttaaagacaatgtgatcttatacacggaaaaaaataagactctaccaaaagcttcttagggtgatacatgaaattaataaagttgcaggatataaatcaacatacaaaaatcagtagcatttctatatattgatagtaaactagctgaaacaagaaattaagaaagcaattccttttacaatagctacaaaaatgtacttagaaataaatttaaccaaggaagtaaaagatttcgacaacaaaaatgacaaatactaatgaaagaaattaaagaaaacacaaaaaaggaaagacatccacgtttatagattgaaataatattcttaaaatgacccactatcctatgtgatttacaaatttagtacaatcactagcttgtatttttaaaagcacctttgctgcatattcttaagatattcaatgacaatgcctggatttaagtttgaggtattattatatctattttatactgggcacaatataatgttatcagaggtaatggttttgattggtcctaggtcatacagtaatatatacattgtgatttatagacatgctatcttttaatactcaggcatttacaaagttcatttagacaaagttataaaaacttgccttcctttccgcctatatcacctaaaaatcctaatttaagaggtaataacattttttgatatacaatttatcaacacaataaaaatctaacaattatcatgtgcagagtgtgaaaatctcatcagattaaggaacacaaagacatctttttcatatttcgaatgtaaaactgttttggaaactgttatttttagaaacagttaaaaacattttttcattagtttttcatgtaaaattgtgacaaccagcatgaaataactgtcatcacagaagcatggtatattcgattccaaaacatattctttgtaagttttaatatatttatgtattatttatacttacattgtaacccataatgtacagatattatttttccttcaactcttaagaatattcttaaataataaaaaattaatgatttataatttttgttggttgggaaaaagaatagacacacacgtgacagtgcatcacttcacctcatcatttcatctcatcattttatctcatcatttcatctcatcattttatctcatcatttcatctcatctcatctcatcccatcatttcatatcatctcatttcatcaaatctcatctcatctcatttccatttcattttcattatttcatttcatcatttcatttcactatttcatttcatttcatctaatttcatttatttcattatgtcatttcatatcatctcatttcatttcatctcatattttttatatcatttttcatatcatttttcatctcatcatttcatctcaattcatttcatctcatcatttcatctcctcatctcatcatttcctcctttcaacatttcatctcatttcttctcatctcatttcaatttcatttcattatttcatctcatttcattatttcacctaatttcattatttcatctcatctcatctcaattcatcatttcatctcatttttcatctcatcatttttcatctcatcatctaatctcatttcacttcatttcatctcatcatttcagctcatcatttcatgtcacatctcatttcatcatttcatttcaacatttcatttcatctcatctttcaatttcatttcaatatcatcatttcttttcatttcatctcatttcattatttcatttcatttcatctcaccatttcatctcatcatttttcatctcatcatctcatctcatcatttcatcatttcatctcatttcttctcatcatttcatctcatcattttatctcatttcatctcatctcatttcaatttcatttcattatttcatttcatttcacttcatttcatctcatcattttatctcatctcatttcatctcatttcttctcatctcatcatttcatcatttcatcttgtttcatctcatttcatctcacctcatctcatcatttcatctcaacatttcatctcttcctttcatttcatctcatcgtttcgtctcatctcatctcatctcacctcagcatttcatcatttcatctcatcatttcttatttcatctcattttatctcatttcatctcatatctcaattcaatttcctttcattatttcatttcatctcattcatttcatctcatttcattacatctcatcatttcctctcatcattacatctcatctcatctcatcatttcatcatttcatctcatcattgcatctcatcatttcaaatccatcattcatctcgtcatttcatctcatcatttccatttcatcatttcatttcatcatttaatttcatcatctcatttaatttcacctcatttcattatttcatttcattttttcatttatgtcatttcatttcatctcattacatttcgtctaatttcatttcatcccatttcatctcatcatttcatctcatcttttcatctcatcatttcatctcatcttttcatctcatcattttatctcatcatctcatcaactcttttcatcttatcatttcatcatttcatctcatctcatatcttctcatctcatttcaatttcatgtcattatttcatttcattatttcatgtcatctcatctcatcatttcatctcatcatttcatcattttatttcatcatctcatcttatcatttcatctcatttcaattttatttcaatttcattatttcatttcatttcatctcatcagttcatctcatcatttcatctcatcatctcatctcatcatttcatctcatcactcatctcatttcatatcatcattttatctcatctcatcatttcatctcatttcatctcatctcatttcatcattacatctcatttcatctcattttatgtcatcatttcatgtcatcatttcatcacatctcatcgtttcatctcatcatttcatcatttcatctcatttcaactcattgcatctcatctcatcatttccatttcattattccatttcatcatttcatttcattatgtcatttcatctcatcatatttcatctcatctcatcatttcatttcatctcatcatttcatctcatcatttcatctcattttatctcatctcatcatttcatcatttcatctcatcatttcttctcatctcatcatttcattatttcatttcatctcatttcattatttcatttgtcatttcatctcattacatttcatctcatcatttcatccatcatttcatttcatcatttcatctcatgatttcatctcatctcatctcgttatcgcatttcatctcattattgcatctcatttcatctcatctcatcatttcatttcatcattacatctcatcatttcaactcatttcaatttcatttcaatttcatcattacatttcataatttcctttcattatttcatttcatttcatctcatttcattatttcatttcatctcatttttcatctcatttcatctcatcatttcatctcatcattcatctcatttcatctcatcattttatctcattatttcatctcatctcatctcatttcaatttcattatttcatatcatttcattatttcatttcatctcatcatttcatctcgtttcatctcatcatttcatccatcatctcatcatttcatctcatttcatctcatctcatctcctttcaatttcttttcaattttgtcatttcgtctcatcatttcatctcatcgtttctactcaccatttcatctcaaaatttcatctcatcatctcatctcatctcatcatttcgtcatttcatctcatctcaagtcatcttatcatttcatctaagtgaaatgatgtaatggaatcatgaaatgaaatggataggatgccctcagtgatgttaaatttaaaaattgtttcttttcatgtatgcatttttatatttatatgtatttatatttatatttacttatatttctttttacttatttttatttatatttttacttatttctttatttatagacaaggtcctgttctgtggcctaggctggaatgcagtggtgcattcacagttcactgcagcctcgagcaaacctcccaccttagcctcccaggtggctgggaccccaggtgcacaccaccacacctggttaatattttattatttgtagagatggagtcttgctattctgcccaggctggtctcaaactcctgggctcaagcaatcctcctgcattggcaacccaaaatgctgggatgacagatatgagccacagtgcccaacctatttatttatttatttatttaataaggacaaggtctcactatgttgcccaggctggtcaactcctggactcaaatgattctccaaacgtggcctctcaaaatgttgggattacaggtatgagccaccatgcctggctaaaaatagtattatatttttgtatcatataattttcaattaggtaatatgaatattctgtacaggaaatacgcccttaattacataggaataaacatttgttacactgagaaaaatctaacagagctaaaaataaaaattaatttggaaaggtcattagatactgacacattcttacgtttatacattctttcatatattcatatattcttttaacagtatcaatggtttggagttatgtgtacaaaaccatgacctatatgtaatacaactaataacaggcacttacaattcaaggcatattatatacaaagctttaacttcttatcaaaatattttgttttttttctttctgttttggcagatactatgaatacaacattcaactcacagacaccatggagcccttactaagcataaagtactgtgaaaggccagggctaggacagaactgagacagggccagggataggacagaaccggggcagggtcatggccagagaaaaaccaggggcagggtcacagccagggacatgagaggaccaaggccagggccagaagcagggcagaaccagggccagggcagggacatggcagggccagggccatggcaggatcagggtcagcagaaggccagggcagggctagggtagcacagggccaaggcagggcagggtcagtgtagagcaaggaacgggccagggtatggcagggcagggacagggaggtccagggccagagtcaggtccagcacatggacagggcagggccagaaacatggcaggaccagaaaggggacagggcaagggcaaggccagagaaggaccatggaaaaaacatggccagggagggtccagggcaagggcaaggccagggcagaaccagagccagggcaggccaaaggcagggccagggcagggcaaggccagggtagggtggggccagggtagggtgagggtagggccagggcgagttcagggccagggcaggactaagatagcacagggccaaggcagggccagggcagggccaaaaggaggggccagggccaagcatggccagtgtcagacctggggattgtcagggccagggtcagggtcaaggctgggccagggacagggccagagcaagggcagggccagggagaaagcagaaccagagaggatccagagcaaggccagggtcagggaagaaccaggaccaggataaggcaaagccaaggccagggcagggcaagaccagggcagggcaagaccagggcagggcaaggccagggtagggccaggccagggtaggagaaggccatgatagggccaaggccaaggcagggcagggctagggtagcacagggcatggccaaaaacagggcagggccatagcagtggcaggactagcaacagggccagggcaagcgctggaccacagcatggtggggacaatacagggccaggacagaggatggcaaggcaggtccagggccatttcatggactcggtaggcctggggtcaggccagggcagggcaaaggcaaggccagggagaaggcaaggccggggccaaggcagtgccagggcagggcaggaccagtgcagggccaacgcagggtgagggcaaggccagggcatggaagggcagggcaggaccaaggggaagggccaggagagggccacggcagggtcacggccagaacaagggtatggctggggtcaggaatatggtaggacgagggctgggcccaggctgggacacgcagggcagagcatggcctgtgcaaggcacggccagagccaggccatagagatgggagggcaacaccaaggcagagtcagggtagatccagggctgagcagagtcagggcaggtccagagtcgaggcagagctagggcccaagcagggccatggtagcaccagggcagaggagggcagggcaatgcaggactgggccatggcagtgcctggtcaactccggggcagggccagaagcaggacagggccagggccaatgctcaggccagggacagggcatgacaggacgtgccagagcagggctgggccaatgttggggcaggacaaatcagaccaggacacctccaagtccagctctggccctgccttggccctggacccttcctggcctgaccttgtccctggccctgccctatccatgccctgtgtgtttgaccactgttttataaccagaatcctacaagaaacttaaattagttctttttgtgcatttttagtagagatggggtttcacaatgttgaccaggctggttccaaactcctgagctcaagccatctgcctgccttggcctcccaaagtgctgggattacaggagtaatctggccaagtatttaacttctttatgcctgtttcctacatttggaaaatggggatgctttaagtacctagcacatagaattattgtgagaatcaatgcctcacatatttacatattgataaaattatactcatagaacactactggaaacaaagacagtattagttaaaatttagtgattactgcaaatattattactattacaaacaacatagtatagacattactactactatagttatcttaaaaatctaaaataaaaattttacataatagcctaatgtaatctctcctgctctgccctggctcagccctagtgctggctctgcccctagtcctactacatccctggccctgacccttccctggtccagccgctgccctggcccttcccatcttcaggccttaccacggccctaccctggtcctgaccctgccctggtctggtcctgaccctggccctaccccacagaaggggtatggcagagccagggaagggccagggcaaataagtgacaggacacatccaaatccaggaaagggccagggctatgacagagccagggcaagtccttggcagggccaggttccaggccagggccaggaaagggtcatggcagggtcactgtatggccaaggtccaggccaaagccaaggcagtggcagggtcagggctgcataagggcaggaccagagccagtgatacggcagggccagggccagggccagggctgtgccaggacagaacaagagcagagcagggcaggaccagagccaggccatagagagagtagggcaaatgccaaggcaaggccagggtagtgccagggctgaggcaaggtcagggaaggtccagggctgagtcaaggctagaaccaagacaggggcaaaggccggggcagatctagggcacaagcagagcaggctagggcagggcaatggcaagaccaggccatggcagggccagcccaggatagaagagggcacaggcagggcagggccagggccacagctggggcaggacaaggaccaggaccggggtccaggccagggcaagggtatggccagggcagaggtaggccagagccagggtctgggcaggaccaaggcaggtctgttgcagggccagggttcagaccagggccagagcagggctgggacagggccagggccagaaccaggaaagggcaatgtcaggacaagggccatggcaggaccagcaacggggctggggccaggacagggtcaggaccagggctgggccagggtatggccttaagtagcgaagggccagggccagggtccatgccagtgccagcgccggtccagggcagacgcagggccatggccaggtctaggacaaggctggggcagggccaaggtctgggtcagggtcagcacaagaccaggacagagccaggggagggacagggccatggtaagaccagattaaatcagggacaagacacctgcaaatccacttcagggccagggtcagggcagggccagttcagggccagggccagggccaagacagggccagggttagggctcccagggtcattggcagggccagggtcagggctgccagggtcattggcagggccagggccatggcaggaccagggtcaggagcaggggtcaatgccaggccaaggccacacataggaccaggtctgtgctagggccagtgtgagggccaaggcggggtcagggcagggccaaagggagggcagggccagggcagggtgatgcaggcccagggtagcacagggttaaggtagggcacgaccaaccagggcaggtctatggctggggccggggcagggccagggccagggcagggccagagccagggcagggccaagacagtggcagctccagggcagggccagggttaggaccacggacatgtccaaggccagtgccagggcaagggcaagggcaggggcagggccaggttcatctaagaaccagggacaaagccaggcccagagatgggccaggacaggtacctggcagggctagggtctgggccagggccacggcagggccagggccacaaccaggtctgtgctatagccaggtccaacacagtgcccaggtaaggctaggtagaaggccaaggtagggccagggcagggtcaaagccaggctagggccaaggcagggccagggctggcaaggcagggccaggaaagcatagggccaaggcagggcagggccaggccagtaccaagacctgggcagggccaggggcagggccaggggcagggccacggccacagcctaggcaggaccaggttcggggcaggagcaaaacaagggtaaggacagtgcaggttcttggcacagccagggtccaggacagtgtcagggcagggccaaggcagggtctgggccttgataagaccagcaacagggctggggctaggccagtgacaggaccagagtcagggcaagggccagagcagtgcaaggccagggtagggccaggcatttcagggtcagggccaggggagaaccagggcaaggtctgaagcagggaagggccagggccaggacaggtccagggcagggccatgacacggccaggggctgcgttagggcaagggcagggccagagcaaggtaagggtcagggccaaggccagggtagggacagggcaagaaatatggcaggaccaggggcaatgccaaggccaaggctgggccagggctgagccagggctgagtcagggcagggcaaggcagggcatggtatggccagtgcaggacaggacaagagccagtccagagagagagcagggctgatgccaagaaagagccaggctagtgccgaggctgaggcagtgtcagagcatgtccagggcagggccggggccagggacagaaccgagccagggcacagccaagacagggtagggcagggaaatagcatggctgggtcagtactgggacagggcagagcagggcaaggcgatggtagcggcagggcagggacaggccaatgcagagccatgtcatgccggggccaggacacctccaagtccacttcaggcccagggctatggcaggacaaagaccagggccaggatcagggccaggtctgtgctagggccagctccagatgagggtctagcgaagactagggtgagggccaaggtaaggccagggcagggtcaaaggcagagtagggccaggtcagggtgatgacacatccagagcacaacagggcagggtgatggcaagaccaggggcagaccactgccagctcagggccaaggaaaggccagtgcagagccaggaaagggtctgggtctgaacaaggcagagcagggccagggccatggcagagtcagggcaggtccttgacaggaccaggttccaggccagggctagggcagcagcaggggcagggcctggataagggcagggccagggatatggcaggaccagggctagggccagggccaggccatagtgagggcagggcaaaagccaaggcagggtcagggcaggtccagggcaggtccagggagcggccagcaccaagcggggccaaggcacaaccagcgcagggtaaggcaggacaatggcaccactgggccatgacagggcaaggtcagcaccaggagagggcagaacaggcaggcccatggtggggccagggcagggatgggccaaagcagggccaggacatgtccaaggccaggtcagggccagaacaggagcaggaccatgaccattggcagggccagtgccatgacaggaccagggtcaggacaaggggcagggccagagccagggccagaaccaaggtcaggccagtgcaggttcagggcagggccagtgccagggcaagaccagggcagggacagggtagcacagggccaagacagggtcaggatgggaccagagcaggacagggccgagagtccaggtaacagtagagcaggtatagggcaaggcagggcagtacagggccagatccatggcaggcgcagggcaaagccaggcccattgccaatgcaccagccctccctacaaggctcctaccacctggccactgctgcagcccgtccatcgctgtaagcctgaaccccaaccctggctgcagccacctgccctcctagtgcggccgctctcctaccgctctggcgcactgcaatctccgtcactgccacccacccgcagcgaggcaagccgtggtgtcgcaggctcaaggtgtctcctcctcctcctggcacggagcagctgggcaggcaaagccagaaaagcctagaggaagatgtgaggggtggaagggttagagcctcaacttgtcatgccagccactgggtggcaggggccagtttcagcaaaggcactcacacccaccctccaaagtccagcctctccttttggcccaagctggccgggaactggggtctggggtgggtgctggagatatcacagcacccagctccccactccacaggaaccattgggcccaccggggctgcactcctcggggagcaggagaagcagaaaaattcagacccagccagccctccgcacccaggtgccaattcctgttccggacgcctccacgcacagggccctgtcccccatggtgtccccaggggtgcctggcagcctctgaggcacagacccagagtgcacaggcccaggaaccacggtgggtgtgggggctctgccatgctcaggattcccacgcaaacgctgtgtgccctgccgcattccagtatgaccaagagtgggtcgccctctggagtgtggagtcagggagaggagaaccactccttccttggatgccaactctgttgaccgccgccagcagtgcagcccctgatagcaccgaactcgcccccgctccacggctagtcctgccctcaatagcgccccccacctccgtcccccaatgccgccagtagcgtatacccgataatgccctaacctgtcctcctccatgggcactgaagccccagaaagcgcccataacccaccctccctgctgtgggcagtgcagccctgtacagtgctaccaaccagtacccctaatgcaggcaatgacaccctggatagcgcccccaacccaccccacactgcgaaaggtgcagccctggatagcccctgtcctaccactctgttcatgctgcagtctctgtcaccaccaccagcaaccacagtgaggcaagccagtgggccgcaggctctagcatccagcagccaggcatggagcagctctcgctgatggccggctcctaccactctgaccatgctgctgtctgtctccatggccatcttctttcactacaaaggaataaaactaggtatcaataagaaaagtaattttggaaacaatacaatcacatggaagttaaacactaccctcctgaataaatgactagcaggtcaatgaagatactaagacagaaattcaaaaatttcatgaaacaaagggtaatgaaaacacagtataccaaaacttgttacgcagaaagccatacaaaggcagagatttacagctacaagtgcctaccatccaaacaaaagaaaaacttcaaataaacaatacatcttaaagaactagtaaagaacaaactaaaccgaaaataagaaaataaataagatcgtagcagaaacaaaattgaaataaaaaacacacaagattaaacgaaaagttggttttctggaaagctaaacaaaattgacaaacttttaaccaggctaagaaaagagacaagattcaaataaataaaatcaacagattaaaaaaaggagacattacaactaatacttcagaaattcaaaggatcataactggctattatatgccaataaattggaaagcctagtagaaattggcaaattcctagatgcatacaacctacttaggttaaacaatgaaaacatccaagaccagaacagattggtaacaagtaatgagattgaagccatcagaaaaagtctcccagtaaagaaaagcccaggaactgatgtcttcactgctgatggcttcacaccaaacaatttaaagacctagtacgaatcctgctcaaactattttgaaaaacaggagggaatacttccaaacttattctatgagaccattattactgtgataacaaaatcagacaaaagcatcaaagaaggaaactacaggccaggatctctaatattgatgcaaaaatcctcaacaaaataccagtgaatcaaattcagtaatacattaaagagataattcatcatgatcaagtgggatgtatccctgggatgcaagggtcactcaacatacaatgtgatacatcatatcaaccaaataaacgacaaaaacagtatgatcacgtcaactgaaaccgaaaaagcatttgatgaaattcaacatcccttcatgctataaatcctcaaagaaacgggcacagaagaaacataccgcaacataataaaaactacaggaaagacacccacagctagaatcatatggaatggggaaaaacggaaagcttttcctctaagatctggaacatgataaggatgccccctgtcaccactgttgtttaacatagtaccagaaatcctagctaaagcaatcagtacagcccctgatatggcccccaacccaccctgccccctaccaccagcagtgtcgcccccccgcaacagcacacccaacatacccaagccgccccgcctccccgcaccatgggcattacagcaccccatagcgccctcaacccgaaaccgccacccacccccccaccgcccacagccgcacagtgcagccccggatagcacacttagcccacctcactgttgccagcaatacagtctgggatagtgcccccaaccggctccccgccaaaggcagtgcagccccggtttgggcccccaaaccatccccccgtgcaggcagcacagccccagatagcacacccaaccagccacccaagacgggcagtgacgcctgagatagggctcccaaccggtcccaggccacccgcagtgcagcctggatagcgcgcttaccccaacgcctttctacgctctggctggctgcagtgtccatcgctgccaccaaccacaaacagggctgcaaacaggaaggattttattcaccgtcgatgcggccccgaggtgtcccaaagcgaggcagtgcccccaaggtctgtgcagagcagaacgcagctccgccctcgcggtgccaccggcccgcccgcccgggtctgtgctgaggagaacattgctctgccttcgctgtatctccgaagtctgtgcaaaggagaactcagctccgccctcgcaaaggcacacagcgccggcgtggcggagaggcggacagcggcggagaggcggacagcggcggagaggcggacagcggcggcgcggcggagaggcggacagcggcggagaggcgcacagcggcggcgcaggcgcggagaggcgcacagcggcggcgcaggcgcggagaggggcacagcggcggcgcaggcgcggagaggcgcacagcgcggcacagcgaggcgccggcccagactccactccccagctgtgaaagggtaagaactgagggtggctgagactcggggttgttcagggcggggtgggctctggacccagcaggcccggcacccaggtcagggctccaggggaggccaggtgggcgaaggccaagaaggggccggggctggtcaggaagggctcctggtaaccagagcactttgcgtgagccagcgtgggaggaaggtgggctggatgagctagggaggcgccgggaggggccttggcagaggcgaccccctccgtcagcccccaggccactgaaccctgggtagcgagaaccgacaggggaggctgcatacagaggagtggaggctccccggctttgggggctctgagtagaagcatctagggggtccctcaagaggcccccaaacgcctccccatggtgagaaaagaaagcgcagagaggggcacggctgtgatttcttttattgccccaaatgtacttcatcttggtagatttctattggctttaaaaatgtgtgtgttttgctgttggggagtggggtgttatacggatgtcagattttgctggttgactgttcagatcttttgtaaatccttgctccttttctgcctagtttcactctgtcacttacattagagtgcggtggcacgaacatgactcactgcagccttgacttcctagggtcaagtacttcccctggcttaacctcctgagtagctggtactataggtgtgtgccgccacacctggctaaatttaaaattttttggagagatgaggccttgctatgttgcccaggctcgaactcctggcctcgagctatcctttgtctttgcctcccagagttctgggattacaggcatgagccactgtgcccggcctctgcctagttttaacagttgctaagaggaggatgttgaagtagatgtcttcttggtgggttaatccttttgtcattaagcagttgttatggtcacttccttttcaccccattggtgaaggaggggtccctgccctaaagtgtaggagatggctgaacacgacacctggcgtggatggatgagattgacagcagtgttttagtcacatatacccacagctcagaggaggacactgcatgccacacagggtcagatgggcaccgcactctgtagcggagtgagggctgtgggctgaggaagcaggcaggcttgatagtaacaagagcacacaatgaccaatggttcccgagggggaatgcagttggcttgtttgaataaattcatgggctggcagacaggtgaagtgaagcttcttaggctgaggtgcaactgtttggctgataaaagaactagccaggtggggagcctttcctgttgggtggcagggtagggggtgtctggtagaaacaggaaaacccacggctaggcctttggggccctgtgaggctcaaagatgtcaaggcagcataggaaattttagatcttaaaattcagcgaagaccctctccagctctggtaaattattttgcttgaagtctacttcatgagatattaatatattcactcctgcttccttaaaaaattaatgatttcacaggatatctttctccattcttttactttcaacctacttaggtccttaagtgagtttgaagtttcttatgaacagtatttagttgggccatgtgtttattataggctctccatcaatctgtcttttggtttatttagaccatttacatttaaggtgcttatagttacataattgcttatgtctgatgtttttattatttgctttttcgtttcctttttctttccctccatcttgatctatttctgtataatgttgttgctcgtatctctttgtatagtcttaaagtgtttgctctggatgttacaatatgtgtattgtaatacagtagtctactggtaccagtatttaccacttcaaagtgtggaaacctgccttgcatttatgtctctttaccttttccacttgtataaatcactggcttgagtattaggtggtggtatagtttttgtttcagtcgtcaaatgtgattttaagaactgtggattgtctcgcgtatgtatccacatttctggtctttcctttgtccctcctcctatagtcccatattcatcccttctgcataagaactttctgtagccatttttttgttttgatttttttgttttaattttttgtattgtggaaatgacagaacatatttctgtagccactttttagcatttctaaattgaccagtgacaaattcctatattctcttcctctgagaatgtctttatttctctcttcatttctgaagggtagtttcatgggatatagaatttgcagcgaacagtttttttgtttggttggtttttttgtttggttgttttttttttaaacacttgaaaatgttgtgccacttccttctggcctccatggcatttgagttggcgtgtccctacaggcattctgccatttttggtctttgtttttagttttgaaagtttaattggtgttgctttcttttggtatactttgaggtttgctcagcttcttgaatctgtaagtttatatctttcaccaaatgtgggaagcctcaggaattagttatttgcatgctttcacagctctggtctcctatgggactcagataacataaatgcggggttatcgtcccacaggtccgtgcagctctgttcatttgttttcaggttattttctctctcttgtttagactgggtgaattctgttgatcaggtttcagcttctctgattctctcctctgtcgtctccacttttactcaatagggcccatccagttagtttttttaaaatttctgttactggattttatatttctgtaatttccatttgattcttcagtttctttgctgatgttttcagttctttgattgttgccataggatttgtagttgcttgttgaagcatttttatactgactgttataagtgatgagtcagatggttccaacatctgcctatgtaatttttttatttttgcaggcagtcctcctgtttaggtttagtctgtaggtcttggtctactttgtgggctgtgattccaatggcaatttaatttcagagccttcatggtgttattttggtctctttggcttatatgtatcactgggattctcccaccagtccctgttgttgcccacctgagggaacaggggagccgccctaggctgggccacctgctgcagctaggtgggtggggaatggtggttgtcttggtgtgtggagctggttttcttgttgtggggaagatctcctttgatctgcggggactgagtctgcctgggttgccttctattgctacgttgggagttgggaaactctgggcctgggtcaccttcctattggatgaggtccagggagacacctggccactatgcattccctagtcctagagtccctcagcagcctttttctgtccaccttttggaattctccattgatcctctcctgtctattatttctagagtttgggttacatttcttaggagggtataatgtgttatcttctctagaccagaaatccttagtggtggtttcgggttgtaactgtgctaaagggagaattggcgtatttgtgatgtcgggtctttcttttcaaatgaggacatatcattattcagtatataatatttacaacacctacttccttgggttgaagaatgtggttaaggcaaggaaagtacttaacacagtgcctggtgtggagagcacttacgagtgttggtagtgatgctattccttttgtcctttggtagcctattaaagcttttcttcttttttaaaaaaataaagttccggtgcacttcttgttaggtttattcctattttatccttttttgcttttattgcaaataggagcttcctatcttttataacgtctacctggttctttggcccttacgtgaaaatgttttaatagccttctaaacattgttctctcaaatgagttttaatttgcctctttcttttgttttcctttttttgagacagggtctcactctgtcacccaggctggagttcagtgacgcaattatggctcactgcaacctctgcctcctgggcccccaaagtgctgggtttacaggtgtgggccactgcacccagccttacttgtctgtttcttttaagagtgggaactataattgagcccagagctccaaaaacaaatgaagaaatgaatgagtgaataagctcttcccatgggtttggtgtggtttgggactctactcttaatctaaatgctatgttttatataatctaaaatttcccctaggtgtgttacacgattgtgttgtgttgaacttacattgagactccttttcacatgtgctggttatcagcgtgggacttttccattcactctttgaattattcgtttgggggacacagatagacctctgtgtctttcataaagagtgtccattggccggttgcagtgtctcatgcctgtaatcccagcactttgggaggctgaggagggcagatcacgaggtcaggagttcgagaccagcctggccaatatggtgaaatcccatctctactaaaaatacaaaaattagccaggcctggtggcgggtgcctataatcccagctgctcgggagactgaggcagtagaattgcttgaacctgggaggcagaggttgcagtgagctgagatcgtgccactgcactccagcttgagtgacagagtgagactccgtctccaaaaaaaaaaaaaacaaaaacaaaagagtgtccattatctatactagaaaaattgagattgggattttgacatgaagtgcggaaatgtggattgggtccatttagtttacctaaacagatgatgaaatactaactgttttacgaagcattccctagtgcaaagttttgcctgtgtttctagtgatgggaacagtgagaatcagacttggaacacggagcgcattgtgggcctgtcgtgggtggggccagcagcacatgcatgccgggctgacagagcagcctttgggtgttcttttcccagaggagctctacggtgactttgaagacttggaaacaggggacgtgcacaagggaaaatcgggccccgatactcaggtatgactttgtcgtagctggctgttcttggtcattgtgttctgagagaggcccgcattgagaaatgcaaatcttacttgtgatgtgtgaagattgcagactggatggatagattccttcctaaagtgtggggatgtggggaccaaagagaagctttcttatttacttgttaagttttggactacagttactaccgtttcttgccatagtcatttgccaagtccactgtgatttttcactcacagaagtcttagcttctcagacttacattcaaccattgccatcattctcctctttttaaatttaagtgtcatttaaaagaatgaaatccctgttctccctaatatttctttagaacagggtctgggagcatctgggtgagggacatgtctgttatttttattctagtttgtgttcccagccagcttaaggaatagcagctagttgtaatgcagatgtaacaatttcctgtagcagtaccatgttattcagagacaaaggttatgttgtgttttgttttgttttattgataatgataacagatttttgctaagatttttgtttaaatagaactttaaaaaatctaatgtttaaagaaaagaccttcataaacatacacaaaattttttcttctggaaatttaagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacaggtgagaaacctcagttcctctcagccccttgtcaagactatcacatagtgtaggaatccctgactttctttgggtccctgcttcctatcctgcttctgtgcctttcacttggactcctgggtagatgcatgtgagtgtgtttattcatgcagtgagctcattgtttctacagtcagaaggtcaccagaaaaagatccatacctattttgtaacaagaattaggaaaccgaaatgactgagacatggtctctacttttgagacttttacaatgtagcgatctgagatagtgtgttcatttcagtgcaagccaatgctgcctattccgatcgctgctccctgatttgaatggcaggtgatcagtggcccgtgtggcttatggacacaccagagctcccaggggaagtgctctgaaaacatcctggtcagagttcagaaggacatgtggagtataaggtcagatgcggagataagggagatggtgtggccctcctgcccaggggtgctgagcaggttgctggaggcggtgatctcactctgaaggagacagacacagaaacgtatgtacagttgatggtgagcatctgagttgcgtcttgttagtgaggccaggagtgcctgtgtaagctggaacagattaggtatatgatttgtgaaacggagtttcatcctacgtcttcatctagtcaaaggactgtttcctgattaggcattagcttagtggttgctagtctgtgttgacctttgaaaggcatgactaggctaactctgaagttgttgcttcacaccatttacaatttaaaattacctagagccttgtgggccattggaaaagactgaatgtttcactctgaaatgggagtccttggagggttttgaccagagaagagacattcaggtaatcagatcactctgccaagagatcagtccagtggcacaaaccagagggctggcagtggagatgagacagagtcaaacccggattgagtttatttggaagctgggtcagtaggatttcctggtggactgaatgtggggtgtgtaagaggaaatgagggtggcgactggaagttcctggaagggtgggttgttgcaggttagataggaaaccgtctgcagatgcagttttgggaagatgatgtttggttcggctgggtatcatgcagacaagcggagtgtcaagtctggagagacaggtctggccagggacttagatgtacagccctcagcatgtagatgccacttaactctgtgaggtggccggggagtgagtgcagagtgactgggaggagcaagactggcatgggcgagatggggcgattgcggccgtgaggcctgagcagtgcctaggagggagagggagaagcagtgtgagcatgcaggcacgcaggagtccagttgtacacggaggcgaagcactgttcagatcccgctgcagtgttaactacggtaaaggcagagttgaccactggaggagtccttcagcgtggaggccttcagcgatcttggcaagcaccaattttcgtggatgtaggagaatgggagcagaggaactggaggctgcaactgcggaaaacttttgtggggttttgctgcagagagaagcagagaaatgaagcagttgttggtggaagaaatggaatcaaaaggttttgagatagagaacagagggaagagctgttggaataaagtccaggaagagtggatggtgtctagtgagcaagtgatgtgtggccctgagtagaggcacgtacaaatcacctgtgcctgagctgcccttagaactttctgtgatcatggagatgcacgtctgtgcttcccaatattgtaacattggccgcaggttgatatggaccacttccagtgtgactagtgtgattgaggaactgcattttaaatattatgtaattgtaattaattttaatttaaatagccacacgtagctcctctataggccaggtcagagctctgataaggctggatatgggaggaaaccctggtagagggttgactgtagaggttcttttggttttggagtgaatcaggaaacagccatcagctgagtgaaggtgagggtggtggtgggtgtttgaagacaagggaaaagtgtgaaagaattgtttggagaggaaggaaagaagatgtggactggggatgtttccaatgttcgagcacgcagggctccacagttatctacatttgctgtcccttggagcaggagagaagaaaacggttgggacatattctgagcagactgtagaggtaaaatacgtagtttttttttgttttttgagatggaatctcgctctattgcccaggctggagtgcagtggcacgatcttgactcactgcaacctccatctcccaggttcaagcgattctctcacctctgcctcctgagtagttgggactacaggcacgcaccaccacacccagctgattttggtatttttagtagagccagggtttcaccatgttggcgaggctggtttcaaactcctgacctcatgtgatctgcccgccttggcctcccaaagtgctgggattacaggcatgagccactgtacctggccaaatatgtagtatttttaataggataaagcctacataattctgtccacagttcctttacttagaaattgctcatttgttcatgttaatgctatgtttattacagataacagcatacaggttttccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcaggtgggtccctttgctgcatatttggtgcctgaggctctgtggatttcccctccatcaatcatcttaccctctcatccccctcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagccttttttttttctttcttttttttttttttttttgagacagagttgcactctgtcgtccaggctggagtgcagtggcacaatcttggctcgctgcaacctctgcctcctgggtttaagcggttctcctgcctcagcctcccgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacataagttgtccttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgtactgtttttcagtatttggggagggtggtttgagcagcatttattgacaatttcattagtggggatgtttctattgaaaacagggttaggaagtcataaaatgttcctgcaatataaggtaataataccaccagcgtttatcttactgttttcatgttctaagtgcatgcatctgagtaaaaggatctgggctgcagtccagtctgagagatgccagcaaaggcttcctaggccagttcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatgattttgtgtgtgtgtgtgtgtttttatcttgctgtacctgtagggaatgtttaattcagccttggaagtggccaaatttgaaggtgctgtgattcgaactgtcagtgggataagggggcagatcaagaaagcactctgagctccagaaggagctttccgggccagctttgaggataagctgctgatgagcggtgagtgtcttaagtagtgttcagggcagggtgttaccattcatgcttgacttctagccagtgtgacgagaggctggagtcaggtctccggagagttgagcagctccagccttagatctcccagtcttatgcggtatgcccattcgccttgtgtctgcagccccctggccacacccagtaacagttctgtgatctatgagaatagttcccttagcgacctttcccttcaaatactttgcagccaggtagagaagtttggagtgaaggttttgttctttgtttcttcgcaatatggatatgaatcttcttttgaaaatattaaagtaaattacctcttttcagatattgtcttcatgcaaacttggtatcctgtttccatcccagccttctgtaacccagtaacatctttgttgaaaccagtgggtgagaaagacacctggtcaggaacgcggaccacgggccaactcaggcttgcccatggtgtcagactaaaggcaaacaaggactctctgtataaggtactggtcgtgtgtgtgttagtggagatgaagcctgtgctctacagacagggagtcacacagacacttttctataatttcttacgtactttgaatgttcaagtataaagtctaacattaaatttgattgaacaattgtatgtttgtgggatattttggagtggaacaccaaaaaatggtaatagtggttctttctggattgaagacaaacttttcttttttaaaataaattttattttatatatttgaggttgacaacatgatcttaaaggatacatatagatagtaaactggttactatagtgaagcagattaacatagctaccatctcacatagttagatttttgtttgtgtgacaggaacagctaaaatctacttatttaacaaaaatcccaaagacaatatatttttattaactatagccctcatgatgtacactagatctctaacttgttcatcctacatgtctgctactttgtattattttaatgtacatctccccatttcctattggtcatttcctatttggcccatttttcaactgggttgtttttctgctattaagttgtaagagttctttactgatttttggatattaacactttatcacatatgtggtttgcaaatatttcttccagtctgttggttcccctttcattttgttggttgttcctttgctgtgcagaggctttttagtttgatgcagtcctccttgtttatgtttacatttgtagcctggcttgtggtgcgatatccaaaaaattattgctaaggccaatgtcaagaggctttccccctatgttttcttctaggagttttatggtttcaggtcttatttgggtctttggtcttgtatctgttttgagttgatttttgtgtatggtgtatgatcagggtccaattttattcttttgcatgcgaaaatcctattattgaagagactatcttttttaccattgtgttgtcttgtttgcccttgtcaaaaattagttgacagtatatgtttggatttatttcaaaggtctctgttctgttccattggtctatttttttgtttttatgccagcaccatactgttttgattactatagctttgtaatacaattttaaatcaagaggtgtgatgcctccaactttttctttcacagtaatccgttggctgtttgggattttttgtggttccataagagtttcaggattgttttttcttttcttttttttttttttgaggcgaagtctcactctgtcgcccaagctggagtgcagtggcataatctcggctcacggaaacctctgcctcctggattcaagcaattcttctgcctcagcctcccaggtagctgggactacaggcacatgccactatgcccggccaatttttgtagttttagtagagacagggtttcactctgttggccgggctggtctccaactcctgacctcgtgatccacccgctgcggtctcccaaagtgctggaattacaggcgtgagccactgtgcctggccaggattgttttattcggttctgtgaagaatgccatcagaactttgatgaggattgtgttaaatctgtatatttgctttgggtagcatgaacattttaacaatattaattctcctgatccataaacacgggatgtcttttcattcgttcatgtctaaatttctttcatcaatgttttatggttttcaagtgtacacatctctcaccttcttggttaaatttattcctaagtttttgtttttctttgatgctatcgtaaatgagattattttcttgattgcttcgtcagctacgttatttgtatatagaaatgcaactgatttttatatgttgagtttataccttgcagcttaactgaattgatttagtagttctcacagttttttgtggaatctttggagtttttttacgtaaaggatcttgtcatctgcaaatagagataattttacttatttaatttagttgcctttttttcctcatctgattgctcttgcaagtattctattgaataaaagtgatgaggctggccatccctatcttgtactcaatcttagtggaaaagctttagttgttccccactaactatgattagactgtgggtttttcataaatggtctttattgtgttgaggaactttccttctatacataaactattaagagttttatcaagaaacgttgctgaactttgttaaatgcttttactgcatcaattgaggtgaccatatcgttttatctttcattttgttaatgtgatatatcacattgattgatttacatattttaaatcagccttgcatgccagggataaatcccacttaaacacgatgtataatgtttttgatatgttgttgaattctatttgctaaaatttttttaggatgtttgcatcagtgtttaatttattggagaagttgacctgtagtttttgtttgtttggtgtgtgtgtgtgtgtgtgtgtgtgtgtgtgtgtgttttggtttggcttaggtattaaggtgatactggcctggtaaaatgtgtttggaattatttcctctcgctctgttttttcgaagagtttaagaagtaaactcccaggggatgggagtgactctggacatgggagtgacatgatagtgactctggaccctgcagtggtgggacacagcagcatctctgtctctgtgaggccaggcgcagcatcagcaaggaccccagaatggtggagcactactgtggcttgggccctcgggggcagggaccagtgcagcaactacttctctccctggggaggcaggtgcctgggcaactcagattctccagagctagtccagttccaaggaagcagggttctacagttgtttgtcctgaagggcaaggtaccccagttcagccaatgccgttttcctgggatatgggggtgccatgttggctcatccctggcaggtgtggctgctcagctcagccaagacactgattccctgtgaagcagggcagcgcttcagctctcatgcagtggggggtgtgactgctcagactggccaaggcactgattccctggaaagcagggcaccaagtcagctcaggctccaaggggcagggcgcaatggcagctgggaggggaggggcacagcagcatggccctgcaggtggggtgtatgctgtgatgtggacatcatttgttcccaccagccatttgaaatttcatccatttgaaatttgattccaaatgtggtggtgtgggaggtggggcctagtgggaggtatttgggtcacagggcagatcctttatgaatagattaatgccttttcatgggactggattagttaccaggagtggattgttatcagagtgagttcagcttcctagactctcgtgtttcctctcttgccatgtgagccccttgcatacacctgtttccccttccactttccctatgagatgaagcagcacaagaccctcgccagttgtgctgcccaatctcggacttttcagacacaagcagggtgagccaaataaaccttttttataaaataagttaccccgagtctcaagtattctgttacagccacactaaatggcctaagacagtgtaacagcggctcgggggtggtgggccactaggtgggtgtgatatagagcaacaaagcctgaggatggaagaagggtgcggtggcagctcaccctgggtgggacatgctcccgaagtggtccaggtccaggagggcacgttgcagcagcagctggtccatgggggtggggcacaatgtcagttccttctctgaggggagtgctggggctactgggcccctcttgcttccttatccctgcagggagacatcccctctgcttcaggctgatccctctgggggaatgggtggtgggggccagatgtttccttccctcctttatgtgaccgtcctggttttctgtgctctgctggatttctgctactccttgatgcactctggggctctcttttagtgactttcatcaaaatatagatgtttgctgctttggctgtctttgtcaggggatgagtgcaaggggctattgatcagccccttgctggcatcactccctcttaaacttttcactgggtactcttttgaactattttttcccccaccgtatacatgtattttttaaacgttaatgtgctaatttctactgaagcaatgtggatttttctgaaagttttaatgttttaataagctttttattgaaatgttaatgtccacacagaagagtgcccgaatcataagtgtgcatctagatgaactgtagcacaccaggctgccacgccctggaccaagcagtagcctcgccctgtggcctctcccaggcactgctgccccaacccacagaatagctactttcccagttcctgatgtagatttgttctgcctggttttgacttctataaaatacagcacattctgtttagcctggcttctttggttcagtattacagaacacatccatgttcttgtctatggcagacattgatttatcgtcattgttgagttccattatatgactgtgtcaccatttttccattgatgagtaaaatgatttcctatttttggctgttatcccacggccctgaacactaggtctggatatgggacttgcaggtatgcaggggcacacgcacttctgctggaggatccctgggtggggtggagactccagggcacctgtgctctgcttcagtatggagtagttggagtgtattgcttagaacaaaagagatgagacactaacactgtgtgtatattctaaatcatatatcagtgaagaaatgtgatgtttgcaacatcttctctggggatgctaaccccctaagtcattattaccatgcatgtaagcacctcacctagatctgcactccatctagcagtgagaaattccaccataatctacacaccataatatcatcaatgtgtctagaagtcagatcctctatgtgtgaaccaagacaatgcctggcaaacaagacagctgggctctcaggtctctgcaccatggggaggtgtgtaaggccattcttgaattactataaagaaatctctgagactggatgatttacaaagaaatttacaaagaaatgttgaattgactcacagttctgtgggctgtacaggaagcttggtgctggcatctgctccttttctgggatgcctcaaggagtttttactcacggcagaagatgaagtaggagcaggcatctcacatggcagaacaggagcaggatagagagtgggtaggaaaggtgtcacaaatttgaacaaccaaatcccatgaaaactcactatcataaggtgaaaaccaacccaagaaggatactctctcatgacccaagtacctcccacaaggtcccacttccaaccttgtgaattacatttcaacatgagatttagtttagcatccaaactataccattattcccctggtctctaaagtctcatgttcttctcacatggcaaaatacaataatgtcttcctaacaatccccaaaactcttaactcattccagcatcaactcagtcgaagtccacagttcagagtctcatttgagttaaggcaagtccctttcacctataggccagtaaaataaaaaacaagttatttacttccaaaatacactggtagtacagacattgggtaaatattcccattccaagagagaaaaaactgccataaaaaaagggctacagatgtcatggaagtttgaaaccccgcagggcattcattaaatgttaaagctccaaaataatctttttttgactccgtctcccacatccagggcacactgatgtaaagggcaagctaccaaggctgagggcagttctacccatttggctacgcagggttcggcccctgtggctactctcataggctgttaagtgcctgcagcttttccaggtgtaggatacaatctgccagtagatctaccattctggaatacagaggacagtgacctccttcccacacctccactaggcagtgccccagtggggactcggtctggggcctccaaccccacatttcccctccacactgacctagtagaggttctgtgggagggttctgcccccacaacaggcttctgccttagcacccaggcttttccatacatcctctgaaatctaggtggaggttgttgaggctccagcactcttgcattctgtactcctgcaggtttaacaccacatggaagcttccaaggcttaacatggcttttgctccccaaaactgtggcatagcattatctggagcctcttgagccaaggctggagctgaatcagccatgaggttgcacaggactgtggggccctaggccagacccagcaagccattcagttcacctaggcctcaggacctgtaatgtgagaggctgcctcagagatatctgaaatgcctttgaggtctttttcccattgtcttggctatcaacacttggctcctctttagttacgcaaatacctctagcaagtgattgtttcgcagcccacttggattcttttcaggaagaggggatgttattttctgccacatagtcaagctgaaaatttttcaatcttctatgctctgctttccttttaaatataaattccaaattaaagtcatttctttgatctcacatctgagtataggctgtagacacagccaggccacctcttgaactctttctgcctagaaatttcttctgccagatactctaaatgattgttctgaagttccaacttccacagattcctagaacatgaatagaattcagccaaactctttcctaaggcataacatgggagatacttgccccagttcccaataagttactcactttccgtctgagatgttgacagcctatgcttcattgttcctaacaccatcagcattttgatcacaaccatttaaccagtctctataaagtctgaagcattttctaatcttcctgttgtgaacccccaaaattggacacaagtctcagttaactcagaaagcttattttgccaaggttgaggaggcacatctgtgacacagcctcaggagatcctgatgacatgtgtccaagatggtaggggtacagcttggttttatgcattttaggcagacatgagacatcaatcaacatgtgtaagatgtacatcagttcagtctggaaaggtggaacagctccaggtgaaggcaggacaacttgaagtggggaaggggcttccagtcttagatagataagagacacatggttgcattcttttgagcttctgatgagcctctccaaaaggaggcaatcagatatgtgtttctctcagtgagcagaggggagactttcaatagactgggaggcaggtttgctctaagcagttcccaggttgagtggggtcccaagatttgttttcctttcacactgtcttctcctgagccccccaaacccttccaacctctggccatgactgagttccacagctgcttttgtactatcaggtatcttttagccatactttatttaccaattatctgtgttaggacattgttgcattgctacaaagaaatttgttgggaaatttacaaacaaaagaggttgaattggcttatggttctgcaggctgtacaagagtcatggtgcctccatttgcttggcttctgaggacacctcaaggggattttacttggtggaacatgaagtgggagcagacatctctcatggcagggtgggagcaagaaagagagtaaggcaggaggttccacacatctaaacaatcagatcttgcaagaactcactcactgtcatgaggacagcaccaagcctcgcggaatccgcttcaatgacccaaccacctcccaccaggtgccacatgcaacattggggattacgtttcaacaggagattgagagaggacacacatccacactatatcaggaggtgtgtgccttgcaaccatcaggggatgctgcaggactgccctatggtccctacacagctgcttagtaagaaccattcactccaaggaacctgtgccctgtgctcaatgatggggactcaggagctgtgtcctctctggcctggcagagtcccctaagcagagacctgtgtatggtctcggcaggtgcttcctcccagggccctcccgagggggaaaccaaaccttcctcctcctcagtctggagtgtgagctaagcttcagctccagggctcagggaggggctgggcagtccttggatggaaacatatttgcatgagcagcccctcctctggcagaggatggagaagaagaggagacctggggcagctcaggcccactgttagggctcaggggctgtgtccaccatggcctggactcttctccttctcgtgctcctctctcactgcacaggtagggaaagtccttataaactgagtctcagtgtccaacctacaccatcccctgtggctcagacctacaagaagctttaccctgggaactgccttatcacccatgatgtctgtgttttcaggttccctctcccagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactcacacagtgctccagacccatgaggaagtaagacaaaaccctcccctctactctcctggtctagtgaaatcacccctgctggtggctctgaccaaatctagctcagggggtgacatctgttgtctcatcgacagcactggagctcccacggagaagtaggtctaacaaagtcctaccttgctcgcatttcacaggcagacatcccttgctcaggggtaaaatctctcagtgttgacattgaagaaggcaagagggctgggttggggttcatctcagctcagagtctagaagtgactcagagatgctgctggtctgagagttttaatatgagccttgggatacaatacagggatgcagatgggaattgtattctctatgtcagtaacgaaccatcagtaattgaaaagtcaatacattgagaatagcataaagcatgaaatactttaggataagtatgacaaaaattgttgttttacacactagaagtcctaaaacattgtttagacgcaggtcttaaagaagacctgagtaaatgcacagataatccttttttttttttttttttttttgaggcagagtttcactcttgttgcccaggctggagtgcaatggcatgatcttggatctcggctcaccacaacctccacctcctgggttcaagcgattctcctgcctcagcctcccgagtagctgggattacaggcatgtgccaccacgcctggctaatttttgtatttttagtagagatggggtttctccatgttggtcaggctggtctcgaacacctgatctccggtgatctgcccgcctcggcctcctgaagtgctgggattactggcgtgagccaatgcgcccagcccagataacccttttttttttttttttttttgagcaggagtctcgctctgtcgcccaggatgcagtgcagtggcgcgatcttggctcactgcaacctctgcctcccggttgaagtgattctcctgcctcagcctccctagtagctgggactacaggcatgtgacaccatgcccggctaatttttttttttccttgtggcaacggggtttcaccgtgtttggtcttgatctcttgaccttgtgatccgcccaccttggcctctcaaactgctgggattacaggcatgagccaccgtgcctggccccagataaccctttttatgtgagagtgtagagaatgttgctgcagctggtgtgggatgggggatggctgggttgagactgtgttgtcacctgcagtgtacacctgaggtgacatggttctgaacatcactttccccattgaaggcccgagtgacctatcacttgcttctcaaaattcaggaactaggtgactctaggagagtgcacaggaagctttctgcatattctttcaagagatttcgaggtcactgactcttttttcaagacttaaacacaaaatccacatccatcattcttgcgtaaagagaccattcttttttttttgagatggagtctcgctctgttgcccaagctggagtgcagtggcatgatctcggctcactgcaagctctgtcttctgggttcatgcccttctcctgcctcagcctcccaagtagctgggactacaggcacccgccgccatgcccggctaattttttgtattttttagtggagatggggtttcaacatgttggccagaatggtcttgatctcttgacctcgtgatccacccgccttggcctcccaaagtgctgggattacaggtgtgagccactgcacccggcccaagatggggtttcatcatgttgacctggctggtctcaaactcccaacctcaagtgatccactcacttcagcctcccaaagtgctgggatgacaggcgtgagccacagtgcccggcctagtacattgtttaaatggtgcatgtaaaacctcatggtactacaactgcctggtgacagactcaccagagtaaataactatcctgctgttctccaaccacatgggattccccaaacaaagatttgttgagtccaagatgcatcatgccagaactcttgcagtcatacacataatttgtttcattttaataaatacggttatcttttttcttcagtttattgtttttaatgtatcatcttctaggtttcattacacatcaaagatgaataatttctctcatctttaggacatgctgaaaacactcattagtgattttgaacagtattatttcctaaacatcctagttggaatggttgatcctaaaagctaccatgtgtcaggctcacctgagtgcagactgtggtctaaacaagctaaagttttaattcttccatcttcaaatacggagcatatttgcttgttttgctctttagcaaaacactgcaaagtcattcgccaggatctcctgcagactggcattcagtgatggagaacagactcctaggtgagatccctggtcacaggatccagatgactatgactgcaagtctggaaaagaagagacagaacaaagatttaccagcataaccctctgagaatgtgccccagccatcctggagggaagagctccctattgacccagcactgcagaatccacagaggaaggacagctctggccaccagggagcagccacacgacaagagaggacccggtgtccccacaggtgaggaaatgagtccatggggctggtcagtgctctcgatttcattctgccataacaggactttgtgtagtcaccacctgagtcctatacagtgaacagccaaggagacatggacagattcacccctgaggaacccagtagaatgtgaagtctgccctgaggtcacgaagaaaagactcggggggctgcctggcctggccctgatggagggggccatggacagaacaacggggaggcaggggtgtctctgagaggctctggtcaccttgtcatacaatggtggtgtacaatgtcgcaccatggacactagggggcgcctgcgcaccattcctgagaagactgggtgtgatgagagcaggaccagcgccacctgtcctgcttggtgccctatgcttagggctcacagatgtcaactctccaccccctgggaccacacagccccacccctggcactctctgacatcctcaggcagaggagcttgacccagggcccagggtgggatcagaaagctggagggtctgatttgcatggatggaccctccttctctcagagtataaagaggggcagggagagacttggggaagctctgcttcagctgtgagcgcagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccagggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggcacagtgctccagcccaatggggaactgagacaagaacccccttcttcctcccccaggagggtgagtgccgccagctgctgctcacgcctgacctgtagcttctgctgctgcaggttctcccatgggccacggggcagccagggccctgcctaggagtggaggctccaccacttttgtcctcagagtcaggaacagggactccaggaatgagaatatcctgctcctgcagcttgggacacagggtctctgcactgacatcctgggctgaggtggcaggtccagctgtgtcttcacagtccttcctgtgcctgcccatggtgtggggagggagggagtggggaagggggtgtgggcctttgagcttcactagagacctgagggagcagaggtgctccccaagacctggactccttccctcaccctcctcccatcactctcctcactgtagctatggccaggtgagggctcagggctacttgaggaccttgctcagcccagggcctccatcccaggcattgtttccaaactctgtaagggctgtctctgaatctgtagaaacagttatttctatgtgcccaggactgggttagagggcaccaaccccaccccttgcaaactgctcctcacctcttagcgccccagtgaggagaagaaagagttagaaatcaggaatctactcagggctcccctctctcccctttcccagcctcccctggctttctctttctacagaaacaccaaggaggcagccaccaaggacgaggggaggcccaggcattataccaggcagcggagccagccagtccccccagatggtggagggaggtggtggaggtgtctgggaccagaaaatagtgaggaccctcttactgaagtgaggacgggtggcataaactgaggcccagatggtggaccagatctcctgagccatctactcatttcttcgtgtgttccagtttgggtaagaataggctaaaaaaaaaaaaaaaaggctttgaagaggttcctttcctcagataagaattcgtagaggattattgcccactcaggcattgaggggaggctgagcctcactctcaggccaatagaactgggggctttcaagggaatttgattgtactgagctcccagactctgacatctaagatttttgccctcgtagccgaacccagcactgataccaaaatggatgaaggctgatagataagcctagaatattctagctggcaccatctcgtggaaaagagaatcaagttagaatattgatgtgataaggtggcatcgcacagtgaggggaggagagcttgcatgggggagggtagaggagccactagagggctggacaaggaggagacagtctgaggtaagtttgtgaggaaaactccagatgcttcagagaagatggacaaggaggtaggcagtgtgaaggccatgggaccagctctagtcaccgggagagagtggtcagattcagcaccagtgtctggggaggaggtactgaagcctgggtgaggggagaggctcaaggctggccttaggacctgagtggggcacagtgatcacactgctggggggtccttcaagtgcaagggggctgcaggaaggcttgagctcattgtcacaatgaaaacttagacaacagctccccagccttgttcaaaggtgtcacaggactttttcctctccacatggcaacgtggagaagaaaacttatctctgagatatataagatgttagttctccataacctctcttgtcccctggctgaattcctatttggaaacaaaatgactctccagttttatatatgacatcctcacaaaaaaaaagttccagaatgagaaagatctgccctccctgacccactggtgaggaatctcagccttcaggacaaccagactaaatcattcatgccatctcccatgacagcatcatgtggaccagggagcctaccttatgggtttgggccacacactgcctgtccctagcattgcagctggggacacttacatgctgaactcatggctgggagatctgaggtccagacatgacaggaaaaggaaaaagaccaggagctctgcctaagtagcccccctgtgtgaatcactctaccctccaccctcatcttcagttcgtgatgggtattgtcttgtgaaaactgaaagctgggctgggacacaggcaagagagtctctgactcacaaatctccatcgtgggctctctggcctttctgatattcttttcacacatcaattctgggccaagacacatccatgctcatcaagaaggcattgataggagaatcaggtagcctccagagagacaggaagcagataaacaccctcatgttggcctcctaagcccagaggagaaaaaaaaaagttggaggggaagaagttcaagaagccacactagaagccactgattaccatcacctcggcacctgtcctccatctgcccctctttcaagtgaggaccagactcaggggacagcacctgcacctccccctctgtccatgcactgtgtagggagcctccttctgctctcatctcaaggtggctgctccgccaggtcagccgtatcactgctgagagtcttccctgggtcctggtcacagggtctgggatcagcagcaacctggctttgattcagctctgaccctgccccttcaggacacaaagcccattattaaagggataactgaactctcctagttcactcaaccttagattttccttctcagtgtccttctagaaagtgccgcctctactaaatgatttcatgttatttcctcaggtctagagctatttgatttccaaaattctatactcttctgttctcattcccggtcatggctcattttccctcagcagctaatgatgctaatcatgtatctaccccccattgtcacaaaaaagagagatggaagagttccttagataaatacagggttagcaaagaaaagtttcattatctcttaagaattactccaagatctggccaggcgtggtggctcatgcctgtaatcctagcactttgggagtccaaggtagacaggtcacgagatcaggagatcgagaccatcctggctaacatggtgaaaacccatctctactaaaaatacaaaaaattagccaggcatggtggtgggcacttgtagtcccagctactgaggaggctgaggcaggagaacagcgtgaacccgggaagtggagcttgcagggagccgagatcatgtctctgcactccagcctgggcaacagagcgagactccgtctcaaaaaaaaaaaaataaagaattactccaagatctaagaaaattaattccagttcttcaagagtttactcctcagaaacaacagcatgaatacattaggtagtgaatgttcttggtcttctcaatgaataacgtctgaaaggttcagagtatatgtttcaaaaaggtaagtgcataactttcaaaaaaatgtagtattaacatgtcaacaattttaattggtatatatatttctgaaaaaaaagcagtatgatggtaaaagaaatgtaaaaaagcctttgtaaaacccagtgcttacagtccaccaggatagcacctgtgaagcaaatttcctttgctgaagatacaccgccttttagaataatagcaagatagtttgaatttgtcttcttctctcacagcaatctaaaaattaacttaatcccatttatatgacatatctagaaatattcctgtacatgtggacattcccatcgcacacctcccatccaggctgtcctaaagtggcatctcctcttcttctgctcatgttctccccctctcctcacctctcctgctgacacgtggctcctccctgccttcctctccagtagccccagcagatcaggcccaaccagtgaacaagctcctggacttcttggatttctgaggacttgccctgccagggtgtctttctcaatcacaatctctccttcccgggagtccaattctcctagatcctgttatttatctaatgttatacatctgtatctacttggtggacttccctacatcttcacccgaaccccaggaatcttcaggtcatgcccatatgaccttagttctcctggagtcccttcttccttcttcccctgtgatcccaccaagtggagatctcttctcagaccctggagtgcagcagggacttctctggtctctgccccagggattaagggggtggaattgaggactcctgtgcccttcctatgcctgtgttttcatcagggtcagctgcacaaggtagggattcccactctcagagtatgaagaggggcagggagagatttggggaagctctgcttcagctgtgggcacaggaggcagcactcaggacaatctccagcatggcctggtcttctctcctcctcactctcctcgctcactgcacaggtgactggatgcagatcgaggggagggtccctgggaagcctatggattcttgctttctcctcttgtctctagaagcagaatcatgatgcctgtgtctctcccacttccagggtcctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgaatgctcacacagtgctccaggcccagggggaggtgagagaagaacccccttcctcctctaccaggagggtgagcgctcagctgctactgctcaggcgtggcctgtggcttctgctgctgcagcttcccccatggtccaggggcatccagggccctgcctcagagtagaggcttctctttttttctgttctgagaatcatgcacagcagctccttcctaggaacagggcctccagggaccagaacatccatctctttgtaccttgggacacagggtctctgcagtgaagtcctgggctgaggtgtcaggtccaactgtcatcacaaacctgatgcagaacctgtgtctccatcaacctcatttcctgatttctggaagttccgactgttggctttctgtccctgctcctcagggtgaatcgcttggcttctttcctccccagcctactctttttaataaaaccctttccaaggaggaataatgtccatacgagaaaacacctatatttataatataccatgacacccattttggcatgtttctggatccttgaaagcatcaccaccaccgagctatgcaagctgtgaccaaccccagcagctcctcatgaccctttgtcatctccctttctaccccaatgccctcccgggaagccacagatcctcctctgtcattagtgtttggtttccattttctggaaggtatcagtgttcacaaacattctcttgccatttgttgaggcttctttcactccgcacactttttgagattctccctgttgttgctgaatgacatctcatcccataaagggctcatcagtacctttgagggcccctagccattttgcctttcatgcccattcctgcatttgtatatacacatatagaatccagggtagcctatattccttttaatctgaattttaaaaaatcaatacattttctggggcccctaacagcgtcgagtcctgtaggcatttgatcttctctctccagtgatgctcagccctacttgcatctcatgcgattatactcacttctcgccattattcaacaattttgttttattctcttggttttaaataggcaatacacaaacaagatgccacatgagaactatggaaaccacttccccctcctacatcctgtctcctggcctgttggtttctctcagctgaagtgaccaggaatgcttacatttatgttccctcccagccaggatctgtgtgtagaaacaagggggtctgtctgtgtctgtgtgggcaaccacattatgttttctttagtaccactacaaccttactattgacaaacaactttttaattcctgagactgtgacttcatgtaatcctgacagtagcccgattattgcttttgaggcagtggtcctgattggagaggaactgtttgtgacctggggatggcgttctctaatttatcaaatgtaaacactggaggtcagttaaatttgaattcggtaaaacaatgatgaagaatcaataggtaggctgggcgccgtggctcacaccttaaccctggcacttttggaagccaaggttgatggattgcttcaggccaggagttcgagacaagtctgacccacgtggtgaaaccccgtatctcctaaaaatacaaaaattagctgggcctcatgacatatacctgtaatcccagtgactcaggaggttgaggcatgagaatcacttgaacccaagaggcagaggttgcagtgagctgagaccgggccactaactccaggtggagtaacagagtgacactctgactcaaaaaaaaataccaaaaaaaaaaaaaaagagtcagtatgtgtatcccccagacaatattgtgtatttaaatataaacataactgggtgccctttaatttatctggcaactccacacagtgtcacaacctggaagaagcatagctggggcagtcatccccttactgatgctgggtctaggggcttaactacaaagacagagctttgctagcaaagatacactcaagtgagcacatcagtgagcatgaaatgcatgtgatataattcccaatgaatgatgcctcctcacttctctaattattctttctattatccttcaagtctgcagattcagggcctccccagggattgcttcagcctgagcgctagacaagtgatctcatgtcctgtcacacccagatgcatggggctactctgtccccacacagaggggcttcagcctggggtgcataagtaacatgtgagagagagaagagctcagcctggctctgcttatatctagtgagagaccaacttcgggttcatttgatgctggaggctggtgagctgagagcagaggagagaccaagccttagagtgcagggctttcaggagagaaattgggaacctggaaatgggccacactcttcagtgaggaagaagcaggcagctctaggcacagccctgcattcctagtggcttccccttcatcaagcttgactccctgctttgatgtctgtcagggaatctacttcagcaaggtgaagatcccagggctttactaaaaatagcagtagaccaggcaggtatgtcatggttcaagagttctgtgcacagaaataaatacagatgcatattcacaagggccctcacagttgtctcttttggagtggaagagatgaagaaaggcagggagaaattgaaagactcagtcggtctgggcctggggcagcactggatgctgtggacttatccctgaagggtctgcaggtgaccacagccaggaagccagcccctgctatgaccctgtgtcatctgctcactgctcactgagctcagcagctgtgtcctcacaggaaactgggtgcagccagcttggccttctccaccccacctggaaaatgtgggcaggtgactgtcagcattgagatcctatgaaggggctgggagacaagggaagagggctgatttgcatgaagcaatcattccacacccttatctttaaactatatcccattaatggaagctctggggccatccaaacctgatcaatctaagaggggttatcagctggaggtggtcagagtgaggaagaaactggcttccttgaaagactcatcaacacagccaccaactctgggacaaatggggtgactccctataactgtcacccgatattagccacaggagcctgagcctagtcccctcaccttattgcttctgattctggtccagtcccctgttgtccctggacccttgcctatgtctgagtccagggtggcaggggtagccccatctcagtcaacatctatagagaggtaagagctactacggcttcaagcagagtccacagttttacccatgagggcctcttttgctcccccaccctgtcacacaggtgactactgctgtgggtctggtggagtggcccctggcccctgaaggacacaaggtattccttcctctctaacaccaggcatatagtggagaaggtatgggtgggtatagaacagattggcttttctagatgcaaatcggtaagaccctggctacagaaaaattatttcacaaaaccccacaccctttcgtgacaaaaacactcagtgaattatgaatagaaggaaattacctcaacatagtaaaccctatgtatgaaactcccacagctaacatcacgtgcaatctgaaagactgaagatatttcctgtaacttcaggaacaaagcaaggatgcgcactttcaccacttctattccaaatagtattggaagacctagccagagcaattagccaagaaaaagaaataaacagaaaagaaattagaaatgaaaaagtaaaataatctctgttttcagatgacctaatcttatatgtagaaaatccataaaacttccaccaaaatagcaaactcttctcagctaagggaccatgttctaacccaatgaagggaagctaagaaccttgataaaaggttacaggaacagctaaatggaataatcagtttagagagaaacataaataacctgatggagctgaaaaacacagcagaagaacttcatgaagcatacacaagtatcaatagctgaaccaaaccagtggaagaaagtatatcagagactgaagatcaacttactgaaatgggtgtgaagacaagataaggcaaaaaagcaggaaaagaaatgaacaaagcctccaagaaatatgggactatgtgaaacgaccaaacttacaattgattggtgtacctgaaagtgacggggagaatggaaccacgttggaaaacacacttcaggatattatccaggagaaattccccaacctggcaagacaggccaacattcaaattcaggaaatacaaggaagatcactaagatactcctcgagaagagcaagccaaagacacataaccgtcagattcaccaaggttgaaatgaaggaaacaatgttaagtggatccagagagaaaggtcaggttacctacaaagggaagcccatcagactaacagcagatctctctgcggaaaccctacaagccagaagagagtgggagccaatattcaacttcttaaagaaaagaattttcagtccagaattttatatccagccaaactaagctacataagtgaaggagaaataaaattctttacagataagcaaatgctgaggtattttatcaccaccaggcctaccttacaagagctcctgaaggaagcactaaatatggaaaggaaaaactgctaccagccactgcaaaaacacaccaaaatataaagaccaatgatgctatgaagaaactgcatcaagtaatgtgcaaaataaccagttagcatcatgatgacaggataaaattcccacataataatattaattttaaatgtaaatgggccaaatgccccaattaaaagacacagactggcaaattgggtaaagagtcaagacccattggtgtggtatattcaggagacccatctcacatcaaaagacacacataggctcaaaataaaggaatggaggaatatttaccaagcaaatggaaagaaaaaaaaaagctggggtcgcaatcctagtctctgataaaacagactttaaacaaacaaggatcaaaaaagacaaagaaaggcattacataatggtaaagggatcaatgcaacaagaagaactaactatgctaaatatatatgcacccaatacaggagcacccagtttcataaaacaagttcttagagacctacaaagagacttaaactcccagatgataatactgggagactttgacactccactgtcaatattaaatcaatgagacagaaaatgaacaaggatatcccatccttagaaaaccccatcgtctcagccccaaaactccttaagctgatgagcaacttcagtaaagtctcaggatacaaaatcaatgtgaaaaattcacaagtatttctatgcatcagcaatagacaagcagaaagccaaatcatgagtgaactcccattcccaattgctacgaagaaaataaaatacctaggaatacaacttacaagggatgtgaaggacctcttcaaggagaactacaaaccattgctcaaggaaataagagagaacatgaactcagctctggaccaagtggacctatagatatctacagaaaactttaccccaaatcaatagaatatacattcttctcagtgccacataacatatattctaaaattgaccacataattggaagtaaaacatccttagcaaatgcgaaagaatggaaatcataacaaacagtctttcagactaccgagcaatcaaattagaactcaggatgaagaaacttactcaaaaccacacaactacacggaaattgaacaacctgctcctgaatgactactgggtaaataatgaaattaaggcagaaataaagaagttatttgaagccaatgagaacaaagagacaatgtaccagaatctctgggacacagctagaacagtgtgtagagggaaatttatagcactaaatgccacagcagaaagtgggaaagatctaaaattgacaccctaacatcacaattaaaggaagtttagaagcaagagcaaataaattcaaaagctagcagaagacaagaaataactaagatcggagcagagctgaaagagatagagacgtgaataacccttcaaaaaaatcaatgaatccaggagctggttttttgaaaagattaacaatctagatagaccactagctagactaataaataagaaagaagaatcaaatagatacaataaaaaagataaaggggatatcactactgatctcccagaaatgcgaactaccatcagagaatactacaaacacctctatgcaaataaactagaaaatctagaagaaaggatagattcctggacacatacaccctcccaagactaaatcaggaagaagctgaatccctgaatagaccaataacaagttctggtattgtggcagtaattaatagcctaccaaccaaaaaaagcccaggaccagacagattcacagctgaattataccagaggtacaaagaggagctgataccattccttctgaaaccattccaaagaatagaaaaagagagactcctctctaactcattttgtgaagctagcatcatcctgatatcaaaatctggcagagacacaacaaaaacagaaaattccgggccaatatctttgatgaacattgatgcgaaaatcctcaataaaatactggcaaactgaatccagcagcacatcaaaaaacttacccaccacaatcaagtcggcttcatcgctgggatgcaagtctggttcaacatacacaaatcaataaatgtaatccatcgcataaacagaactaaagacaaaaaccacatgattatctcaatagatgcagaaaagccctttgataaaattcaacatcccttcatgctaaaacctctcaataaactaagtgttgatggaacatatctcaaaataataagaggaatttatgaaaaacccatagccaacatcatactgaatgggcaaaagctggaagcattcactttgaaaaccaccacaagacaaggatgccctctctgaacacttctgttcaacatagcattggaagttctagccagggcaatcaggcaagagaaataaagcgtatttgaataggaagagaggaagtcaaattgtctctgtttgcagacgatatgactgtatagttagaaaacccaatcatctcagcccaaaaactccttaagctgataagcaactccagcaaagtcccaggatacaaaatcaatgtgcaaaaatcgcaagcattcctacacaccagaaatagacaagcagagagccaaatcatgagtgaaccctcattcacaattgctacaaagaaaataaaatgcctaggagtacaacttacagggacttgaaggacctcttcaaggagaactatacactactgctgaaggaaataagaaaggacacaaaggaatgaaaaaacattccattctcatggataggaagaatcaatatcgtgaaaatggccatattgcccaaagtaatctatagattcaatgctattcccatgaagacaccactgactttttctgcagaatagaaaaaagctactttaaatttcatatggaaccaagaaagaacctggataaccaagacaattctaaacaaaaagaacaaagctggaggcatcacaccacctgacttcaaattacactaccaggcaacagtaaccaaaacagcatggtactggtaccaaagcagataaatagatcaatggtacagagcagagacctgagaaataacaccacacatctacaaccatctgatctttgacaaacttgacaaaaacaagcaatggggaaaggattccctatttgataagtggtgctgggaaaactggtagccatagacagaaaacagaaactggaccgcttccttacaccgtatacaaaaattaactcaaaacggattaaagacttaaatgtaaaacccaaaaccataaaaaccctggaagaaaacctaggcaattccattcaggacacaggtgtgggcaaatactttatgatgaaaataccaaaagcgatggcaacaaaagctaaattgaaaatgggatctaatcaaactaaagaacttcggcagagtaaaagaaacaatcatcagagtaaacaggcaacctacagaatgggagaaaatttttgcaagctacccatttgacaaaggtctaatatttagaatctacaaggaacttaaacaaatttacaagaaataaacaaacaaccccatcaaaaaatggactaaggatatgaacaaacacttctcaaaagaagacatgtatgtggccaacaaacatatgaaaaacagcgcatcatcactggtcattagagaaatgcaaatcaaaaccacagtgaggtaccatctcacaccagttagaatggcaattattaaacagtcgggaaacaacagatgttggtgaggctgcggagaaattggaatgcttttacactgtcagtgggaatgtaaattagttcaaccattgtggaagacagtgtggcaattcctcaaggatctagaaccagaaataccatttgagaccagtaatcccattcctgggtatatacccaaaggattataaatcattctaccataaagacacatggacacatatgtttattgcagcactctatgcagtagcaacgacttggaaccaatccaaatggccatcaatgacagactgaatatagaaaatgtggcatatatacactgtggaatactatgcagccataaaaaagaatgagttcatgttctttgcagggacatagatgaagctggaagccatcattctcagcaaagtaacactgaaacagaaaatcaaacactgcatgttcatactcataagtgggagttgaagaatgagaacacgtggacacagggagggaaacatcgtataccagggcctgtccgggggggctgggggtcaaggggagggagagcattaggatgaatacctcatgcataccgggattaaaacctagatgacaggttgataggtgtagtaaaccaccatgtcacatatatacctctgtaacaaacctgcgggttctgcacacatgtatcccagaacttaaagtaaaataaacaaacaaataaataaataaataaataaataaataaaataagtcccaccaaaacaaaaactgttagaactattaaatacatttggtaatatttcagaatacaaaatcaacacataaaaccatctaatggacagccatgatggctcatacctgtaatcccagctcttggggaagctgaggtgaaaggattggttaggatcaagagagttcaataccagcgtgggaaatgaagtgagaccctgtctcaaaaacaaacaaacaaacgaacaagcaaacaaacagggttcttatatttctatacttaatcaaccaaacaggaaacaagaagacaggacacaacgcaaaatgaaattaagaaaacaattcaatttacaatagcatcagaaagaataaaatacttaagaatcaagaaggggactcttctatactgaaaactataaaacattgctaaaagaaattaaagaatacacaaataaatggaaagaaacattgctaaaagaaattaaagaatacacaaataaatggaaagaaaacatttgttcatgaattgaaaaacttgatattgttaagaaatcaatacaaaccaaaagaaatctacagattcatttcaatctctattaaaattccaataatttttttgcaaaagtagaaaaaattaattctaaaatttacatagactatcacaggactccaaatagccaaaatgatcttctaaaagaagaacagtgttggagatttcacacttcctgatttcaaaacatactacagagctacaccaatcaaagcagagtggtacagatagacagacacagagacaaatagaatagaattgagcacccagaaagaatctcttagttatatgatcaaatgattttaaataagggtagcaagaccattgagtggggaaaggacagactccataaaaaatgtttttgagaaaactggatatccacatgcaatgtggaaatggataaaagacccaaatggaaaagccataactgtaaaaatcttaatagaaaacactaggaagaagtttaacaacattgggtttggaaatgatttcttgtatttgacgccaaaagcacaagaaaaaaaaaagaaaaagaatatagataaattggatttcatcaaattgtaaaatttatgtgcaacaaaggactctatcaacagagggaaaatgcaaatcatggagtcagaaaatattttgcaaacattgtatctggtaaggtgtccaggatatagaaagaactcctacaactcaacaggaataaaaaaatagaaacaatctgaataaaacatgggcccaagacttgaatagatatttctccgaagaagatcaataaatggccaataagcacatgaaaagatgtttagcatcactaatcattagagaaatccaaatcaaaccacaataatacacaacttcacacccagtaggatggcgttaccaaaataatagaaaataacaagttctggcaaagatgagtagaaattgtggagaaactataaaatgatgcatccactgtggaagccttatggcagttcctcaaaaaattaaacatagaattaccattttaacagaattttcacttctgggtatgtgcctaaaagaattcagagcagggtctcaaagagaaatttgtacacccttgttcatagcagcattgttcacaatagctaaaaggtagaggcagcccaagtgtccatctaatggataaatgggatatagtatacacacacaagggaatagtattcagccttaaagagagtgttctggcccatgctgtggcacagataaacctgaaagacatcatgccagcagaaataagctggcttcaaaagaacaaaaattgtttcattacccttatatgaggtacctagagtagtaaaagctaccgtgacaagaagtataatgaagtttcccaggtccttggggtggagagtagggggagaatggacagttatttgttttttgtttagtttagttttgctttgttttgtttttgagactgagtctccctctgtcacccagtctggagtgcagtggcacaatcttggctcactgcaacctctgcctcctgggttcaagcgattctcatgcctcagcctcccaagtagctgggattacaggcatgcaccaccatgttcagctaacttttggtattttttagtagagatggggttttaccattttgctcaggctaatcttgaactcctgggctccagtgatccaccgaccttggcctctcaaagtgctgaaatcaaggaagtgagccaccacaccgagccgggcagttcttgtttaatggttgcgaagttttagtttgggaagatgaaaaatttctgaagatgaatggtagcagtgtgattgtacaagttgatttacttagtgacactgaagtgtacacatgaaatggtgaaggtaacaaattttatgtttgaatattttaccacagtcaaaaagaggaagatttatatttggcaccattgctctacttccaagaacagtagaaagatacagtagtaggagagtgtgcacaagtatccaggacgtctttcattttttgccagccctgcagcatcctaacaatccaagagagcaggaggtgtctcattacaggggactcagaataatgtgaagaaatctggggcggggtgggggcataatgatagcacacaggtgccggacccagtccaggagtggccacaaatgcaagggctgcagaagagggggagatgaagctggtggcagtggtagcagctgcttcagctggaaaggggcatctgttgctttccaaagtggttcacagttgaaatatctggcatagatacttcatcctgcctacctttcatgactaactatattttcattgcaatatatgcagtcatagtgagaatacctatttcctccagatacaagcaaacgtgaaggaaatgtgctttagtgctttggccaacttgacatggcagtcacaaaaagaggatgaatatccaaagacaaccttttccaaagataaggttattataccgtttattgtaaatactggaagtgcacaacaatcattcagacacctgggaaaatgacttgaccaaatacagttgtgaaaacaatgagtaaagaaagtgatatattcttggtaaaagaaccactggatctagtgagtaaagaaccaaaaggagatgaccctagattggaacttttagaccaggaccttggtaacattggtcctgtttatgcaacaaaaacaaagcaataccttgtctaccagtgagaatctgaatgagggaacagcaacaggaagcagcagaaaaaaggaaaagaagctcagtgcaaacagctgaatggggagatcacagggaccaccaagaaggcccagggttttctgctcagtgccttccctctcatacaccttagagcacccactgaacaaagataactaccagtatattctagctgagcctgatccccacgcccttggtcctcagaagcttgaacttgactgctgggcaaaattccttattcctggagacctctacagaggctgcttgtatgaacaggttttgttagcctgacataattgagctccccagttaaaagtctccaatgacctgctggctgactgtggttgaacagaaggtctactctatggtacgggattctcatgggttaccttgatatcaccatggatgagatgccaccagacactgctgccagactgggttggtcccagtctttagataactgtcaagcttccttagtttatgataagtttaactattcttgggagaattaaagggaatgaagttccaccagtccactggcaaacactactcttctagctatagacaaggagacatcctgggattttatatgaatcttcctgaagaaacaaagacagtcaagtcattgcctgatacttacaaagataaggccttgataaagtttaagaattatttgtgttttgaggaaaaagactttgtgactgaagcagagaagagcctaaaagagacttcccacagtgagataagattttataaaaatggtgttagtcaaggcatggcttacaaagatattttcaaggggctttactttccagcaatcttaccagaaaacaactgcataatttccatgaacattggactgtgcttcaagtatcctccaaaggatctcacttactgccctatgagtgacatgggctgggatgctctggtagagcacactctggctggtgtcttggtgctagaaatggattcaatcactggacaagaaagtccttcaggggcaaacataaggacactgagggtcatcttattctacctgccttctctccttacttgtatcctaggccagcctatgctagcgcaactgtccacagatctctctctctctttctgtctctctctcgtgtgtgtgtatgtgtgtgtgtgtgtgcatgtgtgtatcaaatgatcaaacatcttcattcaaaagtccaagccctgcagcatcatgagacagtgctaccacacatgaagaaaatgttcaaagggcaccaaatagagatcgcatgatccaaagttatttctgatcccagaaaagaatggcacacaatcaatatgaatagtattagatatcaaaattatagtacaatctcatttgtttttaccatagattcaaactctctttagcatattggaaagcagaatccatgttctactgatgcaattccccttgaccatcatgaaagaattggactgaaagcaggacatttctgaagtctctggaggatacgtaacatgactgttggagggaatgcacataggaagaggtagtgaattatgtgtcaagtgccccaacaaaaggctgtcagtgtttgtctctgacacattgttggggagaaaggtggagtcacaggacacactgccatgggacccacgagacttgatcctacatcccacagcgggcagcctgcatcaacgtggtcatgcagggatagaaacacagccacagaaagctttcacctgcccaagcagcatctcccaagagccagcatgggtgctgtctctgctctgcttcttcctggactgtgtctcagagccctgagttctccctcacccagtttcccaatccccctcttctccactggttaccaggggttaggggagtggggaggggaaataaacgtttaaagggtacaaacttttcacttgggatgatgagaaagttatggaaattcataatggtgatgactgtatcacttttttttcagaggtggtaacttgctctgttgcccaggctggagtgcagtggtacaatgatagctcactgcatccttgaactcttgggtctaggcaagcctcctgcctcagactcctgagtagctgggactacaggtgcaagccaccatgccaggcaattctatcacattgtgaatatacttaacaccactgaattttacagttaaaagtgatttaaatggcaaattttatgttgtgtgtattctatgacaattaaaaatacacttgttcaaatgtcaaaatatatatgatgttatattcataaaattttccttttcacacttatatatttatcctattctaactcattctcatcaattaaaaaagtactgtaattactggtcattatgtactaaattttccataattcacattgaagccttaacccccaatattactgtatttggagacagagcattacagagggtaattaagatgaaatgagatcataaggaccggcatccttataagaggagattagaaaatggacaacataaaatgagatgaggacagagtgagaaggtggtcatctacaagtgtggacacatcttcagtttgtgtggagtaacagttgaagggctcgcccatcctataatgaaagttggaacaggtgccttgggcgggctccaggattaactgatctagtcactgcatcccactgtgggaccccagagggaaagaagcactgtggagattcctgagacattagaaatggagcctgagaaatttccaggacacccacatgggctccaggtgaagcaggggcccagaaggccttgtctgagccctgagtgtgacgcagcacctggccactagggggaggcaaactctgtgaatcctaagggacctgagctcttgctctgagccctgcccttgttaatcaccagccctgggagggagccgatttgcatggaatgtgatgtccctgcccacttcttcactgagggaataagaggctttagggcctcaggctcagctgagagactgaagaacccagcattgcagcagctccaccatggcctgggctcctctgctcctcaccctcctcagtctcctcacaggtcagggtgggcagtgggctgggcccccaaagggacccccacctcccagcctccatctccccatccctgctcttcctcctccaacagctcatcagccacccaccaacaggagccctcatgggtgtctgtgtttccagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgtaacccacagtgacacaggcagaggggaagtgagacaaaaacctcccggctgatctgctctgtccacacttccttcccactggcctgactcacatttcagagggctgtctcttaactctgtatttaaagttttcaccttcccagacattttggagttctaattcacagcatatgttccctgtgtgtaaatattttctcaagagcttttgaaacattgaagtttgcacaccaacatttgtggtttttgccactcacctgtcccctgatgggattgaagtttccaggttgtggaactgctcacaggtgcgtttatcaggaaatcaccgtcaccagctcccacgacctttgtccatattcaacatttgtgagctgcctattcaatgatgggaactgacaatttccctggagacacaaggccttcaccctgactcacagtgtcacataatcgacgtggacttcagccatctccagtcacctccatgtgcacagagctctcatggtacatgtgcttggctgccctagaaagagagaatggacacacaccaaagatagtagaatgtgagcctgctctatatctgagattctgaaagaggcccccactgccttcacagaatgaattccttcacatgcagggagagagctctggtggaatcactctgcaatgctttctgatgacaaatacctggattgaggtcaaatttcacaggttaataacccttttcaagactacctccactacagactccagttcccaggcattaagcctgaggacccttgtagacaaccaacatggggctgtgaccagcaggagcaatgggtaactgtcccaggccctgccttggggctgctcacagccgggtgagccccactggccacaggctggcagaggctgagctgctccctgtgctcgctgatgaaactcagcagcctagtgctctcagggtccagcaaagcctcttgggcagggtcctgtgcctgttcccaacagccgctccttcgaggaccctcctaggcccacactcgagcagctccttcctcaacctcctctgtcctcacatccccttttgggttcctgaatcagtgatcaggtagggtctcatttagccagaagggagggagtagatttgcatgaacagcttcttcttttccctgagggcagaaggaaaaatagtcaagcctggggaagcccagcccaactgtgaggtccagaggctgtgtccaccatggcttgttgcctgaactcctctggtacccaatccttggtctatgtttatagactcaatgaaaatacctccctttctactggcctcttaatgctaacagaatcattttgtcccctaagcacaaatagcctttcgggttgctgggtgggatgacaactagagcagaagtctagcatgtgcaaccccattcctggcccatacatgtccctgctcttggcccagtctttgctggttactccctgaactctgaaacttcagggaagttgagtttctctttctcttgagattgtactcttgaggagctcctgaatttccaggtatagggtgacccctcctcattaaggacatggctctcagacttatccctggtttacttccccaggtttaggtctgtgagttctaaacagtttccctatgtttctttggttgatattttggttgatatttccctttgtttctttaggttgatattacattgggtaattacattggttgattacattgggtaaatatattcttgtagatatacacattataaactcttcccccattaagctcttaataaataaacttgtttgggtgccaatgtaccaatgtaggtaagaagtcttgacgcttttttttttttcttctgcaggagcagaggagaacctgaaaaaaaaaagagagagagacaagttcagcttataatactgttattttcatataaactctcctactttaaaaagtacaaaactagacctatactgaaaatatttttaaatatatcagagtatctgcatctgtcactgtggagatggttgcttgctctaccacagagcacaataatactgagcctcatcttcagcctaggcccctgtgatggtgagggcagtcttgtcttcaagcacagagtgtgagaatcaagtggggaccccatgcagagatggggacgtcagacacacacaccctggctcagcctcacctcatgctcctaacatctccatcttcttcacacagaggctgctgctgcttctggctaacacgggctcctgacgctggttctccagggcccaagagaaagtggtcacatatattcttctaagctgcaaaatttgtatttttaacccaacatgttattataacaatgtgttcataaagcacaatactaagatctatcatcaattgcacagttatgagttatttataggagtggcaaaataaaaagttacgcacacacacacgcagattcgggcaggccagaatttaattacaggagcaaagtttgatattagtgacacaacataacaatgatcctatgtataatgataaacatagcaatggaccatatgaagctttgaagaaacatagtggaaacacagaaaaaatctccctctcaccaaattttagaaaattctaaaaaaaattaaaaatttttaaaacccctcaaaactgagttaatttataaaatatgatacaaaacataaagtttacataactttaacactcttcatactcagtaaatgcaggttctttctccacaatttaatccagtgtaccaaaaccgagccttcctgtttgctggaggaaaacctcagcaccacaacagtagaaaagcaccaacctctctgcccacagtgcatcttccctccagagactccgcaggactctgcatggtctcctgagggccctgaagtggaggttctgtgatgagaagggggcatggatggcacagggcaagaatgtctgcagggtaagagtgttagaaggacaagcttcattcctctctgaaacaagcctatcttacatgatttatctttattcttctctacaaaaaaaaaaaagtcacaaagatagctgcaaagaaatatgtgaaattatacaaggctaagataacaaagaatattggaagaaaaagtaattatgacatcttctatcgaaacattttaggccaagcgtggtggctcatgcctgtaatcccagcatgttgagaggccaaagcaagagaatcacttgaggtcaagagttcaagacaagcctgagatcccatttttattttttaaaagcagcattaaaaaaaaaaggttcatcatagtctcctcttcccacagttaataatgagaatggagaaagttcaaaaagtgaaaatttaagcaactcttatgtacccataacaattttttaaattttgaaaaagaaatgaaacccgtagcacaactgaccaccagcacacaggtgcctcttcttcagctgcccctcctgaagtgacaaccaaacccaggggctcagcacaatgagctctccctctggccatacattccctgtgaggccccatctactctcatcccaacacaattgctccccaggcatctggggactgctgctgagattctccactcatggggtcctgggcacagcggtgttatcccagtccccctcttcctctgtgtcctgggagctggaatcagagtcagcctgatctggcccaaagcctacaattaagagccctgagtggcctctcctgctttccccccacattggactcttcctttcagtgtccttcctggggtactgtgtcactactcaataatatcttatgtcctcagtgctaggcgtttttcacataatatactcttgttagtttctcctcacctttccaagctcagttatcaactctaggctgatgatcctaactattcatttacagcacattgtcatataaaggccagcgatatctagaaaaaaaagtgccaataaatgtgtgtactgcatcttacgaatcactacaaggataccacaaacaatatccctgtatttaaatagagttcactcttcagacacaagagtttaagtggagttcaatataatagtttatatagataatagttaatataacagtttaaccagtctgtctgtggctaaaccagtcaccatctcctgcactggaagcagcaacaataagggtcttgggcttgtgtcctggtaccaacaatgaccaggaagtgccaccaaacctctgatacatatgtacggatccatatatttatatccatatcctgcggcgaatatccacctgcagggatccaggactgaatctcaggctaccggtctggcaaggaggcattgctgagcatctctgggctacaggcttaggacaaggctgatctctgctgttggctttaggcagctccatcgaggtccccacagtgctgcagtctggggaactgagacaaaggcacaccaggtttccaatgagtatgagctacctgcagcaccacccactgtcaggacaactgggctctttaccgtttgtgtgtatgtttcctggtgctgccactaaccagtgcccaggactcaagtcagggacagtgatctagagaatgcagctttgttctttcagagccagcccacagagggagcccttagcaatggcacattgtcagactgcttcaaaagaatcagaaagcctttgattccaggaacaggctgctctggggacagacccgagatgggtcaggggaggcagggacagattccaggtggctctctctcaggcacatgcactaatgcagaggtctaatcatccctattgtctactgaacaactactatgtgccaggctatggggagggctcaggatacagagttaccaagacagacaaggttcctgtcttcatagggctgacaccaaactaaagagagacagtcaagaagtcaatgggaataaggcatattgtggtgtatcaaagaggtgacactggccagaagggggagaatgatagaacgcctttagtgggtcgtaagcaaggaagacacagccttttgtttgagatttaggaggaaagtccagcttcttcaaggaagacaaaaaatgaggggatagtgcgaaggcaaaaggtccagttagaaagcagtggcattgtgcacatgagagatgaggtatctagcatctgatgtagcagctgagctgggaggaatgtgcatgacccacaccatggtgagaaggactagaggaaagaggtcactaggttgaggccctgaccttgtccttgtgatggaaacctgacaacagcctgcagctgcgatcaagcatgtcactctcctcttctctctggaaagctcataggactcaggactcattgctgcccttccctcttattcagtgagatttatttgaaccatcacttttcacacctggacagagacctgcttactttctcttgagcaaaagcactaagggtcgggacagagcactgtagagcacatgggatgatgccctacacactcaaggggctgctgttactgctgttaaagctcacgatcaaacctcccagagctctgtcagaaaccatgagacgggaggtgtcagtgctgaagtagctgatttgggggcacactgatttgcagtctgtgcagtcctgatttggaggtgtgggacagtgagggctgaagcccagcatcggcaagaggttcctgaggtgtctttatgtgccagggtccttgtgaccacctcagtgatgtgtgggggtaaaggtcaattgaaaagctggagagcagtggacaggcaggattctgtgtctgggtgagggacgggatgttcagctcctgcccaggcatccttatttacatttctgtttacctctcttcttccttgtctccttcccagggcagggttccagggctgttgtatctccgctgctctttctccatcacaaagagagcaagagagacaggttatgtgatgactaattccctcttcacactcagttgtctgattgtccttaggaattcttcctgaggatgggaatgtgctgttttatttctcccttacagtgagatcctagccatttgtgaggccaaggagattgaccccatcctgtcgatgaaggattatttataacacacatggtcaaaaagaacatcatcaacttctgcacaagtcagtccattcgtcagggttatagaagtgcacgtctctcagctgtcagcaatgggcttcaaatccccaggatgactaacttgtcaggatgggatcatccacattaagatgtttctttacagttagtgactctattcactgtgtttcccctgctgagatccaacctctatgagattgtttattggctgttttctgtcttgttattgctgaaaacacttcctggcactaaggacagactcaatacatgtttattaaatatgtgagttcacctacattggaatcccaggaagaggtacaaacctgaggtcaagataataatttttttaaaaattctgaatattttgtgtttgagattccaagttcattcaatggaagatactaagtaatgacttttgcctttggatttggttagcaggagaaggatatggatataaaaatgcaaatatatatatcacacatacctccccatggcccagagacctgaaagcccagctggtctctgcagctgccaattgcagcctctgttcactcatttatggtctgattgtcatggatccatatatactggatcccatgggttcatgtggagaaagtggagaggatgcgatgggctttcccagtcctgataaaagaaaccacaggaagcgaatagatcataaagcaaattctggggacagaaaaccctcgagagcaaataaactgctaatatgggtgagttgggaaaatgtctggcaatatttatataactaagaaactttacattagatatccttccttcacaatattcattacggagctttaaatcatccatatgatcaatgcaattcaaacattaaactcatcaaccccaagtcccatagcagactttgatgaggaaattcttgaaggaagaagggtgggtttgtgagctctgtgtccacagaagagatatttctccactaggagaactgggtaaagccaataaataattaggaatgtagatgcccaactggactatattctaatccaatatgcaatgctgtgagtcctgcatctgcaaattgttaacattcattgtgcttccttcagtttcccaattactacaataaattaactttagacatggatgattacagaacagatcaattaatgtgagagtccttggaatgtgttgctttaatccacaaaaattacggaacacttcaaatgtatatatttgttaatttatgtaccaattgtattttactgcttcgttgatctgttgtaaaaatcacccagtgagggagtaagctgatgggtaaaatgggttgaaaaattaaacaagatgaaccacattgatgatggtcaaatttggctgatgggtgcaaacaattcattagaaaagtatctgtatatttgtatggttcaaaagtttccatgctatccagtgtttaaaatatccttgtttgtaactgttctgcttttaaccggtgtacaatgtggacaaaatgtaagcttacactctgactttgagtagaagcccatcttctcccaacaggcagaggagaagctggtgtggagaacatggaaaacacaggagctcagggtttcccaggacagagaagcgagtgagcctggagccctaaaagcaagggtggggctgtgagttgggctgtgggtgtgtgcaggggccacagtgtgaagggcatgcttcagaggccacaggatttggattttataataagaatgatgagttactgaaggggtttaagccaggtagtaccttccctgcctcatctatatgagagggatctgtatccaaatgcctggaggagagcgtgcctgagaaaagtgagtgatcctgattctagattattcactaaagcacctcgtgagtctagaaacccaagggccatttgcacagttagcacaagagtagacgtggcaacattgagaagtgatggtctctgcctttgtctcctctggcattcaatacttgcaaaaacactttgcaggtaaaataaatactgatatttcaaataacctgaaagcatccagtaaaaaaataaaggtggcaatatcaagatacaaacaaattgtataacatttaggacaaatcgtttaccaaaaaatatgacacgactgtgaagaaagtgacgttttacttagggagataatggctaacctcttaaaacagagatatatgtcacactgtgacaggaaagtctacaaaatctcttaatgttcctacatcacaaaattgagtcaaatctctataaaacatatgaaaccattagatgtataacttttgctaaattgctgtctttaacatgtattggatcatttatttttcctggaaaattctcattcttcactgtccttttgaacaaccccagctgcccttcaacccagctcctcagctgacccatttttcatgatgcccaccctgatggcacatgtgggcaactcgatttttctagaatgccatgcaggggtgctgacaactttaaaagttatatagtacatggctgcacatcccacagaccaagactacttctgggagtgagaaatcacagtaataatgcatagcatgatagaagcagtgtctgggaatcagaccatggatatgtgaatacagacagtgactggagagctgcagagaccagctgggttctgaagtctctgagctttgggaaagtgtgtttcctgggaccagcgtcggatgttgtggggctgccctgtggttctgacacagctgctcagtaaggagcattcactccaagaaatccaggccttgaggctgggccctgtgctcactgatggagacttggcagctgtgtcccctctggcctggcagagttccctgagcagggacctgtgtatggtctcaacaggtgcttcctcccagggccttgcaaaaagaaaagcaaaccttcctcctgctcagtctgcagagagagcagagctgcatccccaggtctcaaggaggggcccggcaatccctgggtggaaacacatttgcatgagcagcccctcctctgcaagggtgggaagaaaaggaggcctggggcagcccagtcccactgtggggtaagcggctgtgtccaccatggcctggaatcctctcctcctcctgttcctctctcactgcacaggtaggaaaaggcctcagagaccagggtcagccacacagcctgattctgactcttgtgtcaaagatcactaaaaaaaatattaccttggtttctgtcttaaagcctatatatgcctgtgttccaggttccctctcgcagcctgtgctgactcagccaacttccctctcagcatctcctggagcatcagccagactcacctgcaccttgcgcagtggcatcaatcttggtagctacaggatattctggtaccagcagaagccagagagccctccccggtatctcctgagctactactcagactcaagtaagcatcagggctctggagtccccagccgcttctctggatccaaagatgcttcgagcaatgcagggattttagtcatctctgggctccagtctgaggatgaggctgactattactgtatgatttggcacagcagtgcttcttacagtgacacacacagatggggaagtgggacaaaaacttcaccctgatctgggtcttgttctgtaacagtttttaaattttaaaataaccagccaagggacaaactaaatttggaaataactttctagttgtaaaaggctcttctctcaatttcccatccattcttctgaagtctcagtaaaacaaaaccaaaccaaagcacctgatgaccctgaagtgttggctggttgtccatatgtgctaacaccactgcctgcggagctggacttttgttcttgaaagaagcaaaatgaggctttcctagctcacatcatagtcagagcctggggacatcctagcaggtgaacagtcccctacagcatggactctgctcttccagcgtacaagcagagacctccccttccatccccactagtctgttctcagggctgtctgaggctcactgtgtcccaggaacaaggcactcaaatatgaaatgctgcctgaggacacaggtcagggaattccagatatagtgctgacctggctcagtcctgggtacctgcatttcagtggaaatgtcaggagatgggattacgtctgagggtaactgtggacctgaggccggtaaacctctatgtaggacatgagagagtcaaggggaggctccaccatggctgaggcaaggctgaggctgctccttggccatgggggaagtaggtcccagggatgtgactttcctgcagctcattccactcaggaccacggggactgctgagggtgggtttgctgatccctcagggcctgtgttctcttctcctctattgcaccattggaggttctcactgagtcaggttctagtagtgagtctgtggaacatctgggtacagatactgtttgcttcaagtgactcctccccaggaaactcttgagaaggcccccatctcaatgtcacctttttctgcatggggagcagcagaaacattgggcattccctcccagaaagagcccctaattttgtgacttaggacatcagcgattgtccctcaggggtccaagcctgattctcctgctctgggtttattcccacagcctcctggacaacttctgcgctccagcctgaggactggctggttatcagtgtcacacagctgcatcctgactccatgttaccaagggttcctattccatggggaaatgagagaaagatctgccccactcatcctctctgccccatccctcctttatccttgcctgtgaccaacaccagttcatgccaagacttttactgtcacttgtgttactgaaagcagagcaagggtgcagggatgataactccttttcttactggtctccccaatggaaacagaatcaacttgtttctagaagcaaaaggagctgcccacacatggtgggtgtggatgaggtggggatgacaagaaagaatccagccagtgtgacccagaagtccaggagccttcagcctggtcccacaggtgtcctctccttttggtgcaggtgtgctgatcatttcctgagctctgaatctgtgggaaagatgacaagaaaggagaatccagcctgtgtgacccaagacccatatgtgagagcggaagtctgacacttaagaaaacgtgggctcagcattctgagaggtctggatctggctcggcctagagctgctctagaagagaagcaagagaaatgctcagccttaggtggcccaggcacagtggtcctgtcaaaggtctgagctctctgcaacatggatatcctgcagagacatccttgggaggctgtgatcctagaatgatgtaaaaatgctaatggaagtgagcaggggatggtttatggaggaatgaggagatgggtgtggggtcagatgtggtaaggagggtgcaccctgaagaggagactgtccattgtgactcataggagaaggatgcccggggcctagggcagtgacaaaaagaggacctggaaggaccggcaccctgaagacacgtagagactggggtttggtttgtctgtgagggttcctgaggagaatcacataaaaaatccacagtcagtgtcttctgtccagggctcactgtcgcaactgttgccccttccttccagatcctctgggtgtccaggttccttagccgtggatctgctcctctctctgccctcagcctaagagctgatggggcatccaccaggaagcgcatccgtgggcagggaggaggccgtgggcagccttctcctgtatgtgagacactgctcagcctcggtgaccccctgttcattaaggtgggaggaaaggaaaacaaaattcactgtgaacatctatgcatcatcaaagaaaaagcaatgagaagaaacaggaagtgaagcccagctctaatagtttatttctacttggaaataaataaaacaatatgcctgatgtgttatataaacacaataaactttttataaaaactatgaaaattatgtaaaggagcatggcttacactaaaaggaacatttaaaataatgacacccttgaaatgcaatcccaaaacacagcatccattttatttcagttacatatacggactggttttatttaaatgcctgcaataaatctcactattttgttgtttaaatggagcatttaaaatctcattgtggccaggcgcggtggctcacgcctgtaatcccagcactttgggagtctgaggtgggctgatcacaaggtcaggagttggagaccagcctggccaacatggtgaaacccagtctctactaaaaaaatacaaaaattagccgggcatggtggcgcgtgctggtaattccagctacttggaaggctgaggcaggagaattgcttgaacctgggagatggaggttgcatttagctgagatggtgccactgcactccagcctgggcaacagaccaagactccggctcaaaataaataaataaataaacaaacaaataaataaaaaatctcattgtattgcaactgtctgatgatacattcacaagtataaatatcaacataaccatccagctgtttccctccatccacgtaaaattccccaaacaaatatttgttaagagtccagggtgtatcatgccagaactcatgcaatcataaacacaatctatttcatttttcattttgattaacagaattatcttttttcttaagattattgtttttagtttattagattctagatgtcattacagaccaaagatgaataattttcatcatcttcaagccacccccacaagactcactactgaatttgaaccataatttttccctggaaatcctagttggggtgctcgatgctaagagctatcacatatcaggctcacctgaggacagactctggtcgtcaaaccaagttaaaattttaattcttcccatgttcaaagactgaacatctttgctctttttgctcataagtgaaacactccaaagacatttgccaggatcccccacagactggcattcagtgcttggaggacagactcctaggcaagatccttggtcacagtatccggatgactatgactgcaaatctggggaagtagagggagaacaaagatttaccaggaaaaccctctgggaattcctccccagggcatcccagaggtaagagctccctttctcctcagcgcagcaggatccacagaggaagtggagccctggccaccagggaggagtcacatgagaggagaggacccggtgtccaacactggtggggaagtgagtccatggggccggtccccgctctgggcttgatcctgaaataaaaggactttgtgtagacatcacctgagtcctctacaatgtacagccaaagagccatagacagattcactcctgaggagtccagtagagcgtgaagactgccctgaggtcacaggagggagacacaggtgccaccttactgggccgggacttgggagcgggggcagtggccagaaaacagggcggggcggaggcagcggtgaatctcagaggctctggtcacctgatcacagaacggtttgccttagtctggacactagggggcgcttggggaccatttctgagaagacttggggtaatcagagcagaaccaggcacctgccctgcctgatgtcctctgctcagggctggcagctgtgtcctgtgtcctccccaccccctgggaccacaaagctccacccctgccacaccctgacatactcaagcccaggagcctgacccagggctcagggtggggtcaaaaaccggggggatctgatttgcatggatggactctccccctctcagagtatgaagagagggagagatctgggggaagctcagcttcagctgtggtagagaagacaggattcaggacaatctccagcatggccggcttccctctcctcctcaccctcctcactcactgtgcaggtgacaggatggggaccaagagaggggccctgggaagcccatggggccctgctttctcctcttgtctcctttcgtctcttgtcaatcaccatgtctgtgtctctctcacttccagggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggtcccacagtgctccaggcccagggggaactgagacaagaacccccttcctcctctgtcaggagggtgagccccggcagctgctgctcaggcccggcctgtggcttctgctgctgtagcttcccccatgggtccaagggcatccagggccctgcctgagagtggaggctcctcctccccttcatcctcagagtcatgaacaggctgtccaggaaacagaacatcctgcttcctgcaacttgggacacagggtctctgcactgaagtcctggactgaggtggcaggtacagctgtgtcgtcacagacccacctctgatgggaaacctgtgtctctgtcatcctccttttcccatttccaggagtttccagagtggtgtcttcctccccctgctcctcagtgtgaatccctgtgcttcctttctctccagccaattctttttttaataaaactcctttcatgtaggaataatgcatatttaataaaccacccagatttataataggaaattagacaaatgttgacattttttgatccttgaatacatcaccaccaacacgcagctatgcaacctgtgaccaaccccagcaacccctcatgaccccttgtcatctccctccctcccttccccagtgctatcctgtgcagccacagatctgtctctgtcactattgtttgctttccattttttggaatgtatcagtgttatcagacattatcttcccatttgttctggcttttttcacactgcaaactccttttgggattcttcctgttctcgctgaattgcacccatcccatagagggctcattactacctttgagggcctttaggttgattattcctgattttgtttatttattttaaagtttgaatttatcgtccatcaaaatcaaactcttggagttatgttcatctaaggtgacaggagagtctgtgatgtcttgtcgggattcttgcttcttcatctcttgcctctcgttctgtctatattggaagaggttctcatattctatttatttacttatttatttatttgggtttttaaggatttcagtgtttttttctctttaattattaatttttttattttaataggtttttagggaatcggtggtatttggttacataaataagttctttagttgtgatttctaagatattggtgcactcatcacccaagtagcgtacagtgtacccagtgagtagtcttttatccctcaccccgcttctaccatttcctcccagtcctcaaagtccattgtatcattgttatgcctttgtgttctcatagcttatctcccacttatgggtgagaatatgccatgctttgttttcaattcctgagttactgcacttagaataacagtccccaattctatccaggttgctgggaatgccattattttgttcctttttatggctgcatagtattccatggtatgcatatatttaacatttcctttatccatttgttggtttatgggcatttgggctggttccatgttcttgcaattgcaaattgtgctgctataaacatgcgtgtgcaactatcttttttgaataatgatttctttttctctgggtacatgcctagtcccagattttgggactttgctggatcaaagggtacatctatttttagttccttaaggaatctgttttccatagtggttgtactagtttaccttcccaccaccagtgtaaaagtgttttgttttcaccacatccatgccaacatctattattggccattcttgcggtattaaggtggtattgtattgtagttttgattggtatttccctgatcattagtgatgctgttcatttttctttatgtctgttggccattcatatatcttcttttgagaatttttatttatgcctttagcctactttttgatgagattgtttagtttttttcttgataatttgtttgaattctttgtagatgctagcccttagtcattaggtggatatgtagattgtgaagattttcttccactcggtgggctgtctgttaactctgctgattatttcttttgctgtgaagaagctttttagtttaattaggtcccatctatttatctttgttcttgttgcatttgcttttgggttcttggtcatgaagtctttgcctaaaccaatgtctagaagggtttttctgatgttatcttctagaatttttattgtttcaggccttaggtttaagtctttgattcatcttgagttgatttttgtataagctgagagatgaggatccaggtttatttctttcacatttggcttgccaattatcccagcaccatttcttgaacagggtgtcctagagtatagtttgaagttaggtaacctgatgcctctggatatgctttttgttgttgttgttgtttgtttgttttttcttagtcttgctttggctatgcaggctcttttttggttccatatgaattttaggattgttttttctagttctgtgataaatgatgttggtattttgatgggaattgcattgaatttgtagattgcttttggtagtatgatcattttcacaatattgattctacccattcatgagcatgggatgtgtttttatttgtttgtgtcatctatgatttctttcagcagtgttttgtagttttctttgtagagttctttaatctccttggttaggtatattcctaagtatttttttttttgcagctatttgttaaaggggttgagttcttgatttgatattcagcttggtccctgttgttgtatttgtgtgccttaattttgtatcccgaaactttgctgaattcattcaccagttctcggagctttttgaatgagtctttaaagttttctaggtatacgatcttattataagcaaacaatgacagtttgacttcctctttaccaatttggatgcccttaatttctttctcttgtctgattgctctggctaagacttccagaactatgttgaacagaagtggtgaaagtgggcattcttgtcttgttccggttctcggaagaaatgcttttaagttttttctgttcagtataatgttggctgtgggtttgtaatagagggctttcattaccataaggtatgtctcttctatgccagttttgcagagggttttaatcatgaagtgatgatggattttatcaagtactttttctgcatcgattgagataatctgtgatttttgttcttaattctgtttatgtggtatattacatttattgactttgtatgttaaaccatccctgcatccttggtaagaaacccacttcatcatggtggactatgatttgatagctgttggattgggttagcaagtatttagtttaggatttttgcatctatgttcatcagggatattggtctgtagttttcttgttttgttatgtccttcccctcattttggttttagggtgacactggcttcatagaataatttattccctctttctccatcctgtgggttaatgtattagtattctccagagggaaagaactaatggaatatatatatatatatatatatatatatatatatatatatatatgagtttattaagtattaactcacataatcacaagtcacacaataggccatctgcagggtgaggagcaaggagagccagtccatgttccaaaactgaagagcttggagtccaatgttcaagggcaggaaggatccagcactggagaatgatgtagggtgggagactaagccaatctctctttcacatttttctgtctgcttatattctagccatgctggcatctgattagattgtgcacgcccaggttaagggcgggtctgcctatcccagcccacttactcaaatgttagtctctttggcaaaaccctcacagacacactgaggatcaatactttgtatccttcaatccaataaagttgacactcaatattaaccatcgcaattactgtcatagacttggtgccaattcttctttcaatgtctgatagaattcaaatgtgaatctgtctggtcctggacttttttcgggggttgactttttaaaattattatttcaatctcactgcttgttattggtctgttcagagtttctacatcttcctggtttaatctaggagggttgtatatattcagatatttatcaatcttctctaggtttttcagattatgtgcatattatcttttatatagtttttttgttttaattttatttagttctggtctaatctttgttatttcttttcttctgctgagtttgggtttgcattgttcttgatcctccagtttcatgaggtgtgaccttagaaggtctgtttgtgctctttcaggctttttgatgtatgtatttaatgctaaacttttcccttagcactgcctttgctgtatcctggaggttttgataggttgtatcaagatttagaactactgcaaccttactattgaccaacaggtttttaattcctaagagtgtgacctcactgaatcctgacaacagctttatgattgcttttcatgcagtaggccctggttagagaggggagtgcttgtggcctggaggtaggattctgcaatttatcaaataaaaacactggaggtcagttaaatttgaattcagtaaaacaatgacaaagaattagtatgtgttagtatctcccacacaatatttttcagttgaaatacaacttatctgggtgccctgtcgtttatctgccaactcctcacaggattcaaggcttggaagagggagtgttggggctggcctcgtcttactgatgccagttctatgagatgaacctcaaaggcagagcttctctaacacagctaccctcaagaaagcacgtcagttagcactaaatacatggtataagttcctcaatcaatagtgcctactcacttccctaattcttctttgtattattcttcaagtctgcagactcaggacctctgctggggttgctgcagccagagttctggatgagggacctcataagcctttcaaaaccagacgcagggggactactcagtccccacgcagcggggcttaagccaggggtaaataagtaagaaatggaagagctcagcatggctctccctttgtccagtgagacagcaaactccagggtccttttgatgctgaaggtgcgtgggctgagagtagggggagacccaccctgagagcccagaacttccaggacaggacttgtcagtctgaaaaggggccacactcttgagtggggaagaaggaggcatctctcgccacaggcctgcatttctggtggcttccccttcaccaaactgtgctctctgctctgatgtctatcagagaatctccttcagtgagactaagatcccaggactttactaaaaataacagcatgaaccagatagatttgtaatggtaccagaattctctgcagagcaatgagtacaaatgcagcttaacaaaggccctcacactcataactgaaaggctcagtaggtctgggtctggggcagtactgggtgctgtaggcttgtccttgaggcatctacaagtaagaacaactgggaagccatcctgctgtgaccctgtatcatctgctcactgctcactgggctcagcagctgtgtcctcacagggaaccaggttcagccaacctggccttctccaccccacctagaacatgtattccggtgactgtctggactgaggttctatgaagggactggcagacaagaagagggggctgatttgcatgaagaaaccattgcacaccctttcctttcatctaaaacccattaatggatactctggggccacccacagaagtctagcttgtctcctaaatttgagagttaggaaggagtcatttcttatcaatctacaggtagaggggccatcagcagcagagggccagagtgagggagaaactggcttcgagagactcatcaacacagccaccaactcttggacaaatggggcacttgctataacagtcaccccaagctactcacaggagcctgagcctagtcccctcaccttattgcttttgattctggtccatgcctctgttttccctggactctttgcccatgtctgagtccagggaggcaggggttgctccatctcagtcaaaatctatgtatatgtaacagctactatggcttggagcagagtccactgttgtacctatgagggcctatcctgctccaccatccccttacacaggtgacaactgctatgtttctgatggactgacccttttcccctggaagacacaaggtatttattcctttctaacacaaggcatatagtggagggggtaggggtgggtgtgaagcagagtggcttttccagatataatgcagtaaggccctggttacagaagatcatttcacaaaattccacaccctttcatgataaaaacactcaacaaactatgaatagaaggaaacttcctcaacatagtaaaggccatctatgaaaatcctacaactaacatcgcatgcaatctgaaagaccaaagatatgtttttgtaatatctatcaggatcaaagcaacaatgcacattttcaccacttctattaagacagtattggaagacctagccagagtaattaggcaagagaaagaaataaacagaataaaaattagaaataaaaagtaaaattatctctgttttcatttgatttaatgtcatatgtagaatacccttaaaagtcccacaaaagaaaactttgtcagaatgattaaatgtattcggtaatatttctgaatacaaaaatcaccatgtaaaattatctcatggctgggcatggtgactcatgcatataatcctaacactttgagaggctgaggtgggaggactgcttgtggtcaagagttcaagaacagcctgggcaacaaagcaaggccctgtctctacaaaaagagagagagagagatgaaagaagaaaggaaagaaagaaagacagaaagaaaggaggaaggaaaagaaagaaagaaagaaagaaagaaaagaaagaaggaaggaaggaagaaagaaagaaagaaagaaagaaagaaagaaagaaagaaagaaagaaagaaagaaagaaagaaaatctcttacatttcaatacttgagcaaataggaaacaacccaaaacaaaatcgggacccacacccattaggatggctttacccaaataatggaaaataataagttgtagcaaagatgtatagaaattataactgtaatgcattgctggagggactataaaatgatgcatccactgaggtggccttgatgacagttgctcagaaaactaaacatagaattaccattttatcagaattttcacttctgggcatgtgcctcaaagaattgaaagcaggatctcaaaattgtccacccttgttcgtagcagcatcattcacaatagctaaaaggtggaggcagcccaagtgtcatctaatggataaacggaatatagtatacacacacaagggaatagtattcaaccttaaaaagaaagttctgacccatgcgatggcatggatgaaccctaaagacatcatgccaacagaaataagctggtttcaaaaggacaaatgttgtctgtttgctcttatatgaggtacctagagtagtgaaatccatagagacaagaagtagaatgatgttttccaggcatgaaattttggtttgggaggatgaaaaattcctggagacgaatggtggtacgtgactgtacaacaatattactttacttaatgacactgaagcgtgtggttgaaaatggttaaaatatgtgttttgtgtttgaataatttaccactgtcaaaaacaaaaagatttatatttggtgcagttacaagaaccataaaaatatacaggactaggagagtgtgcctgagtagccaggacacccttccttctgtgccagccccacagcatcctaacagaccaatagagttggaggtacctcattacaggtgacacaaaataacatgagaaagtctgagaatggccatgatggtaggggtgggtgcctgacccagtccaggagcagcctctagtgcaactatggccaaagaaggggagatgaagctggtggcaatggtagcagcctctccagctggagagggacatctgctgtcctatgaaaatggctcatagttgatatatctggcaaagacatgtcatcctgtctacctttcatgaccaactacagttttcatagtgctttggttaagctggcatggcagtcccaaacacaggatgaatgctatagcatttattgataaatactgggagtgcatgatgaccattcagacacctgggaaaatgactaggctggataacatcgttaaaacaatgagtaaagagagagatttattcttggtaaaggacctcctggatccagggagtaaagacctgaaagaagattgcccaagatttggacttttggatcaggactttggtaaaactgatcctgtttatgacaagcaaaagcaaagcagtgccctgtctgtgagtgggaatctgaatggggcaactgaacaggaagcagcagaaaagaggaagaggagttcagtgcaaacagcaagatgagatctcagagaccaccaagaaggcccagagtgaccctttgttttctgctcagcgccttgccccttacaccttttaaaacacccatttaacaaggatggctactggtatattccaaccgagcctgagccacacacccttggtcctcagaaggttgaagactgctaggcaggagaaattattcctgaagacctctacggagcctgtttctgtgaacaggttttgttagtctaacatgattaagctctccaggtaaagatctccaatgaccagctggctgactgtggttggaaagaagggttactctatgatgcaggcctctcatggggtatggaaagggacctgggactttgaaatcatcaaggatgagttgtcaccagacaccactgccaatggggttggtctcagtcctaaggtaaccatcaatctcccttaggttatgataaacttagctattcttggcagagcaaaagggaaccaagttccacctgtccactggcaaataatactcttctagctacggatgaggacaggtcttgggattttatattaatcttcctgaaaacacagagacagccaagttattgcctgatacttacaaagataaggctttgataaaatacaagaattatttgtattttgaggaaaaagacattttggataaagcacagaagagcctaaaacagattctgcacaggcaaataatattttataaaaatggtgtcaattaatatgttgaataaaaggtatttttgagggggttgatttccagccatctcacaggaaaacaactgcatggtttgcattaactttggactgtgctgcgagtgtcctccaaaggatctcgcttactcccttatgagtgacatgggctgggatgctgtggtagagcacactctggctgatgtcttgtatctcctggagacagaagtggatggaggcacagtcctccatgggaaccctgaacaggtccctctttcttttcaaatatggactttctggggaatgatactggacggcttctgtagttgttgttgttttttgaactgtctcaaatgttttcccaaagatgctacagaacatagcctatccatttagcaagtgaaaaggctgaataagactgggagagactccctgctcatcatcattcttcttccacttccagtgactgctcatattctgtgccataagccaacagctactgatcccaagatcttgtaatccctctgtaaaactggtgctgtactgcataccttgccagctgggactttttatcttactgcattttccaggaataaataaccttgtcccaaaaacaaacatatttaaagacatttccttctgtggacactgattccatgctatctgttttccaaggaagtggtgagcccgtttctgagaacacctggtatcaatggctgtcccttccaaaccaagcaaaaagtgatttcttgtcggtgtggatttggttttgttattaattttaaaacatacctttgaagacttagatctctgaaactactagatctctagaagtgtaattgtgaaaaaagtttgcttgcatcatcaacaacatgaaaaactctttctaaataaaatttgttttgaagttaaaaaaaagaataatgcaagattggaaactgggaggtctgaagattcccaagagcactctcaattctgaagctaattttcagctcagggaccccaaacagcccttcacttcttatgagtccctagaaggactcacatgactcactgaaaactgtgacattcattaatgtgatttttctacagtgaaataatacagattaaaataattcaaggaaagagacacatgggcagagttcaggagaattccaagcacaagcatccatttgtcctctcccagtggagtaatagacaacgctgcattctgccggcaacaatgtgtgattctatgtaggaagcattgccaaccagcaaagctcacccaggcttggtgtccagaaaaattttgattggtggggtgggtgagagtggggttgttatgtagaccttgatgaccatcctcatggctcacttgagtttccactgaattgacaataaaacttcaatcttcaacctttggtcattttcttttaaaaaattttctaaagaaaattattttaaaaagtctcatataaacgagctgtttatccaatatgaggctcaacgcaaatagtttcaaaaagtcagtaggtcattaaaacaattatttagtcattcaaactaaatatttagtcattcaaacgttgttatctggtgttcagatagcaacgaacaccatgtagcactaaaatcgcattatagtcacaggggcaggatttcagcaacagcaagagaaagtaatacaaacaggaatgagcaaagaatagacaagtaatgggtatgaattggcctgggaaatattgtggcaatgtccaaagacaaatcaatagttatttgttaaagaagtgaaagacaacacattctcagtccaggaaagccaccagggggtggtctgggtctcttggattgtaagaagctcaagaggttcaaacttaatgaaccctgcacagatgctcactgactcatggaaatgttagagcagctgcttcctcccacaggacaaatccacagcacacagccaccctgggctggccccccacagtgtagctgctctcagggctgtggacccaggtggtgataaaggcagtaaagatttgcataaagcagcacacagcacaccccctccgtgcggagagctcaataggagataaagagccatcagaatccagccccagctctggcaccaggggtcccttccaatatcagcaccatggcctggactcctctctttctgttcctcctcacttgctgcccaggttaagagagatttcaaataccagcctttggagggatccctttttctccctttctaattcctaatatatgtctgttttttttgtttcagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgctcggcacagtgacagacccatgagaggaaccaagacataaacctccctcggcccttgtgatgtggagatcacatgatcagacatgccagatcccaagatagcctacatgtggaccagccatagaaaggggaaggaaagggtttgaattgattcctatttctacttaagtcttgatgtgtaggaaatgtaagaatgatttgggagtaactggatcaaaaaaaaaaaaggaaaagttaattgttttctattctaaaaggaacactaacagcaggatcacatataaaggctgggtcaaaatgcatttcctccagaaagaagcatcttcagtgtataggctttctgagctaagagcaaagaaactttttttgcatattactgaagtttgttttattgagttactttcaaaccaatacctccagaaagaagcatcttcagtgtataggctttctgagctaagagcaaagagaagaaactctttttttgtatatgactaaaatttgctttattgatttactttcaaaccaatacatgcctattatataaaataaaaatattaaaaaccaccaagttcactgcaaagctgtctcatcagaaacaatccaatttcttcatttggatgcattctttcatttttgttctcaatatttccacaatgggggtcataccttgtgctttttctctctggttttacacatctttatgcctcctcccacaccctgtgcctctctcctgactctcagggtcctgggcagtcagggctcacttggtagcctgcacagtctgtctgtgacaaaaccagtcaccatctcctgcactggaatcagcagcaataaggttcttggaattgtgtcctggtaccaacaatgacaaggaagtgcctccaaacttctgatgtatagaagcaaatatctgcctgcagggacccaggatggatgctcgggctaccagtttggcaaggaggccttcccaagcatctctgggctccaggctgaggacaacgctgatctcaactgttggcttcagacagccccctggaggcccaaacagtgctgcagtctgggggagtgagacaggaacatgtcaggtctcctaggagcacgacctaactacagcaccatacaaccaggacagcagggctgtttaccatttgtgtgcatgtttgctggtgcttctgctaaccaggacccagggctcagattagggacagtgatctagagaatgctgctttgttttctcagggccagacttcagagagagcccttggccacagcattgtcagactgcctcagaagaatcagaaagtccttgatttctggaacaggctgccctgggaatacagccatgataggccagggcaagcagggacagaatccagctgggtctgtctcaggcatgtgcactaataaagatctctgtttgtccttattgtttactgaatacctactatgtgccaggctcaggtctcatgctaaggatacagaggtgagaagacagacagggattctgtcttcacaggactgacaccatgcagaaaagtgagggccaacaagtcaataggagtaaggcatattgtggtgtatccaagaggtgacactggccagaagggggagagcaataggaagcccttagggagttgtaagcaaggaagacacggagtctgatgggagacttaggagaaaagtccagcttctccaaagaagatgaaaaaggaggggagagagtgaaagtggagggtctaattaggagacggtagctttctccacatgagagatgaggtctccagcaagtgatgaagcagctgaggtggtgaaatatgcgtgacccacaccatggtgagtaagaccaaaggaaagaggtcactaggttgaggcccaaagcttgttcctgtgatataaacctgacaacatcctcttgccgttactgagtgtctcacacaccttttttctttggatatctcctgggactcaggactcattgctgcccttccctcgtattcagtgagattcatttcgaacatcacttttcacacccagagagagacctggctcctttgtatggagcaaaagcactgagggtcaggacagaacattctacagaacatgggatgatgccttacacactaaaggactgctgttaaagctcgtgatcaaacctccctggagctacatcagaaaccacgagaggggaggtgtcagcgcttaggtgcctgatttcagggcacactaatttgcagtttgtccagctccctcccaggcatttttatccacccctctctttacctcctttcatccttgcctccttctcagggcgggcctccaggcctgtggtgtctctgctgctctgtctccatcacaaacagagcagtagggagattatctgataatgaagttccctcctcatactcagttatctggttccccttaggaattcttctgcatcatgggaatgttctgttttatttctgccctacagtaggaacccagccatttgtgaggccaaggagattgacctctttccgttgaagcaggattatatttaacacatgtattcaaataacatcatcaacttatgaacaagtcaatccattcttcagaattatagaaatgcatgtctctcagctgtcagcaattggcctcagatccctagattggcgaacttgtcagggtggggtcagccacatgaagatgtttctttatagttagtgactctattcactgggtttcccctgttgagatccaacctccatgagactgtttatttttgttgttgttttctgtcttgtcattgcccaaaatgctgcctggcactaaggaaagacttaatacatgtttattaaatatgtgagttcacctacattggaatcccaaaaagaggtacagatctgaggtcaagttaataatttttaaaaaaattctggatattttgtgtttgagattccaagttcattcaatagaagatattaagtatgaagttttgcctttggatttggttagcaggagaaggatatggatatgaaaatacaaatggatcacacatacctccccatggcccagagtcttgagtgcctagctgctctctgcagctcctaatcacagcctctgttcactcatttatggtctgattcccatggatccatacatgctggatcccatgggcttatgtggagaaagtggagagaaggtgatggccctgctaaaaaaaccacaggaagcaagttgataatgaagcaaattctgggcacaaaatctctcaagagcaaataaactgcagaatatgggtgagttgggaaaatttctggcaatatttatataactaagaaggtttacattacatatacttcaacaaaatattaattctaaagcttccaataagtcatatgatcaatgcaattcaaacattaaactcatcagtcccaagtcccataatagactttgatggagaaattcttgaaggaagaatgatgggtttgtgagctctgtgtccacagaagagatatttctgcactaggaggactgggtaaagccattaaataattatgaatgtagtgcccatctggacttttttctaatccaatatgcaatgctgtgggctctgcctttgcaaatcgtagcattcattgtacttcctccagtctcccaattattacaataaattaattttaaacatgaatgattaaaagacaaatctattaatgttagagtccttggaatctgttgctttaatgcacaagaattatggaacacttcaaatgtatatatttgttaatttatgtaccaatgataaaatactgcttccttgatctgttctaaaaatcacctagaaagggagtaagttgatgggtaaaatgggttgaaaaattaaacaagatgaaccatattgatgatggtcaaagttggctgattggtgcaaacaattcatcagaaaattctctgtatatttgtatgactcaaacgtttccatgctaaccagtgaaaatatccttttttgcaatgagatgtttatgttctgcttttaccaggtgtacaatgtggacaaaatgtaagcttacactttgacttcaagtggaagcccatcttctcccaacaggcagaggagaagctggtgtggagaacatggaaaacacaggagctcagggtttcccaggacagagaagtgagtgagcctggagccctaaaagcaagggcaggggctgtgagttgggctgtgggggtgttctggggccacaatgtgaagggcatgttgctgaggtctcagggttcaggtttcataataacaacgaggagttactcaaggggcttaaaccagggagtgccctgcctgccctatctgagtgacagggatctctctgaatgccttgagaagagagtgtctgagaaaagtgagtgatcctgattctagattattcgctaaagcacctcgtgagtctagaaactcaggggccatttgcacagttagcacaagagtagatgtggctaaattgagaagtgatggtctctgcttttgtctcctgagacatccaactcatttgcaagagaattttgcaggtaaaatacatactgatctttctaataaactgaaaacacctagtaaaaaaatacacgtggtaatagcacaatgcaatttgtataacagctagaacaaattcttgaccaaaaaatatgatgcaactgtgcagaaaatgacgttttacttagggagataatggctaatttcataaaatagtgaaatatgtcacactgttcactggtaaaggtaagtctagcaaatctattagttttcctgtatcacaaaatcgaatcaaatctctttaaaacgtatgaaaccattgtaaatataacttgtgttgcattgctgtctttttttttttttttttttttttttagacagaatctcgctttgtcgcccaggctggggtgcagtggcccaatatcagctcactgcaagctccacctcccgggttcccgggttcacgccattctcctgcatcagcctcccgagtagctgggactacaggcgcctgccaccacgcccagctaatatgttgtatttttagtagagacggggtttcaccgcgttagccaggatggtcttgatctactgacctcgtgatccgcccgccttggcttcccaaaggaattgctgcctttaacatgtcattgatcctttatttttcctggaaatttttcattattcaccatctttttgaacaaccccagctgcccttcaacccagctcctcagctgaccccttttccatgatgcccactctgatgacatatgtgggcaaatagatttttctaaaatgccctgttggggtgctgacacctataaaagttatgtatgtacaggtctgcacatcccacagaccaagactacttctgggagtgagaaatcgtagtaataatgcatagcatgatagaagcagtgtctgggaatcagaccatggatatgtgaatacagacagtgactaaagagctgcagagaccagctgggttctgaagtctctgagctttgggaaagtgtgtttcctgggaccagcgtcagatgttgtggggctgccctgtggttccgacacagctgctcagtaatgagcattcactcagagaaatccaggccttgaggctgggccctgtgctcactgatggacactcggcagctgtgtcccctctggcctggcagagttccctgagcagggacctgtgtatggtctcaacaggtgcttcctcccagggccttgcaaaaagaaaagcaagccttcctcctgctcagtctgcagagagagctgagctgcatccccaggtctcaaggaggggcccggcagtccctgggcggaaacacatttgcatgagcaacccctcctctgcaacagtgggaagaaaaggaggcctggggcagcccagtcccactgcgggggtaagaggttgtgtccaccatggcctggactcctctcctcctcctgttcctctctcactgcacaggtaggaatagacttcagagaccagggtcagccacccagcctgattctgactcttctggcaaagatccctgaaaaactttaccctggtttctgccttagcacccattaatgtctgtgtttccaggttccctctcgcaggctgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttctcacagtgacacacacagatggggaagtgggacaaaaacctcaccctgctctgggtcttgctctgtaccaatttttaaattttaaaataactggcctaggcacaaactatatttggaagtactttctagttgtaaaaggctcttctctcaattttctatccatttttctgaagtctcagtaaaacaaaacaaaacaaaacaaaaccacctgatgaccctgaagtgttggctggttgtccacatgtgctaacaccagtgcctgtggagctggacgtttttttcttgaaagaagcaaaatgaggctttcctagctcacatcatggtcagagcctggggacaacatagcaggtgaacagtgccctgcagcatggactctgctcttccagcgtacgggcagagacctccccttccatccccagtagtctgttctcagggctgtctgaggctcactgtgtcccaggaacaaggcactcaaatatgaaatgctgcctgaggactcaggtcagggaattctggatatagtgctgacctggctcagtcctgggtacctgcatttcagtggcaatgtcaggagatggcgttagatattagggtaactgcgggcccgatgccagtaaacctctatgtaggacatgacagaatcaaggggaggctccaccatggctgagacaagccagaggctgctccttggccatgggggaagtagatcccatggatgtgactcctgtagctcatcccactcaggaccacggggactgctgagggtgggtttcctgatccctcagggcctgactgtgttctcttctcctctcttacaccattggagcttctcactgactcaggtctagtggtgagtctgtggaatatctggatacagaaactgcccaatatttgcttcaagtgactcctccctgggaaactcttgaggaggcccccacctcaaggtcatctttttctccatggggagcagcagaaacattggccattcccatggaaatggctatgaggcctcccagagagaacccctaagtttatgacctaggacaatagtgatggtccctcaggggtcccagcctgcttctcctgatctgggtttatccacacagcctcctggagtgcctctgggctccagcctgaggacctggctggttatcagtgtcacacagctgcatcctgactccatgttaccaagggttcctgttccatgtggaaatgatagaaagatctccccactcatcctgtctccccatccctcctttatccctgcctgtgaccaacaccagttcatgccaagacttcagctgtcagttgtgttactgaaagcagagcaagggttcagggacgataactccttttcttactggtctccccagtggaaagagaatcagtttgtttcaagaagtaaaataagctgcccacacatggtgggtgaggatgaggtggaaatgacaagaaagaatccagcctggctgggcatggcagctcacacctgtaatcctagcagtttgggaggcggaggtgggtggatcacctgaggtcaggagtttgagaccagcgtgagcaacatggtgaaacatcgtctctactaaaaatacaaaaattagttgggcatggtggctggcgcctgtaatcccagctactcgagagactgaggcaggagaatcgcttgaaccagggaggtggaggttgcattgagctgagatcatgacactgcactccagcctgggcaacaggcagagactccatctcaaaaaaaaaaaaaaaaaaaaaaagaaagaaagaaagaaaagaaaaaaggaaaagaaagaatctaggcagtgtgacccagaagtccaggagccttcggcctggtcccacaggtgtcccctcctttttgaacaggtatgctggccatttgctgagctctgaaactgtgggagtgataacaagaaaggcgaatccagcctgtgtgacccacagatgtgagagaggtagtctgatgcttaagaaaaggtgggatcagccttctgaaaggtctggatctggcttggcctagagctggtgtagaagagaagcaagagagatgcttagccttgggtggcccaggcccagctgtcctgtcaaggggctgagctctctgcaacatggaaatcctgcagagccatccttgggaggctgtgatctcagtaggatgcaaaaatgctaatggaagtgagcaggggatggtttatgggggaatgaggggacggtgtggggtcaggtgtggtaaggagggtgcaccctgaagaggagagtgtccattgtgactcacaggaggaggaggcccggggcccagagcagtgacaaaaggaggacctggaaggacctgggccctcaagacacacagagactggggttttggtctgtccctgagggtccctcaggaggatcacataaaaaatccatagtcagtgtcctctgtccaaggctcactgtcccagctgttgtccctcccggatcctctgggtgtccacatcctgtagttttggacctgttcttctctctgccctcaacctaacagctgatggggcatccaccaggaagcgcatccgtgggcagggaggaggccgtgggcagccttgtcctgtatgtgagacactgctcagactcggtgaccccctgttcattaacgtgggaggaaaggaaaacaaaattcactgtgaacatctatacatcatcaaagaaaaagcaatgagaaaaaacaggaagtgaagcccagctctaatagtttatttctacttggaaataaataaaacttaatatgcctgatgtgttatgtaaatacaacaaacatattttaaaaactataaaaattatgtaaaggcacatggcttacactaaaagaaacatttaaaataacaacacccttgaaatgcaatcccaaaacacagcatacattttatttcagttccatgtatggactggttttatttaaatgtctgtattaggtttcactatttggttgtttaaatggagcatttaaaatcttattgtattacaacttatatcaacataatcatcttgctgtttttctgtatccccttaaaattccctaaacaaatatttattaagagcccagggtgtatcatgccagaactcaggcagtcacagacataacctgtttcatttttcattttgatcaacagaattatgttttctgttaagcttgttgtttttagttcattagattctagacgtcattacagatcaaagacgaaaaatttctatcatctttaagccacccccacaacactcactactgaatttgaaccaaaatcttctcctagaaatcctcgttggcggctcgatagtaagagctgccatgtatcaggctcacctgaggacagacgctggttaaaccaagttgaagttttaattcttcccatcttcaaagactgagcatctttgctctttttgctcataagtgaaacactccaaagtcatttgccaggatcccctgtagatgggcattcagtgtacagactcctaggcaagatccctggtcacagtatccaaatgactttgactgcaaacctggggaagtagagagagaacaaagatttaccagaaaaaccctctgggaatgtcttcccaaggcaccctagagggaagagctccctttctcttcagctccacaggatccacagaggaaggagagctctagccagcaggaaggagccacatgagaggagaggaccaggtgtcccacacaggtggggaagtgagtccatggggctggtccccgctctgggcttgatcctgacataagaggactctgtgtagacaccacctgagtcctctgcaatgtacagccacagagccatggacagattcactcctgaggagtccagtagagcgcgaagactgccttgaggtcacagcgggaagacacaggtgtcacttgagctggcctggacctgagagagggggcagtggacagaacagaggggaggcagtggtgtgaatgagaggctctggtcaccttatcatagaatggtttaccttggctggacaccaggggacgctgggggaccatttctgagaagacgcgcggggggcgggggtgggcggtgatgggagcacaaccggccacctgttgtgcctgttgtcctctgctcagggctcacaactgtgttctccccaccctctgggaccacagagctccacccctgccacaccctgacatcctcaaggcaaggagcctgacccagggctcagggtggggtcacaaagctgggggggtctgatttgcatggatggactctccccctctcagagtatgaagagagggagagatctgggggaagctcagcttcagctgtgggtagagaagacaggactcaggacaatctccagcatggccagcttccctctcctcctcaccctcctcactcactgtgcaggtgacaggatggggaccaagaaaggggccctgggaagcccatggggccctgctttctcctcttgtctccttttgtctcttgtcaatcaccatgtctgtgtctctctcacttccagggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcccacagtgctccaggccaatagggaactgagacaagaacccccttcctcctctgtcaggagggtgagccccagcagctgctgctcaggcctggcctgtggcttctgctgctgcagcttccttcatgggtccaggggcatccagggccctgcctgagagtggaggctcctcctccccttcagtcctcagagtcaggaacaggacatccaggaaacagaacatcctcctccctgcagcttaggacacagggtctctgcactgaagtcctgggctgaggtggcaggtccagttgtgtcatctcagacccacctctgatggggaacccgtgtctccgtcatcctccttttcccatttccaggagtttccagagtggtgtcttcctccccctgctcctcagtgtgaatccctgtgcttcctttctctccagcctattcttttttaataaaactcctttcatgtaggaactatgcacatctaataaactacccatatttataacaggaaattagacaaattttggcatttttctggttccttgaaaacatcaccatccccgggagctattgtgaccatcccggcagctcctcatgatgcttgtctcctccctccctcccctaatggcctctcaggaagccacagatctgcctctctcactactgtttggtttttttttctggaatgtatcagtgttatcaaacgttatcttcccatttgttcaggcttctttcactctgcacacttgctttgagattatccctgctgtcgctgaattgcacccatcccttagagggctcattactatctttaagggtccttaggccatttttttctgattttattcatgtatttcctttaaagtttgaatttattgttcatcaaacaaactctatgggtgatgttcatctaaggtgacaggacagtccgtgatggtttgtcaggattcttgcttcttcagttcttttcttggctctctctatagtggaagaggttctcatcttttatttatttatttatttattttggggtttttttaagggttttagcgattttccctttttaattatttttaaaatttgttattttattttaataggtttttggagaacaagtgttgcttggttacatatataagttcgttagtggtgattcctgagattgtggtgcactcatcatccaagcagtgtacactgtatccaatgagtagcctctcatccctcacctccctcctatgctttcccccgagtccccaaagtccattgtatcattgttatgcccttgggttctcatagcttatctcccacttatgagtgagaacatacagtgttttgttttccattcctgagttacaccagttagaatgatagtctccagttccatccaggttgctgtgaatgccattattttgtttatttttatggctgtgtagtattccctggtatgtgtatgtatacatcacatttgctttacctacttgttgatttatggacatttgagctggttccatgtttttgcaattacagattgtgctgctataaacatgcgtgtgcaagtatctttttttgtataatgacttctttttctctgggtagatacctagtcgtgagattgctggatcaaagggtacgtctatttttgtttccttaaggaatctccacactgttttccacagtgattgtactagtttaccttcccaccgccagtgtgaaagtgttttgttttcaccacatccatgccaacatctgttatttttttattatagctattcttgtgataggaaggtggtaacacagattgtggtaccgatttgcatttccctgattattagtgatgttgaacatttttctatatgtttgttggccatttgtacaagttcttttgaaaattgtttattcgtgtccttagtccaccttttgatggaagtgtttatttttttcttgataatttgagttcttcgtacattctagatattagtcatttgttggatgtatagattgtgaagattttcatccactttgttggttgtctgttaactctgctgattctttcttttgctgtgcagaagtttttttcgtttaattaagtcccatctatttatctttgttcttgttgcatttgcttttgtgttcttggtcatgaaatatttgcctaaaccaatgtctagcaaggttgttctgacgttatcttctagaattcttaccgtttcaggccttagatttaattatttgattcatcttgagttgatttttgtataaggtgagagatgaggatgcagtttcattcctctacatttggcttgccaattatcccagcaccatttgttgaatatggtgtcatttttctactttatgtttttgtttgctttgtcaagcatcagtgggttggaagtatttggtttcatttctggattctttattctgttcctttggtctgtgtgcccatttttatatcagtaccaagcagatttagtgactatggagtcaaactttactggagtttgaagctgggtaatgcgatgcctccagatttgttccttttgcttagtcttgctttgtctatgcaggctctttttggttccatatgaattttaggattattttttccaattctctaatgaatgatggtgatattttgatgggaattgcatagattttgtaacttgcttttggcagtatgatcattttcaatgtattgtttctacccattcatgagcatgggatgtgtttctatttgtttgtgtgtgtcatctatgatttctttcagcagtgttttgtagttttccttgtggaggtctttcacctccttggctaggtatatcctaagtatgtattttgcagctatttgcgaaaggggttgagttcttgatttgattttcagctcgtttgctgtcattgtataacagagctactgattcgtgtgccttaattttgtatcttgaaactttgctgaacttatttacagttctaggagctttttcgatgagtctttaaggttttctaggtatatgatcatattatcagcaaatagtgacagtttgaattcctctttgtcaatttggatatctttgatttgtttctcttgtctgattgctctggctaagccttccagtactatgttgaatagaagtggtgaaagtgggcattcttgccttgttccagatctcaggagaaacgttttccacttttttccgtttaatataatgttgactgtgtgtttgtaatagagggcttaatagaggacataagttatgtcttttctatgtcaattttgcaaagagttttaatcatgaagtgatgctggattttgtcaagtattttttctgcatgtattgagataatcatgtcatttttgtttttaatgctttttatgtggtatatcacatttattgactcacatatgttaaaccatctctgcattccctggtttgaaaaccacttgatcattgtggactatgtttttgatagctgttggatacatagaataatttaggaaggagtccccctttttccttcctgtggattaatgcattagtcagcgttctctagagggacacaaataatggaatatatatatatgtttattaagtattaactcacatgaacacaaggtccaacaataggctgtctgcaggctgaggagcaaggagagccagtccgagttccaaaactgaagaagttggagttccatatttgaaggcaggaagcatccagcatgggagaaagatgtaggctgggaggctatgcccatctctcttttcatatttttctacctgcttattttctagccatgctgtcagctgattagattgttcccacccagattaagggtgagtgtggctttcccacccactgacaaaaatgtgaatctcctttggcagcaccctcaacagacacacacaccaaggatcaatacttttttttttttttttttggagatggagtcttgctctgtcacccaagctggagtgcagtggcgcgatctctgctcactgcaagctccgcctccagggttcaagcaattctttgcctcagcctcccgagtagctgggactacaggtgcccaccaccatggccggctaatttttttgaatttttagtagagacggggtttcaccgtgttagccaggatggtctcgatctcctgacctcgtgatccgcctgcctcggcctcccaaagtgctgggattacaggcgtgagccactgcgcccggccaatactttttgtccttcaatccaatcaagttgacgctcagtattactcatcacaagtccactccttgtcagcatgaacccatatacaacttgtgatatcgtacataatcttcaaataaagacaataataaagtcataattacgcctaacataatacaattatccttcatacaaccagaacgcacgaatccctaacacaaatactattacatcaagttactgatacttaaatgctgatgtgacgtcaataaatcttatgttatatgacaaaggagaaaggaaataaaatgaagatattttcttagtacgagtttatagatgcgcaaacatgtttttaacaaaagaaggaggaaatactcttgacaattacactcctcgtttctgccgctggccatagctggtattgatgactaccttcttctactacccattctgtattccctttgccttcagcaagcacctcagtaggttgtgttttttttcctggtggagtgacccaaatcttcattcctgaagggtcccattgaccttaatcacagggcatggtaatagcaagaaatgccctaatgcatctcctgtattccatgcatgttcttcagtaactccattgtggagtagtaaactgatttcattttgatagtctgggtcaatcaccccagccgacactgtaactcccttcttagccattgacttaaaggtaggagaagcccaaaatgtccaggtggcaatcttaacttccagtttaatggaatcattgttgtgtctccaggtggtagtgttccttcctctggaagtaaatcctttgagccagcagaacataatgtctcaggaacaggaagcaaaacatttgctagtggatcactagggttgatggtgagtggtgccacttccacttccaccccttgattcctggatccatgaatcctggctacaggagggacagtaccatatattggatgctgatttaaagcatacacagccatctggagaactttgccctggccctgcaaagtattgtcacctagttggcaatgtaattgtgacttcaaaagccattccactgttctatcaatccagctgtttcaggatgatggggaacatggtaagaccagtgaattttgtgagcttgagcccactgctgcacttctttagtcataaagtgagagcctttgtcagagcattgttgtgtggaatatgatgacagtgaatgaggcattccaagagtacacggatggtagtctcataggcaaaccaatatctaggataagtgtctatttcagttaagacaaacctctgcccttcctgtgatggaagaggtctgttgtatttctcctcacacagggcaccagttgagatattgctcctcagaagacagcattagctgcgggggtctgcctgcagaccctgactcaaacgacggatgaataaaaacggacactgacacacagatattctgtttggccagtccggctgggttctttgattctgagtgtccgacaacatacacaccaggagaggtttgtcactgtggtgggtcctgagcagctggtactccaggcatttatttagtatacaattaacaacagaagctttgagtaaacacacttgtggataattaacatggttaagagagtagttctacgaatgattaaagctcaggtaccctggtctaaagtaaataccattacggggcaatatccctggttgacctcccaccgagagggccatctggctcaaaggttagttaatggagatagggtaaacaggcttaactgggaaagcctccattgtccctagcatttaccctatgacctaatgctctaaggtaagaaccagctgccttcagcctgtacaattattacaagctatgtaacattttagccttccaaaatgtttgtgattattccctataactttccctaatatttccctttgatatttctgccaccatcctgagtgaatcccaacagaggtccaatataatcaacctgccaccaggtagctggctgataaccccaaggaatggtgccacatcaagggctcagtgttggtctctgctgctggcaaattgggcactcagcagtggctgtagctaggtcagccttggtgagtggaagtccatgttgatgagcccgtgtgtaacctccattcctgccagcatggccacttccctcatgggcccattgggcgatgacaggggtgtctggggaaagaggatgcgtggtgttcacagaactggtcatactctcctcttgattattaaaatcctcctctgctgaggtcacccgttggtgagcgctcacatgggatacaaatactttcacagtttttgaccactcagagaggtccatccacatatcttttccccaaatttctttgtcatcaattttccaatcatacttcttcctagtccctgtgacagttactacaggacagaatgaagggggactaacacagaaatgaagacaaagacaaagggatctgttttaaagaaggggtcagggggctccttgcttctagtgagcaagggccctgagctactgcaatccttcatatttattaggtagaaagaacagggaggaggaggtaacagttggtcagctgcttgatttatcacaggttcacaggattgctttctttatacaacatacttcagatgtgctgcagataatcaaaagaaacactgtgcttggggcgtgacggctctcagcattcgttctggtggtagatgcagtttgtcgtttgccaacaacctgcattcatgagaacagcttgctgtttgctccagtggtatactgagttggtcacgaccctcattctttcggcctccaagaagtccctgatcgtccagccaaaccgttgactacagcaaataaattcatatataatcacacatctggagatttctccttccatgcaaagagcacaaccaggtgtgctcctcaaagttctgcccaatgggaagatttcccttcaccgctgtacttcagggatgtcctggaaaggggctgtagtgctgcagctgtccactttccggtggtgcctgcatatcatgcagatacatttgtgaaccaggccctagtcttctttctgtcagctgatcatagtgaactgcccctgagaccaccagtgcaggctgggggatagtgcaggctggtggcaggagtggaggtcatggacatttgagccacttccccatgtaacttacttgtgccttcagcccaaatacgtatataccacttccactgaatgatggaatgctgctgtgcatgatccactttatggctaaatgggttagaaagcacccacttcatgacaggcagttcaggttgcgtggggactttaagacgcatagtcaaatgttcagtttccaccaaagcccagtaataggccaagagctgtctctcaaaaagagagtagctacctgcagaagatggcagggccttgcaccaaaatcctagaggcctccactgtgattcacttacagtggcctgacaaagactccaagtagctttgctatctgccgctgacacccaaataccattgggtctgttgggtcatacggcccaagtggcagagcagcttgcacagcagcctggacctgttgcagagccttctcctgttctgaatcccactcaaacctggcagccttttgggttacttgataaatggactggagtaacacacccaaattagagatatgttgcctccaaaatccaaataggcccactagccattgtgcctttcttggttgtaggaggggctaaatgcagcaacttatccttcaccttagaaggaatgcctcgacaggccccacaccactggacacctagaaattttattgaggtagaatgcccttgaattttagttggatttaccgcccatcctcttgcatgcaaatgtctcaccagtaagtccactgtgtttgctacttcttgcccactggatgcaaccagcacaatgtcatcaatttaatgggtcagtgttatatcttgcaaaagagacaagcaatcaaaatttctttgaataagattatgacacacagctggagagctcatatacccctgaggtaggaccgtaaaagtatattgctggccttgcctgctgaacgcaaattgcttctggtgggccttatggaccggaatggagaaaaaggcattttccaagtcaatggctgcatatgaggtgccaggagatgcattaatttgctcaaacaaggaaaccacatctggtacagcagctgcgattggagtcaccacttggttaaacttccgataatccactgtaattctccaagatccatctatcttctgcacaggccaaatgggagagttgaaaggggatgttgtgagaatcaccacccctgcatttttcaagtccttgatggtatcactaatctctgcaatccctccacagatgcaatattgtgggtttatttttttttaataaagtttcactctgttgcccaggctaaactacgatggcagaatcatggctcactgaaacctccatctctggtttcaagcaattctcctgcctcagcctcccaagtagctgggattacaggtatgtaccatcacaccccacgaattttttgtatttagtgtagatgaggtttcaccatgttggtcaggctggtctcgaactcctgacctcaggtgaggtgatccacactaagatccagcttatgtggatcttttctcttcttttcttggttaatctcactagtggtatatataattttatttatcttgtctaagaattggtttttgtttcatttatcttttctatcatttttttgtttcaattttatttagttctggtctgatattgctatttcctctcttctgctgggtttgggtttgcattgttcttgattctccatttccatgaggtgtaaccttagattgtctgtttgtgctctttcagactttgtgatgtacgtatttaattctaaacattcctcatagcactgcttttgctgtatcccagaggttttgataggttttatcaagatttagtacaactgcaaccttactattggccaacggcttttgaattcctaagagtgtgacctcatttaatcctgacaacagctttatgattgcttttcattcagtaggtcgtgattagagagggagtgcttgtggcctggatggaaggttctccagtttatcaaataaaaacaccgaaggtcagttaaatttgaattcagtaaaacaatgacaaagaattagtatgtgtaactcccacacaatattgttcatttgagatacaaacttaccttgtagttcatctgccaactgcacacagggttcaaagcctggaagaggcagagttagagctggtcttctcttcctgatgccaggtctatgagctgaacctcaaagacagggcttctctaacacagctaccctcaagtaagcacatcggttagcactaaatacacagtatacgatgcccaatcaataatgcctactcacttttctaattcttctttctattattcttcaaatctgcagactcaagacctcccgaaacattgcggcagccaggattttgaatgagggtcctcatatgtctttccaaacaagatgcaagggtgctccttggtccctacacagaggggcttaagccaggagtgcataagtaacatgtaagagacagaagaactcaacctggctctccctctgtgcagtgaaacacctaattccagggttctttgattctgaaggtgggtgggctgagagaaagaggagccccaccctgagagctccgagtattcaggacaagacttggcagcctgaataggggctatactcttgagtgtggaagaagcaggcatctctgggcacaggctgcttttctggtggcttctccttcaccaaactgggctccctgctgtgatgtctatcagagaatctccttcagtaagaccaagattccaggatttaactaaaaatagcagcacagaccagaaaggtatgtcatggtacttgaattctgtgcagagcaataagtacaaatgcagcttaacaggggccttcagagttgtatctttggtgaaggagaaaatagacaatggcagggagaaactgaaggactcagtaggtctggaactggggcagcactgggtgctataagcttgtccttcaggggtctacagatgctgacacctgggaagtcatcctgcatcatctgctcactgctcactgggctcagcagctatgtcctcacaaataaccagattcaatcaacctggccttctccacccaacctggggaatgtattccagtgactgtttcaactgaggttctatgaaggggttgggggataagaagaggggactgatttgcttgaagaaaccattgcacaccctttcctttcatctaaaacctattaatggaaactctgaggccacccatagaagtctagctggtcttctaaatttgggagttacgaaggagtcattcctgatcaatctacaggataaggggccatcagcagctggtggtcagagtgaggaagaaaatggcttccttgagagactcatcagcacagccaccaactctggggaaaatggggcacttgctataacagtcaccccaaactactcacaggagcctgagcctcgtcccctcaccttattgtttctgattctggtccatgcctctgttttccctggacccctcgcccatgtctgagtccagggtagcaggggtagttccatcccagtcaacatctatacagaagtaacagctgctatggcttgaagccgagtctacagttctacccatgagggcctctttttctccccaatcccctcacacaggtgaccagtgctgtgggtctggtggagtggccactggccactggtcccaggcgaacacaaagtatttattcctctctaacaccaggcatatattggagggggtttggtgggtgtagaacagagtggttcttccagatgcaaagcagtaagaccctgtctacagaaagtcatttcacaaacctccacaccctttcatgataaaaacgctcagtgaactatgaatacaaagaaactaccctaacatagtaaaagctatctatgaaaatcccacagtcaacatcacacataatcttaaagaccaaagatatgtttttgtaatatcaggaacatagcaacaatgtacacttcactgcttctattcaaaacagtattgaaagtcctagccacagcaataaggcaagagaaataaataaacaggataacaattagaaataaaaagtaaaactatctctgttttcaatggatttaatgtcatatgtagaatacccttaaaagttccacaaaacagcttttgtcagaatgattaaatgtattctgtaatgttcagaatacaaaatcaccatgtaaaaacacctcatggctgggcatggtgactcacgcctataatcctggcactttgagaggctgaggtgggaggattacttgggatcaagagttcaaggacagcctgggctacaaagcaagagcctgtctcaagaagaaaaacgaaagaaagagagaaacaaagaaagagatagaaagaaagaaagaagaaagaaaatctcttatatttcaatacttagaaaatctcttatatttcaatatttaaacaaggacacaggaaaaaacccaaaacaaaattaataaaacaaatcaaattgcaacatcattagagagagtaaaatatggctgggcacagtagctcatgcctgcaatctcagcactttgggaggctgatttggacggatcatctgaggttagaagttcaagaccagcctcaacaatatggtaaagcctcgttcctacaagataaaataaaataaaattgctagctgtggtggcacatgcctgtaatcccagctactcaggggtccaagtcacaagaattgcttcagcctaggagggagaggttgcagtgagccaagatcttgccactgtactccagcctgggtgacagtgagacattgtctcaaagaaacaaataaataaaaatgaaacagtaaaatacttaagaataaagttattcaaagaggtgaaagacttgtagattgaaaagtataaaacattactaaaagaaattaaagaatacacaaataaatggaaagaaatcctttgttcatatactggaaaactcagtattgttatgctaacaaaacaaaccaggaggaattgacagattcatttcaatctctgaaaacattccagtaatattttatgcaagaatagaaaaaaattaaacctaaaatatatatagagtatgaagggaacctaaacagtcaaagtcatcttgtaaaagaagaccagtgttggaggtctcacactttctgatttcaaaacatactacaaagctacactaatcaaaacagagtggtatatatgtaacatacatactgacaaataaaatagaactgagtgcctagaaaaaaaactcttagttatacagtcaaataattttaaacaaggttgtcaagacttttcagtggaaacagtacagtctttcacaaatatagacgttctgggaaataatactgaatggcttttgctgttgttgtttttgaatggtctcaaatgttctctcaaagatgctgcagaacatagcttattgattttgtaagttaaaaggctgagtaagactgtgagagactccctgctcatcatcattcttcttccacttccagtgactactcttatattctgtgccataagccaacagctactgaccccaggatcttttaatccttctgtaaaactgtcattaaaaaaaaattgtctaaagtaaattttttaaaaaattctcacttaaaccagctgtttatccaatataaggctcaacacaaatagttacagaaagccagtaggtcattaaaacaattaatttagtcattcaaataaaaatgaacaccatgtaacactaatatcaaattatagtcacaggggcaggatttcagcaacagcaagagaaagtagcacaaataggaatgagcaaagaatagacaattaatgagtgtgaattggcctggaaaatattgtggcaatgtccaaagataaatccacagttatttgtgaaacaagtgaaagaccacgcattctcagtccaggaaagccaccagggggtggtctgggtctcttgaactgtaagaagctcaagaggtccaaacttcatgaaccctgcacaggtgctcattgactcatgtaaacgttagagcagctgcttcctcccacaggacaaatccacagcacacagcctccctgggctggcccctcacagtgtagctgctctcaggcctgtggacccaggtggtgataaaggcagtaaagatttgcataaagcagcacacagcacaccccctccatggagagagctcaataggagataaagagccatcagaatccagccccagctctggcgccaggggtcccttccaatatcagcaccatggcctggactcctctctttctgttcctcctcacttgctgcccaggttaagagagatttcaaataccagcctttggagggatccttctgtctgcccttctaatttctaacatgtgtctgttttttgtttcagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgctcagcacagtgacagactcataagaggaaccaagacataaacctccctcggcccttgtgatgtggagattgtgtgatcatacacaccagctctcaagacagcctacatgtggaccagccatagaaaggggaaggaaagggtctgaattgatttctatccctccttgtgccctgaagtggaggaaatgtgagagtgatttgcagtaattgaatgagacaaagcaaaagttatttgttttatatgaaaaaaaaaaacagaaacagcaggatcagatctaaaggctgagtctaaatgcatttcctccagacagaagcttcttcaaacgatgggctttctgagctaagagcaaagaaaataaactctccacgggtatattattaaagtttattttattgagttactttcaaagcaatccatgactattatataaagtcagaaagtattaaaaatcaccaagttctctgctaagctaccttatcccatgcaatcaaaataagtacttttcttcatttggatgcattttttatttctgtttttaatatttccacaatggtgattaaacctggtgctcattcctctggtttgatccacctttatgctcttgtcatttaaagttaatgtaagtagtgttccatttatttaaaaggataaaatattttaatagttgatcattgcattttgaactgagtaccagtgaagtattctagcttttaggtaatttcaattgtttgctagtcaatgatgttatacgttgttgtcattaaaccattcctggtcatttctgtggattttgtgaggtcagagaaaatgtctgtgcttttcaatggaaagccttgggtacattattcctgacttcccaacgcacaaaatagagaaacacaaatttcctgctcatgttagttagagcataagagattcaggtacgaggaacaatttataccccaaactacatacagtgtcttcaggcatgtattagaagtgtacttctcaaactctctgatacccttagttctgaagaagctcaaagttggctaatacttttatatttatctttttattttttttacctcagccagcactttctcctgattcctggggttttctgcatttccagtgaatccagtgaatcacacaaataggctaactgattcttcccaaactccagcactctcccttatgtgctgatctagtgaggaatcacatgggaagagagacccatggatttctggcggcctgggaagtgagttcatggctggcctcagcttgcaaaccagacacttgtctccttgtttccctttactgttcattgggttcagcagctgtgtccttccaggtttcctggacagtgatggaccacactctcccaactcccaaccacccgctcctcaaaaggaataaccagactcagcaacttatgtgaggggcacagccaggggtcaggatagattggcattaagtcccctcaattaagagaggccagggaaggggggctgttccccctaatccgtgtggctcaggaagcagagctctagagacatctctaccatggcctgcaccccctcctcctcaccctcctcagtcgcggcacaggtggctggagacagggagtcagggactggcactggcaggaccagggctctgctttgctcccctggctcactgagctgcctccctcaccctgtgtctctctcccgactctcagggtcccgggcaatcatggctcatcaggtaacctgcaccgtctgtctgtggctaaaccagccaccatctcctgaactggaagcagcagcaataaggttcttggaattgtgacctggtgccaacaatgaccaggaagtgcctccaagcttctgactcatagaagtaaatatctgcccgcagggattcaggacagacgctcaggctaccagtcttgcatgaagcccttcctaagcatctctgggctttaggctgaggacaaggctgatcactcctgttggcttcagacagccccctggaggtccaaacagtgctgcagtctgggaaagtgagatgagaacacgccaggtctcctaggagcatgaccttccaatggcaccacccacaaccaggacagctggtctgtttaccatttgtgtggatgtttcttgatgctgccgctaaccagggcccaagacttagttcggggacagtgatctagagaatacagctttgttctctcacagccagccctcagaggaagcccttagcaacagcattgtcagactgcctcaaaaaaatcagtctttgattccaggaacaggctgccctggggacagactcaagatgagtcagggtaagcagggacagaatccagctgggtctgcctcaggcatgtgcactaacgcaaaggtctgttcatccttattgtctactaaacacctattatgtgccagtctcaggagagtgctcaggatacagagtttacaagacagacagggttcctgtctttacagggataatgcctcacagaagagtgagcaccaacaaatcaatgagaataaggcatattgtgaggtataaaatggttgacatgggccagaagacagtgagcaacaagaagctattaggaggttgtaagcaaggagatacagactctggtttgagattcaggaggcaaagtccagcttctctaaggaagatgaaaaaggaggggacagagtgaagaaagatggtccagttaggacatggtggctttgtacacatgagagatgaggtttctggcaagtaatgtggcagctgagctgaggcctgtgctgtggatcccagacgggagccacctgctaggcctaggctggagccctctgcctctgctcacgaggaccagcagctgtgtccttacaggtccttagggagccacagaacagccccaccctggtccaccccatcccaggctcagctttctaggcaagggtcagagtcagggcctagggtgggacttggccagcccaggggaggaggctggtgtgcatgaagagaccctccttcatcctgggctgctggcgaaagtaatagggactgggggagctcaagcccagctgagtgtcatcaggatgcagagctgtgtgtgggtccccaccaaggcctgagctcctccctttctcccccttctcattcactgcacaggtaactagggctagggatcagggctgtgggtgaatggaacgaggaccctgcatgctgccctctcaactgacccacctctctcaccctctgttagtccaggtgtcaaggttctgggcccagtctgtgctgactcagtggtgtgaagagttcctgtgggtggggtaaactgccgccatctatcacacttgaagcagaagcaaggctgggtgtgggcctgtgtcctggtatcagcagtgcccccaaactcctcatctatgacagcagtcattggtctgcacaggtcccagcgaagttctcaggtcccaggttggggatcatggcatccctgagcatctctgggctccaggcagagaatgaggctgattctttcgctcatcttgagacccaaggatccatgattaggcagtgctgcaggccagtgggtagctgggaggaaaaccttctgtctccccagtaatgtgtcttccctcttcagcctccaccccttcagcacaagtttctggggaggagggtctgaagcccgggtgagaaaaagggtcaaggctggccttaggacctggatgggcacagtgaccccctgctgagagggccttcatgagcaagaaggctgggggaggtcctgagttgatttttacaatggaaacagacaccagctccccatccttgttcaaaagcatctcaggaccttttcctctgcagatggcaagggggagaatctccctctgagatacatgagaattcccttcccatgacctgtcctgtcacctggatgaattcgtatttggaaaccaaatgactccccagtgccaggcattacatcctcacagaaaacctgccagaatgagcaagatcttccctccctgacccactggccaggaatctcggacatcaggatggctggactagatcactcatgccatctcccctgacatcatcatggttaccggggggactctctgattaatttgggccacacagtgcctgtccctggcattgcagttggggacgcttacaggctaagtttatggctgggagacctagggtctagaaaggagaggaatagaacagaagctttgcctacatggccccctgtgtgcatcactcttccctccacctttatcctaagttcatgatgggtgatgtctccttgaggctggaacctgggcagtgacatgggcctgtgtgtcctcatctcacaatgcttcatcttgggctccctgacctttctgatattcctataatggatcaatttcaggctaggacacagccatgcccatacaggaggcagtgatctgagaatcaggtagtcttagaagagacagaaagcaaataaacaccctcatgttggcctcctaagcccagaggacataaggaaatgaaaggaattcaagaagaaacataagtggtcactgcccaccatcacctgggcacctgttctccacctgcccctctctcagtgaggaccagactcagaggcctagagaaacacgtcttcatctgttcacaccgtggggtgcctccttctggactcatcccaagactgctgctcccccagcttacctgtgtaactgctgagagtcttcacagggacctggtcacagggtttgggatcaggatcagcctggctttaactcagctgtgaccctgccccttcaggacaaaaagtgaactattagggctctaactgaactctcctgatttacttaaatcttatattctccttctcaatatccttctaggaagttctgtctctacccaataatgtcaggtcatttcctcaggcctagagccatttgatttccagacttctatactcacacttatgctctcattctctgtcatggttcatttactacgcagcagctaatgaggccaaccatgtatctacagcccattgacatgaaaaatggggaggagagggttccttagataaatacagggttagcaaaggaaagtttcttaggaatcacttcaggatccaagaaaattcattccagagcttcgagagtttacaactcaaaaacaacagcataatatatgaggtggtgaatcttcttggccttctcaatgaataacctcagaaatggtcagagaatatgcttcaaaaaggtaagagtatgactttcacaaacatatagtattcacatatgtcaacaattttaattggtttatgtattttggagaaaaacagtatgatgataaataaatgttaaaaagcatttttaaaaactcagtgcttatactccaccaggatagaacctgtgaaggaaatttctgtgttgaagatacactgtcttttagaataatagcaacatagctatgaattttgtcttctcatctcacaatctacaaattaaaatcaccccatttatgtgaaatatctagaaaaatacaggtacatttggacattcccatctgccaccacccatccatcttctcctaaagtggaatccctctgcccccattctgctcctctccacacatctacctgctaacacgtgactcctccctgccttcctttccagatccctagcagattgggcccaccaggggaacaagctcttggacctggggatcaaaagtgcatcttgttggacttctgaggacttgccctgcaagggtctctttctggatcacaatccctctgttcctgggcatccccttttgctggatcctgttatttatctctgtgttactccatctaggtctactctgtggacttccctgcatcttcacctgaaccccaggaatcttcaagtcatgccaatattccctcagttctcctgaaatgtcttattttctcttctcctgagatcccaccaagtcatcccttctgagacccctgagtgtagcagggccctctctggtctctttgcttcaattatgaatgaggagaatgggaggtcctctttgccgctcctacccctgtgttgccatcaggatcagcttcatgaggcagaatgaggctgtctagatcaacatggctttcccaacattgagctctgtgcccagcacaaggtaggtgctcagtaactatttgagaaaacctacatttcatcacactggccacattacactgagtccaggatggggatgaactgggagaagcagtggtggaaatattcctctctctgctttcaggctaagaactgatgggacgttcaccagggagagcatcccttggcagaaagggggccatgggcatccttgtcctgtatgggagacactgctcagcctgggggaacctctgttcatgaaggtgggagaaaaagataaacaaaattcactgtgaatgtctatgtatcatcacagaggaggcaatgacaagaaaataggaagtgcaagcccagttacaattggtttctactttaaaagaaataaaatttaatatgcctggtgtgttatgtaaacacaacaaacatttttcgaaaactataaaaatatttaaagtaacatggtttacaataaataggaacatttgaaataatgacaccctggaaatgcaatcctaaaatacagcatacattttatttcagttatttatcttgactggttttatttaaatgtctatattagagatcactacttcattgtggatttttgtttgtttgcttgtttgttgtttttgagatagagtctagctctgtcacccaggctggagtgcagtagcacaatctcgacttattgcagtctccagctcccaggttcaagcacttctcctgcctcagcctcccacgcacctgggaccacaggtgcgcaccagtatgcctggctaatttttgtgtttttagtagagatggggtttcttttttttttttttttttttttgagaccgagtcttcctctgttgccaggctgaagttcagtggcgcaatctcggtacactgcaacctctgcctcccaggtttaagcaattgtcctgcctcagccttctgagtagctgggactacaggcacccgccaccatgcccagctaattttcacatttttaatagagatgggatttcaccatgttgcccaggatggtcttgatctcttgacctcgtgatccgcccaccttggcctcccaaagtgctgggattacaggcgtgagccactgcacccggcctaagatggggtttcatcatgttgaccaggatggtctcaaactcctgacctcaagtgatccactcacctcagcctcccaaagtgctgggatgacaggcgtgagccacagtgctcgacctagtacattgtttaaatggtgcatgtaaaacctcatggtactacaactgcctggtgacagactcaccagagtaaataactatcctgctgttctccaaccacatgggattgccccaaaaaatatttgttgaatcccaggtgtatcatgccagaactcttgcagtcatatatacaatctgtttcattttaataaataggattatcttttttcttcagtttactgtttttaatgtatcatattctagatttcattacacatcaaagatgaataatttctatcatctttcagacatgcccaaaacactcattagcgattttgaacagtattctttcctaaacatcctagttggaatggttgatcctaaaagctaccacgtgtcaggctcacttaagtacagactctggtcaaaacaagctgaagttttaactcttccatcttcaaatactgagcatatttgcttgttttgctctttagcaaaacactgcaaagtcatttgccaggatcccccgcagattggcattcagtgatggagaacagactcctaggtgagatccctggtcacaggatcccgatgactatgactgcaagtctggaaaagaagagacagaacaaagatttaccagcataaccctctgagaatgtgccccaggcatcccggagggaagagctccctatcgacccaggactgcagaatccacagaggaaggagagctctggccaccagggagcagccacacgagaggagaggacccagtgcccccacaggtgaggaaatgagtccatggggctggtcactgctctcgatttcattctgacataagaggactttgtgtagtcaccacctgagtcctatacagtgaacagccaaggagacatggacagattcacccctgaggaacccagtagaatgtgaagtctgccctgagctcacgaaaaaaatgactcagggggctgcctggcctggccctgatggagggggccatggacagaacaacggggagtgaggggtgtctctgagaggctctggtcaccttgttatacaatggtggtgtacatgaccaaaatggacaccaggggatgcctgcgtaccattactgagaagactgggtgtgatgagagcaggaccagcgccacctgtcctgcttggtgccctatgcttagggcttacagatgtcaactctgcaccccctgggaccacatagccccacccctggcactctctgacatcctcaggcagaggagcctgacccagggcccaaggtgggatcagaaagctggagggtctgatttgcatggatggaccctccttctctcagagtataaagaggggcagggagagacttggggaagctctgcttcagctgtgagcacagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccacggtcctgggcccagtctgtgttgacgcagccgccttcagtgtctgcggccccaggacagaaggtcaccatctcctgctctggaagcagctccgacatggggaattatgcggtatcctggtaccagcagctcccaggaacagcccccaaactcctcatctatgaaaataataagcgaccctcagggattcctgaccgattctctggctccaagtctggcacctcagccaccctgggcatcactggcctctggcctgaggactaggccgattattactgcttagcatgggataccagcctgagagcttgcacagtgctccaggccaatggggaactgagacaagaaccctcttcctcctccgccaggagggtgagtgcctgcagctgctgctcacacctgacctgtagcttctgctgctgtagcttcccccatgggcctcggggcatccagggccttgcctaggagtggaggctccaccacttttgtcctcagagtcaggaacagggaccccaggagacagaatatcctgctcctcagcttgggacacagggtctctgcactgaaatcgtgggctgaggtggcaggtccaactgtgtcttcacagtccttcctgtgcctgcccatggtgtggggacggagtgaggaagtgtgggccattgagcttcactagaggcctgagggagcagaggtgctcccgaagacctggactccttccgtcaccctcctcccatcactctcctcactgtagctgtggccaggtgagggctcagggctacttgaggaccttgctcaacccagggcctccatcccaggcattgtttccaaactctgtaagggctgtctctgaatctgtagaaacatttatttctatgtgcccaggactgggttagagggcaccaaccccaccccttgcaaactgctcatcacctctcagtgaaacaatgaggagaagaaagagttagaaatcagaagcctccccaaggctcccctctctcctctcaaccagcctccccttggcttcctccttccacagaaataaagaggaggcagccacagaaggcaagggaaggtccaggcattataccaggcagtggagccagccagtccccccagatggtggagggaggtggtggaggtgtctgggaccagaaaatagtgaggaccctcttactaaagtgaggaggggtggcataaactgaggctcagatggtggaccagatctcctgagccatctactcatttcttcttgagtttcagtttcagtaagaataggataaaaaaaaagtctgaagaggttcctttcctcagataagaattcgtagaggattattgcccactcaggcattgaggggaggctgagcctccctctcaggccaatagaactgggggctttcatgggaatttgattgtactgaagctcccagactctgacatctaagacttatgctctcgtagcagagcccagcactgataccaaaatggataaaggctgattgataagcctggaatatcctagctgacaccgacttgtggaaaagagaatcaagttagaatattgatgtgataaggtggcatcgcacagtgaggagaggagagcttgtgtgggggagggtagaggagccattagagggttggacaaagaggacacagaatctgaggtaagtttgtgaggaaaactccagatgcttcagagaagatggacaaggaggtaggcagtatgaaggccatgggaccagctctagtcaccgggagtgagtggtgagattcagcaccagtgtctggggaggaggtactgaagcctgggtgaggggagatgctcaaggctggccttaggacctgagtggggcacagtgatcacactgctggggggtccttcaagtgcaagggggctgcaggaaggctcgagctcattgtcacaatgaaaacttagacaacagctccccagacttgttcaaaggtgtcacaggactttttcctctccacatggcaacggggagaggaaaacttatctctgagatatataagatgtttgttctccataacctctcctgtcccctggctgaattcctatttggaaacaaaatgactctccagttttacatatgacatcctcactaaaaaaaaagttccagaatgagaaagatctgccctccctgacccactggtgaggaatctcagccttcaggacaaccagacgaaatcgttcatgccatctcccatgacagcatcatggggaccagggagcatatcttatgggtttgggccacacactgcctgtcccaaacattgcagctggggacacttatatgctgaactcatggctgggagatctggggtctagacatgacaggaagaggaaaaagaccaggagctctgcctaagtagccccagtgtgtgaatcactctaccctccaccctcaacttcagttcgtgatgggtgttgtcttgcgaaaactgacagctgggctgggacacaggcaagagagactctgacccacaaatctccatcgtgggctctctggcctttctgatattctttttgcacatcaattctgggccaagacacatccatgctcatcaagaaggcattgataggagaatcaggtagcctccagagagacaggaagcagataaacaccctcatgttggcctcctaagctcagaggagaaaaaaaagggaaagaagttcaagaagccacactagaagccactgatcaccatcacctcggcacctgtcctccatctgcccctctttcaagtaaggaccagactcaggggacagcacctgcacctccctttctgtccatgcactgtgtagggagcctccttctgctctcatctcaaggcgactgctccgccaggtcagccgtgtcactgctgagagtcttacctcagtcctggtcacagggtcttggatcagcagcaacctggctttgattcagctgtgaccctgccccttcaggacacaaagccgatgattaaagcctaactgaactctcctagatttctcaaaccttagattctccttctctgtgtccctctagaaagtgccacctctaccaaataatttcatgttatttcctcaggtctagagctatttgattaccaaaattctatactcactcttctgctctcattccttgtcatggtccattttccactcaggagctaatgatgccaaccctgtatctacaggccattgtcacaaaaaaaaaaagaaatgagagggttccttagataaatacagggttagcaaagaaaagtttcattaccccttaggaattactccaagatctaagaaaattaattccagagcttcaagagtttactcctcagaaacaacagcatgaatacattaggtagtgaatgttcttggtcttctcaatgaataacctctgaaaggttcagagtatacgtttcaaaaagataagtgcataactttcacaaaaatgtaatcttaacttatgtcatcaattttaattggtatatatatttctggaaaaaaaagcagtatgatggtaaaagaaatgtaaaaaagcctttgtaaaacccagtgcttacagtccaccaggatagcacctgtgaagcaaattttctttgctgaagatacaccgccttttagaataatagcaagatagtttgaatttgtcttcttctctcacaacaatctaaaaattaacatgatcccatttatatgaaatatctagaaatatatctgtacatgtggacattcccatcgcacacctcccatccaggctgtcctaaagtggcatctcctcttcttctgctcatgttctccccctctcctcacctctcctgctgacacgtggctcctccctgccttcctctccagtagccccagcagatcaggcccaaccagtcaacaagctcctggacttggggaacaaaagtacatcttcttggatttctgaggacttgccctgccagggtgtctttctcaatccaatctctccttcccggcagtccacttctcctagatcctgtaatttatctaatcttattcatctgtatctacttcgtggacttccttacatcttcacctgaacaccaggaatcttcaggtcatgcccatatgcccttggttctcctgtagtcccttcttccttcttcccctgtgatgccaccaagtcgaagtctcttctcagaccctggagtgcagcagggacttctctggtctctgccccagggattaagggggtggaagagtggactcctgtgcccttcctatgcctgtgttttcatcagggttagctgcaaaaggtagggattaggctgtctaggtagggattatggcattaggtagggattatggcatttccagagctgagctctatgcccagcaaaagatacgtgctcagcaactacttgacagagacctacctcttatcacatgggacacattatactggacccaggatggggctgaactgggagaggtagctgtggacctgctcctcgctctgccctcaccctaagagctgatggggcatccaccaggaagagcattcctgggcagggagagggccatgagcagccttgtcctgtatgtgagacacagctcagcccggtcacaagatccagatgactatgactgcaattcaggggaagtagagaatgaagattgaccagaataaccctctgggaatgtgccctgggcctcctagagggaagagcttcccttctattcagcgctgcaggatccacagaggaaggagagccctggccaccagggaggagccacatgagaggacccggtgtccccacaaatgggaacgtgagtccatgaaagtcggtccctgctctgggtttgattgtgacctatgaggacattgtgtagtcaccacctgagtcctctacaataaacagtgagagcgccacggacagattcactcccgaggagcccagtaaagtgggaggactgaggtcacagggagaagacacaggcaccacctggcctggccctgacagggggcagtggacagaacagtgcggaggcagtggggtctctagaggctctggtcaccttgtcataccatggtttgtctcggtctggacactagagggcacttggggatcattcctgagaagactgaggttgatcagagcagaaccagccacctgtcctgcctagtgtcctctgctcagggctcacagctgcgtcctttacacccgtgggaccacacagccccacccctgccaccccctgacatcctcaggcatagggacctgacccagggcccagggtgggattagaaagctgggggtctgatttgcatggatggaccctcccactctcagagtatgaagaggggcagggagagatttggggaggctctgcttcagctgtgggcacaagaggcagcactcaggacaatctccagcatggcctggtctcctctcctcctcactctcctcgctcactgcacaggtgactggatacaggtccaggggaggggccctgggaagcctatggattcttgctttctcctgttgtctctagaagccgaataatgatgcctgtgtctctcccacttccagggtcctgggcccagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttccacagtgctccaggcccggggggaactgagacaagaacccacttcctcctctgccaggagggtgagccccggcagctgctgctcaggcctggcctgtggcttctgcggctgctgcttccctcatggtcccaggggcatccagggccctgcctgggagtggaggctcctcctccccttctgtcctcagagtcaggaacagggaatccaggaagcagaatatccctctcccttaacttgggacacaaagtctctacactgaagttctggactcaggtggcagatccagttgtgtcacctcagacccacctctgatagggaacccatgtattcattattctcctttccccaattccaggagtttccggagtggtgtcttcctctccctgctcctcaatgtgagtccctgtgtttcttttctcccaggcctattctttttttttttttttaacaaaactcctttcatgaaggaaaaatgcacacctaataaaccagctgaatttatagcattaaattcggcccattttggcatttttctggatctttgaaaatatcaccaccactgagctatgcaacctctgactaaccccagcagcccttcatgatgctttgtcatctccttcactccccgaatgccctcctgggcagccaggaatctgcctttgccactactgtatggtttccattttctgaaacttactagtgttatcaaacactatcttcccatttgttcgagcttctttcactctgcacacttcttttcagattctccctgctgttgctgaattgcatcccattctacagagggctcattacaacctttgagggtctaggacattctcttctgattctatttatttacttatttattttaaagtttgaattcattgtccatcaaatcaaactctacgggtgatgttcatctaaggtgacaggagtcagtgagggcttctcaggattcttgcttcttcatctcttccctctaattctttctataatgggagaatttcttatctttttaaagtttttctatttattattttatgttggcttttaaggtttttagtgttttttaaaatttttttatttcaataggtttttgggaaacagatgttgttttgttacataaataagtttgttagtggtgatttctgggattttggtgcactcatcacccaagcagggaacactgtacccaatgtgtagtcttttatccctcaccccatcccaccctttctcctgagtccccaaagtccgttgtatcattcttatgcctttgtgtcctcatagcttagctcccatttatgagtgaaaacatatgatgtttgcccttttattcctgagtgaattcacttataatgatagtctccattccatccgggtttctgttaatgccattatttcattcctttttaaggctgagtagcagtctacatatatatatatatatatatatatatatatatatataccacatttgcttcatccactcattgattgatgggcatttgggttggttctatgtttttgcaattgcaaattgtgctgctataaacatgagtgttcaagtaattttttcatgtaatgacttcttttcctcttggtagatacctagtagtgagattgctggatcaaatggtagatccagttctttaatgaatctccacactcttttccatagtggttgtactagtttacattcccaccaacagtgtaaaagggttcccttttcaccacatccatgccagcatcaattattttaatttttttattatgcccattcttgagggagtaaggtggtattgcattgtgactttgattttcatttctctaatcgttagtgatcttgagcattttgccatatgcttgttagccatttgtatatcttcttttgagaattgtctattcatgtctttagcccactttttgatgagattgtttgtttttttcttgctgattagtttgagttctttgtagattctggatattaatactttattagatgtatagattgggaagattttctttcactctgtgggttgtcagttaactctgctgactgtttattttgctgtgcagaggctatttcatttaattcagtcccatctatttatcttcgtttttaatgcatttcattttggattcttggttataaagtctttgcttaagccaatttcttctagaatttctaaggtttcatgtcttagatttaagtctttgaccaatcttgtgttagttttgtataagatgagagatgaagatccattttcattcttctacgtgtgacttgcctattatctcagcaccatttgttgaatagcgtctccttttcccactttatgtttttgtttgctttgtcaaagatcagttaactctaagtattttgcttcatttctgcattctctattctgttacatcggtctatgtgcctatttttataccagtaccatgctgttttggtcattatggctttatagcatagtttgaagtcaggtaatgtgatgcttccagatttgttatttttgtgtagacttgttttggctaccggggctctttcttggtttcatatgaattttagttctatgaagttctgtgaagaatgatggtggtattttgatggaaattgtattaaacttgtagattgttttggcagtatggtcattttcacaatattcattctatacatccatgagcataaaatgtatttccatttgtgtcatctgtgacttctttcagcagtgttttgcagctttcctggtagaggtctttcactttcttggttaggtatatttctaagtattttagttttttggcagctattgtaaaaggggttgagttcttgctttgattctcagcttggttgctgtcgttgtatagcactgctactgatttgtgtcctttaattttgtatcctaaaacttgctgaatactttcactagtgctagaagcatttggggtgagtcttcagggttttctatgtatacaatcatattatcagcaaacagtgacagtttgacttcctccttatcagtttggatatccctgatttctttctcttgtctgattgctctggctaagacttccagtactacgttgaatagaagtggtgaaagtgggcatccttttgttgttccatttctcaggggaaatgcttttaacttttccccattgagtataatgttggctgtgggtttgccatagatggcttttgttgccataaggtatggtcccttctatgctgattttgccaagtttgaatcataaaggatgctggatttcgttagatgccttttctgcatctattaagataatcatgtgattttgtgttttaattctgtttatatggtgtatcacatttatcaacttgtggatgttaaaccatctctgcatttctggtataaaagcaatttgatcatggtagattatctttaagacagctgttggatttgggtagctagtattttgttgaggatttttgcatctagattcatcagaaatattggtctgtagtttatttttgttatgtcctccctggttttggtatcagaatgatactgtcttcacagaatgatttagaaaggattcccattttctctatgctgttgaatagagtcagaaggattggtaccagttcttctttgaatatctaatagaattcagctgtgaatccatctggtcctggattttttgttgtttgcaattttttttattaccatttcaatctagctgcttgttattggtctgttcagagtttctacatcttcctggtttaacctagtagtgttgtatatttccaggagttcatccatctcctttaagatttctagtttatgtacataaaagagttcatagtagcctttaatgatcttttgtatttctgtggtatcaatagtaatatctcccgtttcatttctaattgagcttatgtgggtcttctctcttcttttcttggttaatctcgttaatggtctgccaattttatttatcttttcaaagaaccagctttttgtttcatttatcttttgtatttttttttgttttgacttcatttagttctgctctgatcttcattatttcttttcttttcctgggtttgggtttggattgttgtggtttctccagttctgtgaggggtgaccttagattttctacttgtgctctttcagactttttgatgtaggtatttaatgctataaactgtcctttaagcaccacttttgctgtatcccagagcttttgacaggttgcattaagatttagaacaattgcaatcttactatcaatcaacagctttttaattcctgaggatgtgacctcatttaatcctgacaatagctttattattgcttttcaggcagtagaccgtgattgaagaggtaatgctttgtggcctggaggtaaggttctaaaatttatcaaatattaaattggtgcacaagtaattgcaggttttacaaataaaagtaatggcaaaacccacaaggacttgtgcaccaatgtgatataaacactggaggtcagttaaatttgaattcagtaaaaacaatgataaagaatctgtatgtgtatcacccacacagtattgttcaattgtaatacaaacaactgggtgccctgcattttatcgggaaactccacacagggttcgcagcttgaaagaggcagagctgtggcaggcctgcccttcctgatgccaggtctaggtgcttaacgtcaaagacagagcttctctaagagagctaccctcaagtgaacatgtcagttggcactaaatacatgtgatatgatccccagtcaatgatccccactcacttccctaattctttctattatcctttaagtttgcagactcagggcctccccagaaattgctgcagcctgagttctggacctgggaccgcatgtcctgtcacaaccagatgcaaaagggctctttagtccctacacagaatggcttcagccaggagagcataaataacatgtaagattagaagagctcagaggggctctccttctgtcccatgacagatgaaacttcagggctctgatgcttgtcagggaatctccttcagtgaggccaagatcccaggactttactaaaattagcagagtggaccagacaggcatgtcatggtacaggaattgtgttcagaacaataagtgcagatgcatcttaacaagggccttcacgttctatctttggtgaaaaaggaaatagacaaaggcatggagaaactgaaggactcaatgggtctgggactgaggtagcgctgagtgctttgggcttgtcctggagcagtctgcagatgataacagctgggaagtccacccctgctgtgaccttgtttcatctgcccactggatcagtggctgtgtcctcacaggaaagctggctgtagccagactggccttctccatcccacctgggaaatgtattcagatgactctctggggtgaggttctactaagggcttgggagttatgaggagggggctgatttgcatgaaagaaccatttcaccccctttccttcatctaaaacccattaatagaaacttcagggccattcatagaagtccagctggtctcctacatttgtggggcataaaggatcaatgcctgatgaatgcctgatcaatctaaaggaagaggggctatcagcaggtagtggtcagagtgagaaaggaactgacttttttgagagattcatcaacacagccaccaactctgggacaaatggggtgactctctgtaactgtcaccccaaattacccacaggacactgagccagtcccctcattctattgcttctggttctagtccattcccctattgtccctaaacacgttgcccatgtctgagtccagggtggcagggatacctccatcccagtcaacatctacagagggcctcttctgttcccctctcacctcatgcaggttactactgttgtgggtctggtggagtggcccctggagaacacaaggtatcccttcctctggaaagccaggcatgtaatagacatggtatgggttgatgtagagcagagtggctcatccagatgcaaagcagtaagaccttggctacagaaaattatttcacaaaattccacaccctttcatgacaaaaacactcgatgaactataaatagaaggaaactacctcaacatagtaaagaccatctatgaaactcccatagtttacatcacataaaatctgaacaaccagagacattttctgtaatatcaggaacaaaccaaggatgcatactttcacatcttcaattccaaatattattggaagacctaggcagagcatttagcctagaaaaagaaataaacagaataaaaactagaaataaaagtataaaattatctctgttttcagatgacataatgtcatatgtagaacgccattaaaagacccagaaaataattctgaaagaatgattaagtgaatttggtaatgtttcaggatacaaaatcaccacttaagaacatctcatggctaggcatggtggctgacgcctataatcccaacactagggaggctgaggtgggagaattgcttggggtcaacagttcaagaacagcatgagcaacaaagcaagaacctgtctctaccaaaaataaaaaaataaaaaggaaggaaagtcacttgtatttctatacttaaccaaacaggacaccacccaaaatgaaattaagaaaacaattcaagaggacccacagaccctctgaaggaaggggactgcacccgcaggacccgggagacaccgcaaatactgtgagtgcctcaactgcggaagtgggaaaaggagaccctcctctcccaaacacacacccctactgaagaatgtgaaagtctgttagcaggagaagttctcaactttacctggaacggagttaagttagacagccaagctcagtgaaatacacaggtgtaggaggtagcggggaggccctgggaacttgctgaatccccaagcaacccattcctttctggcaccacaggaatacatcaggaaggaggacagacaagcagcgggtaaaactccacgggaagaaggacttccctagctgaactttgcaacaattcgaatcgggtgagaggcctcctggctctagtatccatggcactagtatccatggctgagaggcccatggatagttcacatcacaggactctgtgcagaaacccccagtaccagcccagagccgggtagacttgctgggtggctagacccagaagagaaacaaaaatcactgcagttcagctcgcaggaagacatccacaggaaaagggggagagtgctacatcaagggaacaccccatggaacaaaaaaaatcttaccagcctttagccctagacctctcctctgacagagcctaccaaaatgagaaataacttggggggaagagtgggagaggggcgaggagtaaaagacaacaaacatggtacagtgtatactgctcaggtgatggctgcaccgggatctcacaaatcacccctaaagaacttactcatgtaaccaaacaccatcttcccaataacttacagaaaaaaaaaaaagaatattataacaatggaatcatatattatgcagcctttcagcattggcttttttcacggagcacaatttccttgagatatatctgagttgcgttgtatcaattatatagtttgtttctttttattgctgagtaatgtttcatggtacggttgtatcaagcttgtttaaccattcgccagttgaggaacatgtggattatttccagtttatttttttggctattaggaataaaactactatgaacattcttatacattaaaaaaaaaagaaaacaattcaaatttcgtcattagaatgagtaaaatgcggctggcacggtatctggtgcccataatcccagcactttgggaggctgagacgggggatcatctgaggtcaggagttgttagagaccagcctggccaatatggtgaaaccctgtctctactaaaaaaagattaaaaaaaattagctgggtgggtggcacactcagtgattgcagctactcatgaggctgaggcacaataatcacttgaacccaggagacagagtttgcagtgagaggagatggtgccactgcactctaacctaggtgacacagtgagactctgtcccaaataaataaataaatgtaaaatacttaagaataaacttaagaaggtaaaacacttgcacattgaaaacaataaaacattgctaaaagaaattgaagaatacacaaataaatggaaagacgtttttgattatgtattggaaaactcaatattgttaagataccagtagaaaccaaaataaaatatactatagagtcatcacaatctttatcaaaattccaatactacttggtacaagaatggatataattctaaaatccagatacccaaaatagccaaaataatcttgtaaaagaagaacgttgttggaatcctgacacttcctgattccaaagcatactaaaaagatacactaatcaaaacagagtggtacatatagacagacatacagacaaatagaatagaattgagtgccttggagaaaactctcagttatatggtcaaatgattttcaacaagcttgccaagaccattcgtgagggaaagaacagtctttttaacaaatgctgttgagaaaactggatatccacatgcaatctggaagtgaatcaaagacacaaatgggagagccacaactgaatcttaaaagaaaacattgggaagtaggtccacaacgtagggtttggaaatgatttcttggatatggcacaaaaaagacagggaaaacatagaaaaagaagaatatagataaattgcatttcatcaaactgtaaaacttatgtgcagcaaaggacactaccaacagagtgaaaatgcagataatagaatgggaaagattgttacaaactttatatctgataaggcatccaagctatagaaagaacttctacaactcaacagtaacaacaaaaataggaataacccgaaaaaaacaaggacaaaggacttgagtagatattactacaaaaaaagatctacgaatgtccaataagtacatgaaaagatgtacagcatcaccaattattagtacactgcaaatcaaatcacaataatatacaactctatacccattaggatggcattaaccaaataacagaaaattaaaagttctagcaaagatgtttagaaattgcaactgttacgatttgctggagagactgcagaatgatgcttccactgtggatgccttatggctgttcctcataaaatcaaacatagaattaccattttatcagaattttcacttctgggaatgtgcctgaaaaaattgaaagcaagatctcaaagagaaaattgtacatcctcgttcatagcagcattgttcacaatagctaaaaggtggaggcagcccaagtgtcaactaatgaatcaacaagatatattatacacacacaagggaatattattcagccttaaaaagaaagtctgacccatgcgatggcatggatgaacctttaagacatcatgccgtcagaaataagctgacttcaaaaggacaaaaattgtttgccagcccttatatgaggtacctagaatagttaactccacagtgacaagaagtaaaacgatgtttcccaggtatgaagttttggtttgggaaaataaaaaatttgtggagatgagtggcagtactgtggttgtacaacagtgttaatttacttaatgtcactgaagtatacatttgaaaattgttgaaataatgtattttgtgtatgaatattttactacagccaaaaagaggaagatttatgtttggtgcagtttctctacctccaagaacagtggaaacctacaggactaggagagtgtgcatgagtatccaggacactcttccttttatgccagccccacagcatccaggacacccttccttttattccagccctgcagcatcctaacaagttaagagagtcagacgtacctcattacaggtgactcagaataatatgagaaagtctagaggtggccatgatgttagcggtgggtgcccaacccagcccaggagcagccgcaaatgcaacagtggccaaagaaggggagatgaagctggtggcagaggtagcagcccctccagctggagaggggcatctgcttctgtacaaaatggttcacagttgataagtcttgcatagatgcctcatcgtttacctcatgaccaactacagttttcattgcaatgtacgttatcatagcagtaatgtctatttcctcctgtagcaagcaaacatgaacgaaacgtgctttactgctttgtccaacaggacatgttagtcccaaacacaggctgaatgtttaaaggtaacgttctctaaagataaggatattataccatttattgataaatacggggattgcatgatgaccattcagacacttggaataattacttggctaaataacattgtttaaacaatgagtaaatttagttattctttgcagagcaaaaaagatccaagtttcaccagtcccttggcaaacactacatttcaaactatggaagggagacatcctgaaattttgtgctactctttctgaagacacagaaacagtcaagtcatacctaatacttatgagcataaagctttgataaaattcaagaattatttgcattttgaggaaaaagactttgtcgctaaagcagagaagaacctaaaacggactcctcatagtgagctaatattttataaaaaggtgtcaatcaaggtgtggcttacaaaaatactttcaaggatgtttactttccagccatctcactggacaagaactgggtggttttcattaactttggactgtgctttaatttcctaaaaatgatgtcacttactgccctgagtgacatgggatgggatgctgtggtagagcacactctggctgatgtcttgtacctgctggagacagaaaaggatgggagacacagtcctccacaggaaatctcaaatgggtccctctttcttttcagatatggactttctggggagtaatactgtagggcttttcttgttgttgcctttaactgtctcaaatgttctcccaaagatgctactgaacacagcctctcctttgagcaagttaaaagtctgggtacgactgtgagaggctcctgcctgccaacactctttctccactttcagtgactgctcttcttctgagggccgtaaaccaacaactgctcatcccaagatccactaagccctctgggaaattggtgctgtactgcataccctgcctgctgggacttgttacattgatgtattttctaaggagtgaataatcttgtccaagtaactaacttatttaaagacattttcttcggtgggcactgactccatggcacccgttttccaaggagttggtgagcttgtttctgagaatgccagaaatcaatgtacattccaaatcattctaaaagtgatttcttttcggtgtgggtttggttttgttattaattttgaaatatatctttgaatactgagatctctgaaactactagatctctagaagtgtaattgggaaagaaggttgcttgcagctttaacaaaatgagaaactcttcccaaatacaacctgttttgaagttaaaaaaaaatgtgacattagaacctgcaaaatctaagagtttccaacagcagtctcaattctgatgctaactgtaagctagggactcccccaacaacgcttcacttcttatgattcccaagaaggactcacatcactcactgaaacttgtgacgtttgttgatatgattttttacaacaaaagaatgcagattaaaataattcaaggaaggaggtacatgggcagagttcaggagaattccaagcacaggcattcagttgtcctctcccagtaaagtaatagacaatgctgcattctcctggcagcaatgtgtgattctgtgcatgaattattgccaaccaggaaagctcgctgaagcttggtgtccaggcaggtttttttgggggtgtgagttggggatggggttgcttatgtagaccttgttgatcatccttatggctgactccgacttgaatttccactgaattgacaataaaacttcaaccttaaatatttggttattttctttttaataaattctctaaaataaattattttgaaaatgctcgctttagctagctgtttatccaatatgagactcaacataaatagtttcaaaaagccagtgggtcattaaaacaattcctttagtcatccaaaacattcagataaaaattaacaccatgtaacactaaaatcgaattatagtcactggggctggatttcaacaacaggaagagaaagtagtacaaatagggatgagcaaaaaatagacaagtaatggatgtgaattggcctaggaaatttacagtggcaatgtcaaaaaggtaaatcaatagttatttgacaatacatgctcagtccaggaaagccaccagggggcggtctgggtcgtctgcatcataagaagctcaaggagttcaaactgaatgaaccctgcacagttgctcactgggtcgtgtaaaatgttagagcagctgcttcctcccgcaacacacggccactctgggcagtcccctcacagtgtggctgctctcagggctgagaacctgggtggtgctaaaggtggtgaatgtggtaaagatttgcataaagcaccacacaacacacctcctccacacagggatctcagtagcatcttcaaaggatgggctttctgagctaagagcaataagaagaaactttctaaacttactaaaatttatttattgagttatgttcaaagcaatacatgcctattacataaaatcagaaagtatttaaaatcaccgagttctcggcaaaggttctttattccaagcaatcaatatgactatttttttttatttggatgcattctttcatttttgttctcagtatttccacaatggtgatcaagccttgtgctttttcatctgcttttatacccctttatgatctagtcatttcaggttaatgtaagtagtgttccatttcttaaaagggataaaatatttaaatagttgctaattttatttttatttgaataccaatgaaatattatcatttttagataattcttattgtttgctactcaaacgaagatatgatattatcttattattaaaacactcctggtaacttctgtggattttgtgaggtcagaaaaaaaatgcctgaaattttcaatggaaagccttgagtacattacacctgacttcacaatgcagtaaatagagaaacaagagtttccgattcatgtaagaaggagcataacagattaaggtatgaggaataatttatatccaaaactacaccagtgtctccaggcatgtgttagaacagtaccccccaaattctgttgtgcatatgcatcttctggggattttacaaaatgcagattctgattcagtggctctggagtgaggacacagtctctgcatttctagaaagttcctaccacacaaaatccacatatatgtttgaacaataacaaggccagccaggagaagaggctcaggtgtgtaatcctagcactttgggagtttgaggcaaaagaattacttgaggccaggagtttgagaccagccagggtaacgtcacaagatcttttctctacaaaacatgtttttaaataataaaaaatgaattagccaggcgtagtgtggcatgcttgtcatcgtagatacctaggaggctgaggcaggagggtcgcttcaccccaggagttcaaagctgcgatgagctatgattatgccactgcactccagcctgggtgacaaagtgagaccttacctctaataacaaaaacagccataacaaattcataagaatagtgtaaaataaggagaaaccttggcagacaataacctaagagatatctcagacatagtgaactaatgtgtttggatgacagaagaaccccacacttggctggctgtggtgactcaggcctgtaatcccagcactttaggaggccaaggcgggcagatcacctgaggtcgggagttccagaccagcccggccaacatggaaaagccccgtctctactaaaaatgcaaaattagccgggcgtggtggcgcagcctgtaatcccagctactcgggaggttgagccaggagaatcactggaatccgggaggcggagtttgcggtaagctgagatggaacgagccacactccatgcaggaagacgaccagggaggacagctgcaaagcagggagaggctcccctttctttaagaaacaaaacaaaagcaaacaaacaactaacctgacctcccctctggctcccatccaacattcttactagcttctcatctagtcttttctgtagtgtagcccatccttaccctctcccctcccacatctctgattcctgaattcccttcttgggtctctctccttttcctgtcaaccacttctcccctctatcatcctgagttaattatcaagagctttatagcaggaagcctattggtatttttccagattttttttcttggaattggacattcatacattttctctctttttttgggggggtagggtggggtgggggtgggggtagggacagggtctcaccctggttgcccaggctgtggtctcaactcactgcaaccttcacctcctgactcaagcaatcttctcagctcagcatcccaagtagctgtgactatgggcacgcaccaccacaccctgctaatatcttgtatttttggtagacatggggtttccccatgttacccaggctggtcttgaatttctgagctcaagtgatccaccctcctcagcctcccaaagtcctggaattacaggcatgagccgctgtgcccagcctattttttctcttttacgagcctctctgattccctagttctgaagtagcccagagttggctgattctcctattttgcctcagctagcacttcctccttctcctttttttttttctccttctgatccctggagtcctctgcatttccactgaatccagtgaaccacacaagcatgctcatttattctccccaaactccaccactctgccttatgtgctgatccagtgagaatcaagaaggaagagagacccatggatttctgtgcagcctggaaagtcagttcatggctggacttggctgggacaccagacacctgtctccctgtctctatttagtattcatagggcccagcagctgcatcctcccagggtgcctgaagagtcactgaccatgctctcctacccagcctcaagaagccacccagtcctcgagaagtataatcagactcagcatcttatgtgaagggaacaaccatggggacaggttagacttgcattgagtcccctcctctaagaagggccagggaaaaggggctgttccccctaatctgtgtggctcaggaagtagagctccagagacttctctaccatggcctgaatccctctgctgctcaccctcctcagtctctgcacaggaggctggagatagaaaggcagggactggcactgggaggaccagggctctgccttgctcccccggctcaccgagccacttcccacaccctgtgtctctgtcctgactcttagggtcctgggcagtcagggctcacttggtggcctgcacagtttgtctgtgactaaaccagccaccatctcctgcactggaaacagcagcaataacgtccttggaattgtgtcctggtaccaacaatgaacaggaagtgtccttaaacctctgatctgtggatgtaaatatccacctgcagatccagaactgattcttgagtgatcagtctggcaaggaggccttcctgagcatatctgggctccaggctgaggacaaggctgatcactaacgttggatttggacagttctctggaggcccccacggtgctgcagtctgtggggaagtgagatgggaacatttcaggtctcctaggagcacgacccgacagcaccacctacaactgggaaaactgggctgtttaccatttgtgttcatgtttgcttgggctggtgctagccagggcccaggtctcaggtcagggacagtgatttagagaatgcagctttgtttcctcagagtcagccctcagagaaagcccatagcaacagcattgtcaaattgcctcaaaaaaaatcagaaagtccttggttcctggaacaggctgccctaggaacagagcccaatcggtcagagcaagcagggacacaactgtgcagaaaacaacaagttttacttagggagataacggttgactgtataaaatgagaaatatgtcacactactcacttgtaaaagtaagtttaccaatgctattcatttccctatatcactacgttgagtaaaaactctaaaatgtatgaaaccactgtagagataacttttgctgaattgctactttaacatgtcatggatcatttatttttcttgcaaaattctcattattcaccgtccttttgagtaacccccagctgcccttcaacctagctcctcagctgacctcttctccatgatgcctaccctgatggcacatgtgggcagttaggtttttctagattttaaaagttatatatgtacatgtctacatcccatggaccaagactcactctgggagtgagaaatcacaataatcatgcatagccttatggaattagtgtctagcaatcagaccatagaggtgtgaatagagacagtgactaatgagctgcagagatcagctgggccatcaggaggtaagtgtcctctaaccagcatgggatgctgggggactgccctatggtccctacacagctgctcagtaaggaccattcactcaaagaaatccaagactaggggctaagaccccgtgctcactgaggggtacttagcatctatgtcctcccatggcatggcagagtcccctgagcaggaaggtgtgtatggtttcagtaggtgctttcttccggagccctctcaaggggaaaagcaaaacttcttcctcctcagtctgcagtgtgagctgagcttcagccccagagcttagagaggggctgggcagtccctggatgaaaacacatttgcatgagcagcccctcctctgcagagtatgggaagaaaaggaggcctggggcagcccagtcccactgtgcatgtcaggctgtgtccaccatggcctggactcctcttcttctcttgctcctctctcactgcacaggtagggacaggcctcagagatcagggccagccacccaacctgattctggctcttctggtaaagatccctgaaaaacctcaccctgaaccctgcccatcaaccatgagtgtctgtgtttgcaggttccctctcccagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgcttctcacagtgacacacacagatgggaaagtgggacaaaaacctcaccctgctttaggtcttgttcttaaaaaattttaaattttaaaataactggcctaggcacaaactacatttggaagtactttctagttgtaaaaggctcttctctcaatttcccatccattcgtctgaagtctcagtaaaacaaaacaaaaccaaagcaactgatgacactgaagtcttggctggttgtcatatgtgctaacaccactgcctgtggagctggacttttgttcttgaaagaagcaaaatgaggctttcctagctcacatcatggtcagagcctggggacatcctagcaggtgaacagtgccctgcagcatggactctgctcttccagcgtacgggcagagacctccccttccatccccagtagtctgttctcagggctgtctgtggctcactgtgtcccaggaacaaggcactcaaatatgaaatgctgcctgaggacacaggtcagggaattctagatatagtgctgacctggctcagtcctgggtacctgcatttcagtggcaatgtcaggagatggggttaggtattagggtaactggggacctgagaccagtaaacctctatgtaggacatgacaggagagtcaaggggaggctccactgtggctgagacaagccagaggctgctccttggccacgggggaagtaggtcccatggatgtgactttcctgcagctcatcccactcaggaccatggggactgctgagcgtgggtttcttgatccctcagcgcctgtgttctcttctcctctcttacaccattggagcttcttgctgaatcagggtctagtggtgagtatgtggaaagaccaccacatctcaaggtcacctttttctgcatggggagcagcagaaacattgggcattcccgtggaaatggctacggaggcctcccagaaagagcccccaagtttatgacctaggacagcagtgatggtccctcaggggtcccagcctgattctcctgctctgggtttatccacacagcctcctggagcacctcttggctccagcctgaggactggctggttatcagtgtcacacagctgcatcctgactccatgttaccaagggttcctgttccatgtggaaatgagagaaagatctgccccactcatcctgtctccccatccctcctttatccctgcctgtgaccaacaccagttcatgccaagacttcggctgtcacttgtgttactgaagcagagcacaagttcagtaaaaataatcccttttcttactggtctcccaatgcaaacagaatcaatttgtttctagaagcaaaaggagctgcccacacatggtgggtggggatgaggtagggacaagaaagaatccaccctgtgtgacccagaggcccagaagcctttagtctggttccaaaggtgtctcctcctcttggtgcagttatgctgaccatttcctgagctcagaaactgtgcgagagatgccaagaatgaagaatccagcctgtgtgacccagagacccaaacgtgagacaggaagtctgatgcttaagaaaacgtgggttcagcattctgaaaggtctagatatggcttggcctagagctggtgtagaagagaagcaagagagatgctcagccttaggtggcccaggcacagcggtcctgtcaaggggttgagctctctgcaacatggatatcctgcagagacatacttggggaggctgtgatcccagaatgacacaaaaatgctaatggaaatgagcaggggattgtttatgggggaatggggagacaggtgtgggataagatgtggtaaggagaatgcagcctgaagaggagactgtccattgtgactcataggaggagtagggccggggcctacagtagtgataaaaggaggacctggaaggacctgggccctgaagacacacagagactggagttttggtctgtctgtgagggtcccatgaggataaaaatccatggtcagtgtcctctgtccagggctcactgtcccagctgttgtccctcctggatcctctgggtgtccagattccgtagctgtggacctgttctcctctctgtcctcagcctaagagctgatggggcatccaccaggaagcacatctgtgggcagggagggggccatgggcagccttgtcctgtatgtgaggcactgctcagcctcggtgatccctgttcattaacgtgggaggaaaggaaaacaaaattcactgtgaacatctatgcatcatcaaagaaaaagcaatgagccaaacaggaagtgaagcccagctctaatagtttgtttctacttggaaataaataaaacttaatatgcctgatgtgttacgtaaatgcaataaacattttttgaaagctataaaaattatgtaaaggaacatggcttacactaaaaggaacacttaaaataatgacacccttgaaatgcaatcccaaaacacagcatacattttatttcagttccatatatggactggttttatttaaatgtctatattaaatctcactattccatttttaaatggagcacttaaaatctcattctacggcaactgcctggtgatacatttaccagtggaaatatcaacaaaaccatccagctgttttcctccatccccatagaattccccaaactagtaattattaagagcccaggatgtatcatgccagaattcatgcagtcgtaggcataacctgtttcatttttcattctgatcaacagaattacaatttttcttaagcttgtttttagcttattagattctagttgtcattacagatcaaagataaataattttctatcatccttaagccacccccataacactcactactgaatttgaaccataatttttccctaaaaatcctagttggggtgcttgatgttgagagctaccacgtatcaggctcacctgaggacagactctggttaaaccaagttaaaattttaattcttcccatcttcaaagactgagcatctttgctctttttgttcataagtgaaacactccaaagtcatttgccaggatcccctgcagatgagcatttagtgtacagactcctaggcaagatccctggtcacagtatccagatgactatgactgcaaatctggggaagtagagggagaacaaagatttaccaggaaaaccctctgggaattcctccccagggaatcctagaggaaagagctccctttctcctcagcgccacaggatccacagaggaaggagagctctagccaccaggaaggagccacatgagaggagaggacctggtgtccaacacaggtggggaggtgagtccatggggctggtccctgctatgggcttgatcctgacataggactttatgtagataccacctgagtcctctacaatgtacagccaaagagccatggaaagattcactcctgaggagtctgaagactcctcagtagagcgtgaagatagccctgaagtcacagggaggagacacagacaccacttggcctgccttggacctgagagagggggcagtggacagaatggggggaggaagccatgtatctgagaggttctggtcaccttatcatagaatggtttaccttgatctggacaccagagggcgcatggggatcattcctgagaagacaggggtgatcagagcagaaccagccgcctgccctgcctggtgtcctctgctcagggctcacagctgtgtcctccccaccccctgggaccacaaagctccacccctgccaccccctgacatcctcaagccaaggagcctgacccagggctcagggtggggtcacaaacctggggggggtctgatttgcatggatggactctccccctctcagagtatgaagaaagggagagatttgggggaagctcagcttcagctgcgggtagagaagacaggactcaggacaatctccagcatggcctggtcccctctcttcctcaccctcatcactcactgtgcaggtgacaggatggggaccaagagagaggccctgggaagcccatgcgaccctgctttctcctcttgtctccttttgtctcttgtcaatcaccatgtctgtgtctctctcacttccagggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggtcccacagtgctccaggcccagggggaacagagacaagaacccccttccttttctgccaggagggtgagccccggctgctgctgctcaggcctggcctgtggcttctgctgctgcagcttcccccatgggtccagggatatccagggccctgcctgagagtggaggctcctcctcccctgagtcctcagagtcaggaacagggtgtccagaaaacaaaagcagggtgtcctgctccctgtagcttgggacacagggtctctgcactgaagtcctgggctgaggtggcaggtccagctgtgtcatcacagacccacttctgttggggaacctgtgtctccatcatcctactttttccatttccaggagtttccagagtggtgtcttcctcccccttctcctcagtgtgaatccctgtgcttcctttctctccagcctattctttttttaataaaactcctttcatgtaggaataatgcacatataataagccacccatatttacaatagggaatgagacaaattttggcatttctatggatccttgaaaacatcaccaccaccgggagctatacaacatacaacctgtgaccaaccccaatagctcctcatgacccttgtcacctcattccctcccccaacaccctccttggaagttgcagatctgcctctgtcactactgtttggtttctcttttctggaatgtatcagtgttatcaaacattatcttcccatttgttcaggcttctttcactctgcacacttcttttgagattctcgctgttgttgctgcattgtacccatctcgtagagggctccttactatctttgaaggtccttaggccatttttttctgattttatttatgtatttattttaaagtttgaatttattgtgcatccaaatcaaactttaggggcaatgttcatctaaggtgacaggacagtctgtgatggcttgtcgggattcttgcttcttcatctcttgcttctgattctctctatagtggaagaggttctcgtctttcatttatttatatatttatttatttactgatttatttgggtttttaagggttttagtgatttttctctttttggttatttttcaatttttttattttaataggtttttgggggacaagtgttgctttgtcacataaataagttctttagtggtgatttctgagattttggtgcactcatcacccaagcagtgtacactgtacccaatgagtagtcttttattcttcacccccctcctaccctttctcctgagtccccaaagtccattgtatcattgttatgcctttgtgttctcatagcttatctcccactgatgagtgagaacatacaatgttttgttttccattcctgagttactgcacttagaataacagcatccagttccatccaggtcgctgtgaatgccattattttgttccttttatggctgggtaatattccatggtatgtgtatgtatacatcacatttgctttatccacctgttgatttatgggcagttgggctggttccatgcttttacaattgtgctgctataaacatgcgtgtgcaagtatcttttttgtataacgacttctttttctctgggtagatacctagtcgtgagattgctggatcaaagggtacatctatttttatttccttgaggaatctccacactgttttctgtagtgactgtactagtttaccttcccaccaccagtgtaaaagtgttttgttttcaccacatccatgccaacatctattattatttttattttttgattatggccatttttgtggtagtaaggtggtatcacatcgtggttttgacttgcatttccctgatcattagcgatgtcaaacatttttctatatgtcttttgtccatttgtatatcttcttttgaaaattgtttattcatgtctttagtccatcttttgatgggactgcttattttttttcataatttgtttgagttctttgtagactatagacattagtcatttgttggatgtatagattgtgaagatttgcttccactcggtgtgctgtctgttagctctgctgattcttttgctgtgcagaaggtttttagtttaattaagtcccatctatttatctttgttcttgttgcatttgcttttgggttcttggtcatgaagtatttgtctaaagtaatgtctagaagggtttttttaatgttatcttctagaatttttacagtttcaggccttaaatttaagtctttgattcatcttggcttgatttttgcataaggtgagagatgaagatccggttttattcctctacatttggcttgccaattatcccagcaccatttgttcaataggatgtcctttttccactttatgtttttgtttgctttgttaaagatcagttatttggctccatttctggattctctattctgttcctttggtctacgtgcccacttttgcaccagtaccttgcagttttagtgactgtgagtcaaattatgctagagtatagtttgaagttgggtgatgtgatgcctccagatttgttccttttgcttagtcttgctttggctatgcaggtcttttttggtttcatatgaattttaggattgttttttccagttctgtaatgaatgatggtgatattttgatgggaactgcattgaatttgtggattgcttttggcaccatgatcattttcaacatattgattctacccattcatgagcgggggatgtgtgacatgattttttcagcagtgttttgtagttttccttgtagaggtctttcacctccttggttgggtatattcctaggtgtatttttttgcagctatttgtaaaaaggtttgagttgttgatttgattctcagcttgttcactgttattgtataacagagctactgatttgtgtgccttacttctgtatcctgaaactttgctgtatttatttaccagttctttttttttttttttttttttttgagatggagtctcgctctgtcgcccaggctagagtgcagtggcgcaatctcagctcactgcaagctccgcctcctgggttcacaccattctcccaccttagcctcccgagtagctgggactacaggtgcctgccaccatgtccggctaattttttgtatttttagtagagacggggtttcaccgtgttagccaggatggtctcgatctcctgactttgtgatccgcctgcctcggcctcccaaagtgctgggattacaggcgtgagccaccgtgcctggccatttatttaccagttctaggagatttttggatgagtctttaaggttttctaggtatatgatcacattatctgccaacagcaacagtttcacttcctctttaccaatttggatgtcctggatttgtttctcttgtctgattgctctggcttagacttccagtactatgttgaatagaagtggtgaaagtgggcattcttgtcttgttccagttctcaggggaattgtttccaacttttttttcctttcagtataatgttgactatgggtttgaaagagtgggcttttcttaccataaggtatgtctcttctatgtcaattttgcaaaggcttttaaccatgaagtgatgctggattttgccaagtgctttttctgcatgcattgagataatcatgtgatttttgtttttaatgctttttatgtggtatatcacatttattgacttgcatatgttaaaccatccctgcatccctggtatgaaacccacttgaacatggtggactatgtttttgatagctgttggatttggttagctagtatttcatttattatttttgcatctatgttcatcagggatattgttctgtagttttcttgttttgttatgtccttccctcattttggtatgagggtgacactggctacaaagaataatttaggaagaatttcctctttctccttcctgtgaattagtgcattagtcagggttttctagatggacagaactaatggaatctgtatatatatagcatgatcacaacatcccacaataggctgtctgcaggctaaggagcaaggagagccagtccgagttccaaaactgaagaacttggagttccatgtttgagggcaggaagcatcaagcataggagaaagttgtaggctgggagcctaggcccatctctcttttcatatttttctgcctgcttattttctagccatgctgttagctgattagattgttcccacccagattaagggtgggcatggctttcccacccactgactcaaatgctaatctcctttggcagcaccctaacagacacacccaggatcaatcctttttatccttcaatccaatcaagttgacactcagtattactcatcacaagtccaccccttgtcaacttcaacccatatatatcttctgagatcatacataatcttcaaataaagacaataataaggtcataatgacacctaacataatacaactatcattcatacaaacagaaacacatcaatccccaacccaaatactgttacataaagttaacgatacttaaacgctgatgtgaagtcaataaatcttatgtcacatgataaaggagaaaggaaataacatgaagatattttcttaggacaaaggtatacacgcacaaacatgtttttaacaaaagaaggaggaaatactcatgacaattacactcctcgtttctgcagctggccatagctggtattgatgattactttcttctactatccattctgtattctgtattccctttgccttcagcaagcacctcagcaggtcgtggatatttttccagatggtgtgatccaaatcttcattcctgaagcatctggttcatttgtagtcctgcctggatagggctgttttagttttccatggaccttaatcacagggcatgataatactaagaaatgccctaatggatctcctgtattccatgcatactcttccttacctccgttatggagtagtaaactgatttcatcttgatagtctgtcccaaacaccccagccaacactgtaactcccttcttagcctgttgacttaaaggtaggaggagcccaaagtgtccaggtggcaatcttaacttccccagtttaatggaatcattgatgtgtctccaagtggcagtgttccttcctctggaactaaatcctctaagccagcagaacataatgtcgtgggaacaggaagcaaaaattttgctagtggatcactaggggtgatggtgagtgctgccacttccacttccaccccttgattcctagactcatgaatcctggctatgggagaaacagtgccatatattggatgctgactcagagcatacacgccttctggggaacttagccccagcactgcaaagtattgtcacctagttgacattgtaattgtgacttcaaaaggccattccattgttctatcaatccagctgcttcaggatgatgggaaacatggtaagaccagtgaattttatgagcatgagcccactgctgcacttctttatgaataaagtgagtgccctggcgagaacaatgctatgtggaataccaggatggtgaataaggcattccatgagtccacggaggatggtagtcttacaggcaaacccatatctggaataagtgtctatatcagtgaggacaaacctatgcccttctcataatggaagatttccaatataatcaaccttctaccagatagctggctgatcaccccaaggaatggtgccatatcaagggctcagtgttggtctttgctgctggcaaattgggcactcagcattagccatagctaggtcacccttggtgagtggagagccagttcgagttccaaaactgaagaacttggagtatgatgttcaagggcaggaagcatccagcacaggataaagatataggttgggagggtaggccagtctctcttttcacatttttctgtctgcttatactttagccatgctggcagctgattcgattgtgcccacacagattaagggtgggtctgcctttcccagcccacttactcaaatgttaatctctttcagcaacaccctgaaagacacacccaggatcaatactttgtatcctttaatccaatcaagttgacactcggtattaaccatcacaattaatgtcataggattagtactaattcttctttgaatgtctgatagaattcaactgtgaatctgtctggtcctggctttattttgttgattttttttaaattaccatttcaatcttgctgcttgttactggcctgttcagagtttctatatcttcctcatttaatttgggagggttgtatacattcagaaattgatccatctcctctgggctttctagtttatgtgcatagaggtaatcagagtagccttgaataatcttttatatttctgtggtatcagtattaatatcttctgtttcatttctatttgagcttatgtggatcttctcccttttcttggttaatcttgctaatggtctattaattttatttatcttttcaaagaaccagttttttgtttcatttgttttttgcattgctttttgtttcaattttatttagttctggtctaatcttcgttatttcttttcttctgctgggtttgggtttgccttgttcttgagtctccatttccatgaggtgtaaccttagattgtctatttgtgctctttcagactttgtgatgtatgtatttaatgctaaacattcctcatagcactgcttttgctgtatcccagaagttttgataggttgtattaagatttactacaactgcaaccttactattgaacaatagctttttaattcctgagagtgtgacctcatttatgcccaaaaacaactttatgattgcttttcatgcagtaggccatgattagagagggagtgcttgtggcctggaggtagggttctccaatttatcaaataaaaacattggagtgcagttaaatttgaattcggtaaaacaatgacaaagaattagtatgtgtatctcccacatgatattgttaaattgaaatacaaatttacctgggtgcgctgtagtttatctaccaactcctcacaggcttcgaggcttggaagaggcagtgttggggctggtctcctcttactgatgccaggtctatgagctgaacctcaaaggcagagtctctctaacacagctaccctccagtgagcatgttagttagcactaaatacaccatatacgatttccaatgaataacacctactcacttccctaattcttctttctattattctccaagtctgcagactcaggacctccccaggggttgctgcagccagagctctggatgagggacctcataagtctttcaaaaccagatgcaaggggactactcggtccccacacagtgaggtttaagccaggggtgcataagcaacatgtaagagacagaagagctcagtatggctcttatggctctccttctgtccagtgagaaaactccagggtccttttgatgctgaaggtgggtgggctgagagtaggaggagacccaccctgacagcccagagattccaggacaagacttggcagcctgaaaaggggccacactcttgagtggggaagaaggaggcaactctgctcacaggcgtgcatttctggtggcttcccctttaccaaactggactccctactctgatgtctatcagagaatctccctcagtgagaccaagatcccaggacattgctaaaaacagcagcatggaccagacaggtatgtcatggtacaggaattctttgcagagcaataaatacaactgcagcttaagaggggccctcatagtcataactttggtgaagaagaaaatagacaaaggcagggagaaactgaagggctcaataggtctgagactggggcagcactgggtgctataggcttgtccttgaggggctgcagataatgacagctgggaagccatcatctgttcactgctcactgggctcagcagctgtgtcctcacagggaaccagattcagccaacctggctttctccaccccacctgggaaatgtattccggtgactgtctggactgaggttctatgaaggggctaggagacaagaagagggagacaggctggtttgcataaagaaagcattgcacaccctttcctttcatctaaaactcattaatggaaactctggggccatccatagaagtctagctggtctcctaaatttgggagttatgaaggattcattcctgatcaatctacaggaagggccatcagcaggaggtggtcagagtgagggagaaactggcttccttgagagactcttcaacacaaccaccaactctggggcaaatggggtgacttgctataacagtcatcccaaactactcacaggaacctgagcctagtcccctcaccttattgcttctgattctggtccatgcctctgttttccctggaccccttgcccatgtctgagtccagagtggcagggatggttccatcccagtcaacatctacaaagaagtctacatctacagctactatgacttgaagcagagtccacagttgtacccaagagggcctcttcagctcccccaccccttcacacaggtgacctctactgtaggtctggttgagtggcccctggaccctggtgaacacaaggtatttattcctctctaacaccaggtatatagtggagcaggtctgggtgggtatagagcagagtgtctcttccaaatgtaatgcagtaagaccctggctacagaaaatcatttcacaaaactccacgccctttcatggtaaaaacacccaatgaactatgaatagaatgaaactacctcaacacagtaaagaccatctatgaaaatcccacagctagtgttggccgggctggtctccagctcctaacctcgagtgatccgccagcctcggcctcccgaggtgccgggattgcagacggagtctcgttcactcagtgctcaatgttgcccaggctggagtgcagtggcgtgatctcgtctagctacaacctccacctcccagccgcctgccttggcctcccaaagtgccgagagtacagcctctgcccggccgccaccccgtctgggaagtgaggagcgtctctgcctggccgcccatcgtctgggatgtgaggagcccctctgcccggctgcccagtctgggaagttaggagcgcctcttcccggccgccatcccatctaagaagtgaggagtgtctctgcccggcagcccatcgtctgagatgtgcagagcgcctctgccccaccgccccgtctgagatgtgaggagcgcctctgcccggccgcgaccccgtctgggaggtgaggagcgtctctgcccggccaccccgtctgagaagtgaggagcccctccgcccggcagccaccccttctgggaagtgaggagcatctccgcccagcagccgccccgtccgggagggaggtggggggccagcccccgcccagccagccgccccgtccgggagggaggtggggggtcagccccctgcccggccagccaccccgtccgggagggaggtgggggggcgcctctgcctggccgccccttctgggaagtgaggagcccctctgcctggccaccaccccgtctgggaggtgtacccaacagctcattgagaacgggccatgatgacaatggcggttttgtggaatagaaaagggggaaaggtggagaaaagatagagaaatcagattgttgctgtgtctgtgtagaaagtagacatgggagacttcattttgttgtgtactaagaaaaattcttctgccttgggatgctgttgatctatgaccttacccccaaccctgtgctctctgaaacatgtgctgtgtccactcagggttaaatggattaagggcagtgcaagatgtgctttgttaaacagatgcttgaaggcagcatgctcgttaagagtcatcaccactccctaatctcaagtacccagggacacaaacactgcggaaggccacagggtcctcggcctaggaaagccagagacctttgttcacttgtttatctgctgaccttccctccactattgtcctatgaccctgccaaatccccctctgcgagaaacacccaagaatgatcaataaaaaataaataaataaataaataaataacaaaaaaaaaaaaaaagaaaatcccacagctaacatcatatgcaatctgaaagaccaaagaggtttttgtaatatcaggaacaaagcaataatgcacactttcaccagttctattaaaagcagtattggaagacctggcaagagtaattaggcaagaaaaagaaataaacagaataaaaattagaaataaaaaataaaatctctgttttcagatgacataatgtcatatgtaaaatgcccttaaaagtcccacaaaaaattattagaatgattaaatgtattcagtaatgttttataatacataatcaccttgtaaaaacatctcatggctaggcatggtgactcatgcctgtaatcccagcactttgagaggttgaggtgggaggatttcttgggttcaagagttcaagaacagcctgggaaagaaagcaaggctctgtctctaagaaagcggtggggggtggggggaagagagaaagagagagaaagagagagaaaagaaagaaagaaaaagaaagagagagaaagaaagaaagaaaggaaagaaaaagaaagaaagaaagaaaatctgttataattctatacttaaataagcaaacaggaaacaactcaaaatgaaattaagaaaagaaatcaaattacaacatcattcgaaagagtaaaatacggctgggcacggtggctcatgcctgtaatcccagcattttgggaggttgatttgggggtatcacctgagattagaagttcaagagtagcctggtcaatatggtgaaaccctgtctctactaaaataaataaataaataaataaataaataaataaataaataaataaataaaatttaaaattagctaggtgtggtggcacatgtctgtaatcccacctgctcggggttgaggcacaagaatcactcgagtatggtaggcagaggttgcaatgagccaagatcctgccactgtactccagcctgggtaacagagtgagacaatgtctcaaataaacaaataaataaagataaacgagtaaaatacttaagaataatattaatcaaaatggtgaaagacttgtacattgaaaactataaaacattgcaaaaagaaattaatacacaaataaatggaaagaaatcctttgttcatttattggaaaactcaatattgttaagctaggcatacaaaccaaaaggaatctacagattcattgcattctctatcaaaattccaagttagtatggagatcattaaaaagtcaggaaacaaaagatgctagagaagatgtggagaaataggaatgcttttacactgttggtgggagtgtaaattagttcaaccattgtggaagacggtgtgatgattcctcaaggatctagaaccagatataccatttgacccagcaatcccattactgggtatatacccaaaggattataaatcattctactataaagacacatgcacatgtatgtttgttgcagcactagtcacaatagaaaagacttggaaccaacccaaatgcccatcaaggatagactggataaagaaaatggggcacatgtacaccacggaatactatgcagccataaaaagggatgggttcatgtcctttgcagggacatggctgaagctggaaaccatcattctcagcaaactaacacaggaacagaaaaccaaacactgcatgttctcacttataagtgggagttgaacaatgagaacacatggacacagggagggtaacatcacacaccggggcctcttggggatgggagctaggggagggatagcgttaggagaaatacctaatgtagatgatgggttgacaggtacagcaaatcaccatggcacgtgtatacctaggtaacaaacctgcacggtctgcacatatatcccagaacttaaagtatatattttttaaaaagtgcaagccaaacaaacaaacaaaaagaatagaaaaaaattaatcctaaaatttatatataatattgagagaatctaaatagtcaaaatcatcttgtaaaagaagaacagtgttggagatttcacaccgatttcaaaacatactacaaagctacactaatcaaagcagagtggtacatatagacagacatactgacaaataaaacagaactgagtgcctaaaaaaacctcttagttatacagtcaaataattttaaacaaagttgtcaagaccatttagtggaaaaggacagtctttttcacaaatactgttgagaaaactggatattcaccagcaatctggaaatggatgaaagacccaaatggaagagccaaaactgtcaaaatcttaaaagaaaacattagggagaaggttcataatatagggtttggaaatgacttcgttaatatgacaccaaaggcacagaaaaaaatagaaaaagaagaatatagataaattggattttatcaaattgtaaaacttatgggcatcaaaggacactatcaaccgagcaaacatttgaatcatagaataggaaagattgtcgcaaattttgcatctgataagagatgcagactatagaaagaactcctaccactcaagagtaactacaaaaatgaaaacaatctgaattatatgggcaaaaaacttgagttcgtattgagtagactccaaagaagatctacaaatgggcaataagcacatggaaagatgttcagcatcactaatcattaggccagtgaaaatcaaaccacaataatatacaactccacacccattaggatggcattaccaaaataatagaaaataacaagatctagcaaagacgtatagaaattataactgttatgcattgctggagggactataaaatgatgcacccattgtggaggtcttatggcatttccccaaaaaaattaaacgtagaattgccattttatcggaattttcagttctgggtatgtgcctcaaataattgaaagcaggatctcaaagagaaaattgtacacccttgttcatagcagcgtcgttcacaatagctaaaaggtggaggcagctcaagtgtcatctaatggataaacgggatacagtatacacacacaagggaatagtattcaaccttaaaaagaaagttctgctattctgaataatgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtctcagtaaactattgcaagaacaaaaaaccaaatgccgcatattctcactcataggtgggaactgaacaatgagaacacatggacacaggaaggggaacatcacactctggggactgttgtggggtgggggtaggggatagggatagcattgggagatatacctaatgctagatgacgagttagtgggtgcagcgcaccagcatggcacatgtatacatatgtaactaacctgaacattgtgcacatgtaccttaaaacttaaagtataataataataaattaaaaaaaaaaaagttctgactcatgcgatggcattgatgaaccttaaagacatcacgccagcagaaataagctggcttcaaaaggacaaatattgtttgcttgcccttatatgaggtatctagagtagtcaaatccatacagacaagaagtagaatgaagttttccaggtgttaagttttggtttgggaagatgaaaaatttctggagataaatggtggtactgtggttgtacaacagtgttaatttacttaatgacactgaagtatacacttgaaaatggttaaaataatgaattttgcatttgaataatttaccactgtacaaaagaggaagatttatattcagtgtagtttctctaccaagaacaatcaaaacatacaggattgggagagtgtgcctgagtattaggacacccttccttttatgccagcctgcagcttcctaagaggccaatagagttggaagcgcctcattactggtgactcaaagtaatgtgagaaagtctgggagtgaccatgatgtaagtggtgggtgtctgacccagcccaggagcagccgcaaatgcagcagctgccaaaaagggggagatgaaactgatggcagcagtaacagcctctccagctggagtggggcatctgctcttgtgcaaaatggttcacagttgatacatttagcacagaatctcatcctgtctacctgtcatgatcaactacaatttttattgcaaagtatgccatcagagtggcatattttatccagcagcaagcaaacatgaaggaagtttcccttagtgctttggtcaaactggcatggcagtcctgaacactgaatgaatatccaaagacaaggttctccaaagataaagatattatactatttattgataaatactgggagtgcatgatgaccattcagacacctgggaaaatgacttggctgaataacattgttaaaacaatgagtaaaaaaagagatgtgctcttggtaaaggaacacctggatccagggtataaagaccggaaagaagactaccgcagatttggacttttggatcaggacttggtaacattgaccctgtttacgacaaccaaaaacaaagcagtgctgtgtctacagtgggaatctgagtcaggaaactgcagcaggaacagcagaaaaaaggaagaggagctcagtgcaaacagaaggatggggagaccacagggaccaccaagaaggcccagagtgactttttgttttccgctcagggctgtcctcctcacaccccttggatcacacatttaatgaagacggctactggtatagtctaacttagcctgatcctcacacggttggtcctcagaagcttgaaattaactgctgggcaggaaaacctattcctggagacctctacagtgactgcttctatgaacaggttttgttagatcaacatgattaagctccccagttagagatctccagtgactggctggctgactgtggttggaaagaaggtctactttatggtgcagacctctcatgggatacggaaagggtcctggtactttgaaatcaccatgaatgagatgccaccagacaccactgccagactgggttgatctcagccctaaggtaactatgaagctcccttaggttatgataaatttagttattattggcagagcaaaagggaatcaatttccaccagtccactggcgaacactactgttttagctatgggcagggagacatcctacgattttatattaatcttcctgaaaacccaagagacagccaagttaccaagataaggctttgataaagttcaacaattatttttattttgtggaaaaagactttgtggctaaagcagggaagagtctaaaacagattccatatagtaaaataatattttataaacatggtgtcaatcaagatgtggcttcaaaagatatttttagggggttacttttagccatctcactggacaagagcttcatagtttccattaactttggactgtgctccaagtatcctccaaagaatctcacttactgccctgtgagtgacatgggctgggatgctgtggtagagcacactctggctgatgtcttgtattttctggagacaaaagaggatgggggcacagtcctccatgggaaccctgaacaggtccttctttcttttcagatatggactttctggggaataatattgggtggcttttgttgttgttattgtttttgaactgtcttaaatgttctcccaaagatgctacagaacatagcctatccatttaccaagttaaaaggctgagtaggactgtgagagatgccctgctcatcatcattcttcttccacttccagtgactgctcttatattctttgccataagccaacaaccgctcatcccaagatctcataatccctctgtaaaactgatgctgtactacataccttgccagctgggacttgtaatcttactgtattttctaaggagtgaataatcttgtccaggtaactaacatatttaaagacattttcttctgtggacactgactccatgccacctgttttccaaagaagtggtgaagctgtttctgagaacacctaaaatcaatggttgtacattccaaaccaatctaaaagtgatttccttttgctgtgggtttggttctattactgatttggaaatatacctttgaacactgagatctctgaaactactagacttctagaagtgtaattgtataagaagtctgtttgcagctttaacaaaatgagaaactcttcccaaattaaagctttctttgaagttaaaaaaaaaagaataatgtgagattggaacctgtgaggtctgaggattcccaagagtactctcaattctgacgctaattgtaacctaagggctccccaacagcccttcacttcttatgattccctagaaaaactcacataactccctgaaacctgtgacatttattgatacaaatttttacagcaaaataatacagattaagataattcaagggaagaggcacatgggcagagttcaggagaattccaagcacaagcacccagttgtcctctcccagtggagaaatagacagtgcttcattttgctcacagcaatgtgtgattctgtgtatgaaacacctatttcctgggtgagccaaccaggaaagctcacccaagcttggtgtccagagggcttttaaggggtggtctgggtgagagtggggttattatgtagaccttgtggatcatcctcaaggctcacttcagtttccattgaattaacaataaaacttaaaccttcaatctttggttattttctttttaaaaattctctgaagtaaattattattaaaattctcacttaagacagctgtttatccaatatgaggctcaatataaacagtttcaaaaagtcagtaggtcattaaaacaatttcttcagtcattcaaaccattcagataaaaattaacaccatgtaatacaaaaattgaattatagtcacagggacaggatttcagcaatggcaagaaaaagtagtgcaaataggaatgagcaaagaatagacaagtaatgggtgtgaattggcctcggaaataccatggtaatgtcaaaaagataaatcaattgttattttgttaaataagtgaaaggccaggcattctcagtccaggaaagccatcacagggcagtctgagtcttctgcatcttaagaagctcaagaggttcaaacttaataaaccctgcacagttgctcactggttcatgtaaaatgctagagcagttgcttcctcccactcagcaaatccacagcacacagtcaccctggtctggcccttcacagtgtagatgccctcagggctaagaacctgagtggttctaaaagtagtaaagatttgcataaagtaccacacaacacaccctctccacatagggagctcagtaggacataaagagccatcagaatccagccccgactctggagccaggagtcccttctaatatcagcatcatggcctggactcctctccttctccttctccccatgtacctcctcacttgctgcccaggttaatagagatttcaaataccagcctttggagggattcctgtgtctccctttctaattcccaacatgtgtctgttttttgtttcagggtcaaattctcaggctgtgatgactcaggaaccctcactgactgtgtccccaggagggacagtcactctcacctatggctccagcactggagcagtcaatgggggtcattatccttactggttccagcagaagcttggccaagcccccaggacactgatttatcatgcaagcaacaaacactcctggacccctgcccagttctcaggctcagtccttgggagcaaagctgcccagacactcttgggtgtgcagcccgagaggtgaagctgagtactactgcttactgcaccatagtcgtgcttggcacagtgacagactcagaagaggaaccgagacataaacctctctaggcccttgtgatatgaagatcatatgatcacgcacaccagctctcaaggcagcctacatgtggaccagccatagaaaggggaaggaaaggatctgaattgattcctatccctgcttaagccctgaagtgaaggaaatgtgagaatgatctgggaagaactggatcaaaaaaaaaatcagaagtttattgctttgtattctaaaaggagcactaacagctggatcagatctaaaggctgaggctaaatgcatttcctccagaaagaagcatcttcaaagtatggggtttctgagctaagagtaaagagaagaaactctacttttgtatatttctaaagtttgttttattgagttactttcaaagcaatacatgcctattatgtggaatcagaaagtattaaaaatcaccaagttctctgcaaagctaccttatcccagataatcaatagaagtacatttcttcatttggatgcattctctcatttttgttgtcaatattttcacaatggttatcaaaccttgtgctcattcctctggttttatacagctttttgctctgtcatttaatgttaatgtaagtagttttccatttatttgaaagggtaaaatatttgagtagttgctaattttatttttatttgaataccaatgaaaaattataatttggggtaattcaaattgcttgtcagacaaagatgtgacattgggctattattaaaatgctcctggtcttctctgtggatttagtgaagtcaaacaaaatgcctgcaattttctatggaaagccttgagtacattatgcctgacttcacaatgcagaaaatagagaaacaagaatttcctgctcatgtttgctggagcataatagattcaggtacgaggaacaacttatattgaaaactacgtcaatgtctccatgcatgtgttagaacagtacttcccaaactctattgtgcatacaaattatctggggattttataaaatgcagattcttattcagtgggtctggagtgaggacacaatctctgcatttctcacatgtgcctgccacacaaaatccacatatatatttgaataataacaagtccagccagcagtggaggctcatatgtgtaatcttagcactttgggaagctgaggcaaaaagattactcgaagccaggagtttgaaaccagccaagagcaacatagcaagatattttctctatagttttttttaaataataaaaaatgaattagccaggcatagtgctgtatgcttgtagccctaagtactaaggaggctgaggcaggaggagagcttcagcccaggagttcaaacctgcagtgagctatgatcatgccactgcacttgagcctgggtaacagagtgagaccttgtctctaataataataagaaaaacgacaacatatccataagactagtatcaaataaggagaatccttggcaggcaagaacctaggagaaatctctgacatagggaatttaccagcttgcatgatagaagaaccccacactccatggagggagatgaccagggaggacagctgcaaagctaggaaaggctcccctttctttgagagcaaaaacaaaagcaaacaaacaacaaacctgaccttccctctggctcctgtccaacactcttactggctcctccttcagcctttcctataatgtggcccatccttaccctctccccttccacatctctgattcctgaattcccttctttgttctctttccctttgctaccacccacttctcccctctaatctcttgagttaattatcaagggctttataacaggaaactcattggcattttttctgcatctgtccttgaagttgacactcatacttttatctctttcttgaacctctcagatatgcttagaactgaagaagcccgaagttgattgattctgttttttcacctcagccagcaccttcttcttctcctttccaggagaatctgtatttctctgtatttccagaattctctgtatttccagtgaatctgtcagacacagtaagtactcttcaaaggtttaatttctgacttcattgttctttgttctcgagatgaacttccttgtcccttctcctaagctacctgctctgtaaacaacttctcccaccagtcccaatctgtaactcacatctcctccttatttagaaagagtcctcttttactccttgctacccattctgtaaactgcccctcccacaaaactacccttcccacatttgccatgccctgacatgcccaaacataccttgtaccataatggactgcctctcccttcccacctaattagccatactcaattttaaacagtagccaatcaggtcagtttagattgtgtggtccaactccagccaatggggacaggacacagaagcagggactaaccacgttagggatgaaaaccccttccctcctttgtttggtgtgctcttgcagtggtcagaagtgcaagcggcactcttctgtagaaataagtttgccttgctgagaaatattttgtctgagtgctcattttccttgcgactctgagctcttgtttctaacaaaatagggggtcatctgggattcccattctcctctgaggaagggcctctgatcacctcttaggaggagatgcatcccactgcttcattgcagtggcctcaggggtaaggaatcaggacccacccagcatgataaataaacccagactctcagcaacacaggaagaaaaggcctacagttaccgtggcgaccaggtaactgtgcacagacaaaggtaagaaaaaccactagggcagtgaagtacttccttagtggtcaggacattctgcaggttgaaaatgtgtgaatgagatgcacaattaagtgcaaagtgagtgtggagtaaagtaaagggtgcaagaaatctctagtaagagaggttgagccccagggaaatggtgcaagaaatctctagtaggagaggttgagccccacgcacactcagcagggaaaggagagcgagaaacctccagtagcggggattgagcctccagggaaaagggtgcaagaaatctttaatacgagagattgagcccccattaacctccaagacgggagtgcaagaaatctctaatatgagagatatgagcccccattaacttccaggatatgaaataccctagtaaaacaagaactacaaagggcaaaggagataacacaattccctctgatagccttctaggtctcatgttaaaatattggagggataatgaaaggactaaacacaagaaaaagcaacaaatgatcaaatatgggaattgttttatttggaccaaagaacctattctcaaaccttcagttttctggccaaggtttggatcaaatgagagttggatttgtcaacttttaatagagtatgtaaatgacaaaagtcctgcttcccaagaggaaatagactctgctgtgtcttggtggcaggggccggtcctcctctacccccttaaaactagtaaggataagccagaaactaattcccctgtaggaactaaggccccacccctgagcaatccatgtgggatcccttagaccatctgcctccaccagatacccctaacttctctcaagcagccacccagacccttcccctgctcacattatgccctccctccttataatcctgactgttagggctgtccccaacctgaacgccctcctgcaagaaggcttcaacgtgagatagagcaatgtaaaaaggatattcaaaacttccctttcccctcctcctcaaaagagtctgccccaatcgtttttcccttaagggaagtgtttctaggaggagagggagttggctttgtaaatgtccccttaactagttcagaggtcagaaacctgagggaagaacttaaaccactattagattatccttttggggtcgtggatcaaattgaccaatttgtaggatcacaagtatacacttaggctgagctaatgtccatcttaagtgttctctttccgggggaggaaagaaccatgatacagaaggctactatgatagcctgggagtgcaaatatcctcccagtcaaaatacccctgcagcagaacaaaaatttctggcccaaaacccccaatgggataataacaatgcagccaactgagaaaacatgaaagaccttagggaaaaggtagttaaagggattcaggaatcagtgcctcaaacccaaaatatttcctgagcatttaatatacagcagggaaaagaccagggagccatggagtttttaaacagactcaaggaacagatgagaaaataggcaggcttaaacataaaggatccccttaggcagggatgttaaaactccattttgttactaatagttggccagatatcatgaagaaattacagaaaatagagacctggaaatatcggcctatagagggaacaagagggcagggagaggagagagaaagactgacagagggaacggagggagccagggagagagggggggagatacaaaggcagaaagagagagagggagggagagacagagaggcagatagatggagaggcagagagacagtgaggaaaagtcagagacccagacagagagggagagaaagagaggcagagggagagaaagaggacgaaacaaatgtttcaaatgtgaaaaaataggtcacttcaaaagagaatgtcctgaatgggaaaaagaaacaaaagtcatatataaaagcagatcagctaatattaaatttctgttaattccagaggcaggaacatatctattagggagagatttaatgctaaaatttggcttaggcctttatattaatcagggaaaatttctcatctccttaaacctactcaccaccacggatgaagagcgtatccatcctgacacatggtcaaaagaagaaaattgggggaaattacagttcctccaatcaagcccaaattaaaaactcctggggaggtagtaaaaaaccaaaatctttcttttgaaagctgagggaataacctcacagaccaaatagccaaacaagctgccatttcctctgaaacgcccatgtttcacctcaccccttgcctttctcccccaaccgccattgccatcttctcccctgctgaaaaggagaaattaataagaataggaaccaaggaaaactcagaagggaaatgggtgttaccagatcaaagagaaatgctatccaaacctctcatgagggaggttttatctcagctgcatcaaggaacccactggagacctcaagctatgtgtgatgcagttcttagagactatggatgtataggaatttatactctagcaaaacaagctacagatagttgtttaatatgcaaaaaaactaataagcaaaccctaagaaaaccatcctttggaggaagaaacccaggaaattaaggccattccaaagcatccagatagattacaccaaaatggcctcaataggtcacctaaagtatctaccagtaatagtggatcaccttactcgctgggtagaagctattcccttttcaagtgtagccaccagtaatgtagtttagacattaactgaaaatattatacctaggtttggattaatagaaaatattgattcagataatggaaactatttccctgcacatgtcattaaaaagctagcccaagtattacaaataagatgggaataccatatccctggcacccacctttatcagaaagagtagaaagaatgaaccaaatcctaaaaagccacctaatcaaactagttttagagactcgactaccttcctattgcctaattgagggtccgaactgcccctcggaaagatattggcttatctccttaagaaatgctatacgggttgccttatttacactccactgctgacattcctacatttgaaactaaagatcaatttctcaagaactatataattggtctgtcttccactttctcttccctcagaactaaagaccttttagcactgacaccacccttggagctcccagcacatcagcatcagcctgggatcacattctcatcaaaagctggaaagaaggaaaactcgaaccggcttgggaaggacactatctagtgcttctaactacagaaattgctgtccgcacagctgaaaggggatggacaccccacacacaagtgaaaggagtgattttcacagcgagagaaaaatgggccgtcaccccagggcccacccgcaccaaattaaaaagggctgaataatcatttgtttattttcccttttctttccaacagaaagtcacctcatcatcagtgtgcctcaaactaatcgtcccttaaccctccagttcgatgcttgttcagtcacctcatgtagagatgaacgagctcaaaggcagctatcaaatgtagataagtatctgtgtccgtaccgtagtgagtcaaccaagtataagtatagagccttaaaaagtccctgtggtgactggacagatgtttggtggaccacccaatatggagggtggacagccaggccccctttttcaaacaattctgaggactgaaacagaaactccaacttattcgtggtaccaccccaccaaattgtaagtcattgcagtgtaaccccttattgctaattatagataatccccaaacaatgacccaagaaccctccatattcgaatgatatgggttaggagcagatgttacaggacaggaccccataggaatcttctttctgaggttggctagaccatcagttaaaaacaataaagaaatccagacccagagtccagggaacctatgggagccaatgctctccccaaacatatcaggctcagcattctcttctcatctccagaatgacccaactaaggtaatggttgtggaggtaaaagatttaaagcagactacagctctagagacagggtacaaagacgcaaatgcctggctggaatggattaaatctcctgtccacactctaaacaaaagcaattgttacacttgtgcacatggcaggccagaggccctgattgtcccctttccacttggaaggtcctccagccaaccaggcatgaactgtatggtagctgtcttccaacaccccacagcctggggtaatgaattatgctgaactctctctctgctatttcctgaagtccagcaccctgtgggtcagcccctgagggccatccagcttctgtctcctgatgcaagtttcaccccatgtctctcacgacaaggggaaaacttagcatttcttggagacctaaagggatgcagtgagcttaagccattccaagagctgatcaatcagtctgccctgatccatccctgagcagatgtatggtggtattgctgcggaccattactagacacttccaagtaactggagtggcacttgcactctgatctaattggccatccctttcactctgacattttgtcaaccaaaaaggataaagacaaagcatcataaaacaaaagatgctcctcatgggtcctttgactctcatgcttatatagatgtcattggagtccagagaggagtgccagatgaatctaagccccaaaatcagatagttgcagggtttgagtccatactattctggtggttgactgtaaataaaaatgtatattggataaattacatctattacaaccagcaaggatttgttaactatactagagatgctattaaaaggatagctaaacagttaggacccaccagccaaatggtttgggaaaatagaatagcattagacatgatactagcagagaaaggtggagtctgtgttatgagtggaactcaatgttgtacttttatacctagtaatactgctcctgatggaaccataacaaaagcattacaaggtcttactgctttatccaatgaagtagctaaaaattcaggaataaacgatcccttcactaatttaatggagaaatggttcagcaaatggaaaagacttatgtcctcaatctttacttctcttgacattgtaataggtttgcttattcttgtagaatgttgtatcataccctgcacctgaggcctactacaaaggcttattgaaacaactctcactaaaacctttttcaaatccaccgcccccccaccttattcagataagctcctacttttagaaaaccaagcagaacaacagagtcaaggcatgttaaaaaggtttgaagaggaagaattataaaaatcaaaagggggaaactgtcagatacagtaagttcctcttaaaaggcttaatttctgaattccttgttctttcttcctgagatcaacttccttgtcccttctcctaagctacctgctctgtaaacaacttctcccaccagtcccaatctgtaactcacatctcttccttatttggaaagagtcctcttttactcctggctacccattctgtaaactaaccctcccacgaaactacccttcccgcctttgccacaccctgacttgcccaaacgtaccttgtaccataacagacagcctctcccttcccacctaattagccatattcaattttaaatagtagccaatcgggtcagtgtagattgtgcagtacaactccagccaatggggacaggacacagaagcagggactaaccacattagggatgaaaaccccttccctccttcatttggtgtgctctcgcagcagccagaggtgtgagtggcacccttctgcagaagtaaatttgccttgccgagaaatcctgtttgagtgctcattttccttgtgactctgagctcttgtttctaacaaatccagtgaaccacacaaatatactagccaattttctccaatccccaccattctgccttatgtgctgatctagtgaggaatcaaataggaagagagacccatggatttctatgcagcctgggaagtgagttcatggatgcactcagttgtaacaccagacacctgtctgccgtttgctgtttagcattcacagggcccagcagctgtgtcctcccagggtgcctggagcatcactgaccacaccctcctacctcccacccacctactcctcaaaaagaaaaatcagactcggcatcttatgtgaggggcacagccaggggtcaggatagatttccactgagtcccctcccctaagagacaccagggaagaggggttgttccgcctaatctatgtggctcaggaagcagagcactacagacatctctaccatggcctggaccctctcttcctcaccctcctgagtctctgcaaaggtggctgtgacatgactctgatgactggagaaacaccagggtcctttgtctcacactgagaaaattagtgacatggacacacattgagtggttttaaggaacagaaagtttaataggcaagaaagaagaaaacagctcccccatacagagggaggagggatcctaatggaaaatcccacatgcaatggaaaacagctgattatattgggaggctggaggaggcagtgtctgatttgcaaagggcccaggggattggtttgaccaggtgtgacattcatgcagcctgtaaaaaaaactggccctcccaccttagccttttaatatgcaaatgcaggtcaccatgatgtcctgcacatgtggcttttatctggaggctgccatgacacctggcacacgtggtgacaaaaagaggagggcgaaagccaccatattgggtggacctggcttctagccaccagcatttgcatatcagtgcttgccagtctggtttttcaagctgctttctgttagcaaagaaatggtttgggggtcgctttttattaaaggaaaattccaccgagaacttacaccatttctagctgcctaaaaattatttcttaatgactcctgttatttcccccctcaggagaagtaaacctaactgtcgttaggggatgttggacaacaattctttctggctacttccttctggaaaggggcgtcatgtaaggggacagcagttgggcctcctcctgaggttgatctaaggattctctgaagaatggcatgtccatgtgtggctctgtctgcagcattatttggagtttgattgcttctaggtgaaaagagataaatcttacaagaaggtttaaaatatagggttagaatatgagtattaagattaccactgttagtgggggtactatagaccacaactatgacagcagagtttgatacttgttagttacaccagtggattgtaatactgggttgtctccactagatgtcactgaatattaccagaaagattaatatgaaagtgacatttttccttgagaaaaccatacatttccccctttacttgccattagtgaatagttttaggcttagaccatttttataacttgcaatataattgggagaaatacattattgggtggctaaattaactttagtgttaatcttgacaattccttttctttaattattaaattatttcatgactttcacagaccctcttacaacatactcaaactttccgacttgtcctaaacatccttcctttaaataaccagtcatttgcttttaggacaagaatttcccacacaagatcttttcttatataaagttccttcttttataaccttctttctatagcttagagtgcaccatacaaccagtcttcaataaaaagtcctatcaaacttaatgatagtaaaactttcatgctatatccataactattactcctgctataagcaaaacagccttgactaaatctttcctgcaattgttaatcctgttataaggatgataattagacaagatgttacagcaattagaattttacaaccagaattccacattgtgagtgccatagtgtatagttctattgcaaatagtagtgtgactgtaacaattcccacaagactggcatagtaaataatttccattgaaaactttacttgccaagatataacatttccctttgggaatctacaaggttacaaatgcaattctatgaataatcaaaatctccctgcgaatatgcattaaaaagaagttctaatatttggtggcaaatttttagaggaaggggtacaaataataaaaagtggccgggcatggtggctcacacctgcaatcccagcgccttgggaggctgaggtgggcagatcacgaggtcaagagactgagaccatcctggccaacatggtgaaaccccatccctactaaaaatacaaaaaaattttgggaggctgagacaggtggattatgaggtcaggagatcgagaccgcctgtagtcccagctgctcgggaggatgaggcaggaaaatggcatgaacctgggaggcagagcttgcagtgagctgagatcgcgccactgcactccagcctgggcgacagagcaagcctccatctcaaaaaaaaaaaataaaataaatagctgggtgtggtggtgcatgcctgtaatcccagctactagggaggatgaggcagaagaatcacttgaacccgggaggcagaagttgcagtgagctgagatcatgccattgtactccagcctggtgacagagcaagactctgtctcaaaaataataaataaataaaaagcatctggtgaggtaggagtgggactgagtaggatgagtagccctcactcagttacttatcttttatgattttcagcttaagatcttctatttctccactttgatattcaggacgttcctctgggctgtcaggggttgctccctcaggcattcaggctttgacttgagtgtgatgtattcagaagttgacacctgtaacttttgctgccaagggggttgaaagagaacagtgtagggcccttcgcagcttggcttagggaaggagagagaggtgagagttttcactagtaccaaatttcctgggttaaataaaggtggttctatttcctggggctgggcttctgccagttgtgtcaatttctgttggaagtgaggtagagaggttacatgcttaaccaatttataggttttctgcctgaaaacagtctctgagcacattgacaaattttatcctttcctaagtgaaaagcttggtgaaggattttaagaactttccattggctggaggctggcaaatggagtttgccatcctctggctgtagccatcctgagagataaaaagcatacccttgagaagtggcctattctgtttctgcaggaaaatactgaggtttaatttctgttatggagcattcctagattagaagggggcttgaagtgtgttaatgccttgaggcttccttgcctttgacttagctgcctgattaatctatttcctttggctactttatttgctgccttttggtgttcctataatgtatccctgctatttctcacggcataaaaagtgaagataatagcctgctaattttctggtgatattttacaggaaatccattagtggtaagaggatgtctttccttttaaatggcagcatgagtatggagagctaagaaagcatacttggagtccgtgtaaatgttggctacctttcccttgcttaattgaagtgttctcgtaagagctattagttcagctaattaagtgcttgtgtctggggagagatgttgtttagagtgactactgcttatcctgccttatgtatttcttgctttaccggctgttagttaaaagcgccccctaaaggacagtaatcctgccacattacgtggggtgtaaacagttaagttctttcccaggattaatttggaggcttttctaactgtaaagctatcatgacaatggcttggaagcatgtgtaaataggtcctcctaactgcaactaaggttgagaaaaatattgtactagagtttttcctgagatgttccttatggtgatgctatgagaagaggggaggcctggattagagagaagaaaagagagagattggctttagtatttagaaggacatctactttccttcaatttccagaatcacccaggtcctggcaccctgttaaatgtgccacccatgtttgcaagcgtgaccctccaagccatggcaccagaggaactaagcttgtgggcctagtcgtgctaccccaagcagctctagtcctctgcctatgatttccctttgacttcctagacttgtgtgatctgtgtgtctcaccccacccccacccccaaaaaaatagatcttggcagaaactatatggaaggaaaggctcctttaatggagggaatgtgctagattgcctgctattatggcctgtgctaaagcatttacccttagaaaaatggttccagttaacttccagacttaaaatctccttactaattaagtactgttttaatcggagagagaacaggtgtcttaaaggaacgcggggacctaatggcgactttcctgctaatgggacagtatcggggcacaaattcggctgcagaggaattttactcctaatagttaaaagcagaattttcccgttcacaggagcagcataaatcctggtttccagtagaaaggtgcaaaaagaaaaaaattgagaagctgcggtgtaccgcggagatcagcaatgtgtcgcataaagaggattttatttccactaggtggcgctgttggcctagaaataccatgtgctcaccagaggaattttagggagtaacctcactgaggggcaaaggaagacttctgttcctagaagattgcaatggcattttcctgagctatctccccagttactacagcattttctgatcttgcctaccaggattacttccctacgctgtaaaaattcccgcacatttgacacacagagagagtaagagacataacgaccacggataaaaaaggaagaaggttctgcgacaggatagctagggatcctttaccaacatccagagcaggccgttggaggctgggtccagtcccgaaacctttgaataacaccaggctgtgccctggccagaaattctcagttgcttcagaacttttcccagcctcacgcgatggctaagtttccccatgaaaagaaactgatttgaagcatgaccaacattcccaaagacccgtgagtattgcgggttctccgtgttctgaccagcaagcctaacactcaagtctttagaacaacagccatgataagcgtatttagacggccaatggatgcccataattgatttgattttgattttaaaatagagaccaagaacctctgaatgacagaacagactttgagttcactcctctaatcactacgtcgatgaatgttgtaccttggattcccagtgaaggcaccagaaaggatacggctctgatgactggagaaacaccagggtcttttgtctcattctgagaaaattagcaacatggatggacatatgtggagtggttttaaggagtggaaagtttaacaggcaagagagaagaaaaacagctcccccatagagagggagaagggctccgaacggaaaaccctacatgtggtggacagcagctggttatattgggaggctggaggaggcagtgtctgatttgcacagggcccagggaatgagtttgaccaggtgtgtcattcacgcagcctgtaaaaaaactggccctcccaccctagccttttaatatgaaaattcaggttgccatgatgtcctgcacatgtggcttttatgtggaagctgccgtgacacctggcacatgtggtgacaaggagaagagggcgaaagccaccatattgggtggacctggcttctagccaccagcatttgcgtatcaatgcttgccagtctggtttttcaagccgctttctgttagcaaagaaatggtttgggggtcgctttttattaaaagaaaattccaccaagaactttcaccctttcttgctgcctaaaaattatttattaataactcctgtagtagctggagacaaggaggcagggatggcactgggaggaccagggctcttccttgctcccctggcttactgagccacctccctcaccctgtgtctctctcctgactctcagggtcctgggcagtcagaactcacttggtaacctgcacagtctgtctgtggctaaaccagtcaccatctcctgcactggaagcagcagcaataagggtcttgggattgtgtcctggtaccaacaatgaacaggaagtgtccccaaacctctgatccatagaagccaatatacacttttagggatgtaggactgattctcaagctatcagttttccaaaaaggccttcctgagcatctctgggctccaggatgagaacaaggctgatcactaatgttggcattagtgatcatgtttgtgatttgctataaaatcatccagcgatggagtaagatgatgggtaaaaagggttgaaagattaaacaagatgagtcacactgatgatgtcaaagctagctgatgggtgccaaggattcattagacaactctcagcatatttatataactcaaaaatttccataataatcactgcctaaaaaaatccatgtctgtgatgagaggtatatgtcctgcttttaattggtatgtaacctgattttaacaatgtggtatataatctgcttttaacaacgtggacaaaatgtaagcttacattctgacttcaagttgaagcccatcttctcctaacaggcaaaggaggagctggggtggaggctatgaaagggaccggagctcagcgtttcccaggacaaagaagtgagtgaggccggagtcccagcagaaggacgaggggctgtgagatgggctatgggagtgtgcaggggccacaacgtgcaggtcatgctgctggggccacaggattcaggttttatataaacaacaaggagccactgaaggtgtttaagccagggagtgacatgccacatctgaatgagaagcatctctctgaattccttgaggagacagtgtctgaaggaagtgagtgacctgattctagattatttactaaagcaccttgtaagtctagaaatccaggggccatttacaattagcacaagtgtagatgtgggctacattgaagaagtgatggtctcttgtcattcttcacagaactagaaaaaacaatcctaaaattcatatggaaccaaaaaagagcccacatagccaaagcaagactaagcaaaaagaacaaatctggaggcatcacactacctgatttcaaactatactataaggtcatagtcactaaaacagcatgacactggtataaaaataggcacatagaccaatggaagagaacagagaatccagaaataaacccaaatacttacagccaagtgatatccaacaaagcaaacaaaaatatagagtgggaaaatgacaccctattcaacaaatggcgctgggataattggcaagctagatgtaggagaatgaaactggatcctcatctctcaccttatacaaaaatcaactcaagatggatcaaggacttaaatataaaatctgaaactataaaacttatagaaaataacatcagaaaaactcttctagacattggcttaggcaaggatttcatgaccaagaacccaaaagcatatgcaacaaaaacaaagttcaataggtggaacttaattaaactaaagagctaaagaaaaaaaagagcttaattaaactaaagagctaaagaactaaagaaatcaaaataatcacttatagaatgatgaaatcggtgtctgggaatcagaacatggatgtgtgaatacagacagtgactggtgagctgcatggcaaaaggaacatcagcagagtaaacagacaacctacagagtggggaaaattcttcacattctatacatctgacaaaggactgatatatccagaatctacaaagaactcaaacaaactagaaagaaaaaaaaaactcatcaaaaagtgggctaaaggcatgagtagataattctcaaaagatgatatacaaatggccaagaaacatatgaaaaaatgctcaacatcactaatgatcagggaaattcaaatcaaaaccacaatgagataccaccttaccacctgcaagaatggccataattaacatataatagatgatggcatagatgcagtgaaaaaggaacacctctacactgctggtgggaatgtaaactagtacaaccactgtggaaagcagtgtggagatttttttaagatctaaacatagaactaccatttgatccagcaatcccactactgggtatctacccagaggaaaagaagtcattatacaaaaaagatatttgcacacacgtttatagcagcacaattcacaactgcaaaaatgtggaagcaaccaaaatgcccacaactcaatgagtgaataaagaaacaatatatatatgatgatatactactcagccattaaaaggaatgaattaatggcattagtagcaacctggatgggattggagacttattctaaatgaagtaactcaagaatgggaaaacattgcatgttctcactcagaagtgggagctggccaggagtggtggctcaagcctgtaatcccagcactttgggaggccgaggcgggtggatcacaaggtcaggagatcaagaccatcctggctagtgtagtgaaaccctgtctctactaaaaacacaaaaaaattagctggccatggtggtgggtgcctgtagtcccagctactcaggaggctgaggcaggagaatggtgtgaacctgggaggtggagctttcagtgggctgatatcatgccattgcactgcagcctgggtgacagagtgagactccatctaaaaaaaaaaaaagaagtaggagctaagctatgagaatgcaaaggcagaagtgttacgggaagtcagggaccccaaagggagggaccggctgaagccatggcagaagaacataaatcgtgaagatttcatggacattcattagttccccaaattaatacttttataatttcttacgcctgtctttactgcagtctctgaacataaactgtgaagatttcatggacatttatcacttccccaatcaatactcttgtgatttcctatgcctgtctttactttaatctcttaatcccatcatctttgtaagctgaggatgtgtgttgcctcaggaccctgtgatgattgtgttaactgcaaaaattgtttaaacaacactaaatctgggcaccttgaaaaaagaacaggataacagtgatgttcagggacaagggagataaccattaggtctggctgcctgagagccatgtggaacagagccatacttctcttctttcaaaagcaaataggagaaatatcgctgaattatttttctcagcaaggaacagccctgagaaagagaatgtgttcctaggggtaggtctctgaaatgaccgctctaggaatgtctgtcttttacagttgtagataagggatgaaataagccctggtctcctgcagcgctcccaggcttattaggatgaggaaattcccgcctaataaattttggtcagactagttgtcttttctcaaaccctgtctcctgataagatgttatcaatgacaatgcgtgcccgaaacttcattagcaattttaatttcactccggtcctgtgatctcgccctgcctccatttgccttgtaatattttattaccttgcgaagcatgtgacctctgtgacccacaccctattcatacactccctcccctttgaaaatcactaataaaaacttgctggttttgcagcttggggggcatcatggaacctgccgacatgtgatgtctcccccagacacccaactttaaaatttctctccttccctttatttctcagaccggccaacacttagggaaaatagaaaagaacccacactgaattatcgggggcgggttcccctgataagaagaatgacacaatggactttggggactcaggaggaaagggtgggaaggagggaaagtggtaaaaactataaattgggtacaatgtatactgctcgggtgatgggttcagcaaaagctcacaaatcaccactaaagaacatactcatgtaaccaaatatcacctgttgatattactcctatcaacattactcctacctgtgtctgtgtatctttgtcatgtgacttatcccccttgactttgtgcttggccctgttctcactttgagtaatggaacatttgtggaccttatgcaagctcaagtttaaatgtccttgcaccacttggtttgccctcttttgcaactctcattactaagatcttgtcctggatagtttttggcccttcaggctgggtttccaaataaacacgtgtgagtaataaatgctgatatttgtgactgttacatagcaatatatgaatgatacatctaacataaagcagacactggatattggtgtggtgagtgaaaacactcaggcttgtatgtatgtagattcctctcccacagagggcagtcatcaatattaccaactcaactaagaggatgattcttatttggtgcagtttctctaattccaagagcagtggagaagtctaataccagggcagtgagcacgaccatctgaacaactcttccttttatgctggccctgacgcatcctaacaggccaagaaacttggaagtgcctccctggaggcagctgggagagtgatgacagatcgggctacgtgggtgatttatttatattcttctattgtctaagatggatatgtttatttaaaattggaaataactgctataattaaagcattgaataaaactaaaattaagaattaaaaatttatatattctccaacatcctatcagtcaaagaaaattacaggtgggtattaaattgtcagataaaagaagaactttcagagcaaaggaaagaaatgaatatttataatctccaagcattgcatgtatattttctctaattctaccatttggctacattttaaggtgccctaaaatttgctttttttttttaaattttctttcgctttccaattctatctcattatcacccatgaagtcccatctttatttttttaacaacaaaatattaggagaaaattaatcatcatttaatccatttatttttatttatttatttttgagatggggtcttgctctgtcatccaggctggagtgcaatggcacaatcacggctcactgcagcctctgcctctggagctcaagtgatcctcccacctcagccttccaggtagctgggactataggtgtgcgccaccacacctggctgagtttttaaaatttgtatagagatggggtctcactgtgttgctgaggccggtctcaaactcctaggctcaagcaatcctcccacctgaacctcctaatgtgctgggattataggtgggagcaataatcatttaatctaaaattctctcagatgagtaggtatgggaaaatttttaaaaaaataataatattaaaataataatataatctaaaacctttttttcacaaatatatctcaggcccaaattttcatccgtccatccatacattcatcaattcattcactcaaccatcaaacatttatttatttatttttttgagacagagtctccctccattgcccaggctggagtgcattggctcgatctccactcactgtagcctccgcctcccaggttcaagtgattctcctgcctcagcctcccaagtaactgggactacaggtgcaagctaccacacttggctaattttttgtatttttagtagagatggggtttcaccatgttagccaggatggtgtcgatctcctgacctcgtgatctgcccacctctgcctcccaaagcgctgggattacaggcatgagccaccacacccagcccatgaaacatttattaagggcccattctgggtgacatattatgttaggttggactgtgagggtataaatacaggacaaatgagaagggttccttctgtcaaggagaacacactcgaagatactagaaataaaatagaaacttctacgctaattactaatacagagaattaccagatttttgaaagctcaactaataaagcaaccacccttttctggatatatcaagaaagtgtctgccttggatgtgggatcttagaaaaagaagagtaagtatggaggaaatgaggtcatctccaacagagggactgtgtgatagtatggactgcatatttctgtctcccccaaaattcttagattgaaaccctaaccccccatgtgatagtatttggaggtagagcctttgtgaaataattaggtttagaagaggacatgagagtggagccctcatgataggattagtgtccttaaaagaagaaaaagagactagatctttctgccatgccaggctacagagaaaggtgccatctacaaaccagaaagtggaccctcgccaagaaccaaatctgcaggcaccttgatcttagacttcccagcctccagagctatgagaaataaaggtttgttgtttaagccatccagtctttgctattttttttatggcagcctgaactaagacagcctggcaaacacaggaaaggaagctataaaagggcacaatgggctgggtgcagtggctcacgaatgtaatctcagcactttaggaggccgaggcaggtagatcacttgaggccaaggagttcgaaaccagcctggccaacatggtgaaactccatctctacagaaaatacaaaaattagccaggtgtggtggtgggagcctataatcccagctactcaggaggctgaggcagaagaatcactttagcccaggaggtggaggttgcagtgagccgagattgctccactgcacaccagcctgggcgacagattgagactccgtctccaaaaataaaaggcaccaatgactgtgtgttgagtgaccaattgtgttgagccatagaggaaagatgtaggcaccagtgacttgtccaggatcagggatgacacacttctttttcttgatagctattctgtcctctcccagacattttttttttttttttaacactgctgtcgcccaggcaggagtgcagacatggctcattgcagcctgaacctcctgggctcaaatctcccacctcaggctcccaagtagctgggaccacaggcatgtgccactatgcttggctattttttttttttatgtttcgtatagatagggtctcgctatgttacccaggctggtcctgaactcctggcctcaaatgatcctcctgccttggcctcccaaagtgctgagattgcaggcatgagccgcctcacctggcccctctcccaaactttcttttgaggttaaataatgtaaaaaggaagagtgtgtagaacaaaagtaatagctaatgtaaaaaaaaaagtttaaaacaaaaattatccatatctcactacttagagataaccattatatatattttgacaacaaatacccttctggatttctgcatttgctctgtcagatgttagttgaggtgggacagggaaaggggttaagggaggaggcaaggaaagaagggtcagaatgcaatttatcttacgaggcgttttcccatttagtaatacataatcaacatctctgcatgttttcaagtatataaagctccttagatcattacttattcatagtattacagggattctatgttttctctattataaactacatgttgttgaacttctttcaaactacatctattcatacagcaagtcatttactttgtaaaaattcctaaacttaaatatctggttcaacacaagtatgcaaaattttgtacagattttatttaccatagaactatggctacaaattaaatgaaaataatagtaataaattataataatataggagtcacctcacagatgtttccagtcacaaagtaaggcttttcctgctttgtacttaagttgaaatccccccaaagtgcataaaggcggatacatcctttctagggtacccttttcaccctgtagatgaaccctgacgtggccaactgatctaccgacagtagtacactctagatgtcttttattaaaataatagataatagagtaatccacaaactaggaccttacacacatacgcacagagcaaaagctcctgaggtgcagagcctacaggaaacctcatcaaaagctctgatggctcctgtcgatgagcacctttaggaggggctgctgttgtcttaagtcagaacagagatagtttgtgcctctccattttgaaatgctccagatttcccttccctgtcttggtctctcagagcctaatgtctgtgctggactagcatagtcagtctttggttatgtgtctgtattttctatttaaagtagtctaggctgggtgcagtggctcacacctgtaatcccagcactttgggaggccgaagtgggtggatcacaaagtcaggagttacagaccaccctgaccaacatggtgaaaccccatctctactaaagatacaaaaaattagttgggcgtggtggcgaatgcctgtaatcccagctactcaggaggccgaggcaggagaatcgcttgaacccgggaggtagaggttgcagtgagctgagatcacaccattgcactccagcctgggaaacagggcgagactccatctcaaaaaaaaaagaaaaaaaaaacattagtcggggtggcggcgggcgcctgtaatcccagctactcagaaggctgaggctggagaatcactgaacccaggaggcagaggttgcagtgagctgagattgcaccactgcactccaacctgggcaacagagggagactccgtctaaaaaactaaaataaaataagatactctaaagtaaattatttaaataattctcatcttaagcaagcagtttattcagcatgaggttcaaagtaaataacttcaaatcagatggtcatgaatataacttctttagtcattcaaaacactcagataaacaagacggataacactgaaatgaaatacagacaatgcagtggattttcaacaataactacaaaaaggactgaacaaagagacaaacaatgaatgtgggcttgcctaggaaatacagtagaaatgtcaaaaaaagttaaatgaatgagaggggtactacaatcctccaccccaggaaaccacagcaaggtgccgtggatcctctctgaagcctgacgttcaggttgttcatattttaggtaccctggacacttgctcataggccctgcaagaggttacagcagctgttccctcccacagggcaaagccagatctcacagccacctaggcctccccatgacagggagttgctccctgggacaaagaccagaataggaggaggagggagagataaaaggctcagatttgcataatgtgtcccacaaatacctaacctttatgcaagaggtgaggagggcataaaagagccattagagagtccaacactagctgtgaggccagtgggcccttggaacttcagcaccgtggtctagactcctctcctcctcctcactcagtcactgcccaggttcacagagatttcagatcagcctttagaatgattcttctgccttcttttgggagaaagtgggtctaggaaaaatagaatgcaaatatttttccaatccatagggaacaataagaggtatactagatgaagagtttatggtcaaatattttttcaaaaaaaaaatctctctatgatgtaattctgactgataatagcaaagaaaacaagctccttattttatataaaaaatttttctttttttttttttttttgagatggagtcttgctctgtcacctaggctggagtgcaatggcacgatcttggctcactgcaacctccacctcctgggttcaagtgattctcctgcctcaacctcctagggattacaacctcctagtagctgggattacaggcagccgccacaacgcccggctaatttttgtatttttagtagagacagggtttcaccatgttggtcaggctggtctcaaactcctgacctcgtgatccgcccgcctcggcctcccaaagtgctgggattacaggcatgagccaacgcgcctggcctaaaaaatttttcaaaacaatgcaagtttactacataaaatctggctttttttttttttttttttttttttaatgatgtggtcctgctctgtcattcaggctggagtgcagtggcacaatcactgcttattgcaggcttgacctcccaggttcaagctatcctcccctacctcaatctcccaagtggctgggaacataggtgtgtaccaccacacttggctaatttatttattttctgtacagcctggatccccctgtgttgcccaggctggtcttgaacttctgggctcaagctatccttcctcctcagcctcctaaaattccggaattacaggcgtgagccaccatgcccgacctagaagtatttgtttcaaggagcatatttaactacgccgtaaagaccaaatagttcagaagttagatgttacaattttagtctcttctcctacttcttcttttttttttttttttttttttttgagacagagtctcactctgtcacccaggctggagtgcagtggtgcaatcttggctcactgcaatctctgcctcctgggggggtcaagcaattctcctgcctcagcctcccgagcagctgggagtacgggcatctgccaccacgccggctaatttttgtatttttagtagagacggtgtttctccacgttggccaggctggtctggaactcctgagctcaagtgatttgccccgcctcggcctcccaaagtgctgggattacaggtgtgaaccgccgcgcctggctgttctttcacatattttctccatagttcagatcacaatgtatacaaatttttttcctgctagttttctttcacattactgcaatctatctcttttaaaaaaagtatatagtgcagctatttcagccaggcacggtggttcatgcctgtaatcccagcactttgggaggcagaggcggctgaccacttggggccaatgagtttgagaccagcctgggcaatgtggtgaaaccccatctctactaaaattacaaaaaaataattagccgggcgtgggggcccgcggctgtaatcccagctcctcaggaggctgaggcaggagaatctcttgaccgcaggaggcggaggttgccgtgagccgaaatagtgccactgcactccagcctgggcgacagagtgagtgaggctccgcctcaaaaaaaaaccaaaccaaaacaacaataacgaaaaacaacaaaaaaagtagattgtgcagctatgaaatgaaaagtacaaaactgttcagtttccaggcatttaaaattatttctggccaggcctggtggctcatgcctgtaatcccagcactttgggaggccgaggtgggcacatcacctgagatcaggagtttgagactagcctgaccaacatggagataccctgtctctaactaaaaaaaaaaaaaaaaattatttctactttacatttacattagtacaaccaaagtattgatgaattatcttacatactcaattttggatatatacataaacattcattctgtaaatttttattggatatgttaaaagcatcccatgaggccagcagtggctcacgcctgtaatcccagcattttgggaggccaaggcaggtggatcacctgaagtcaggagtttgagaccagcccggcctacatggtgaaaccctgtctctactaaaaatacaaaaaattagccgggcatggtggcaggtgcctgtagtcccagctacttgggaggctgaggcaggagaactgcttgacccctggaggcagaggttgcagtgagccgagattgcgccattgaactccagcctgggcagcagagtgagactttgtctcaaaaaaaaaaaaaaaaaaagcatcctatgaaaaaaatgaaattattacctttttattcatatattgaaataacttccaaaaaggcttatgccaattgaaactccttttaatacatcctcactgacagtaaacattacaatttatataatattcatcagtacgctaccattgctttaattcccatttttgtttttgctatggagactaaatattttgcatttatttaccaatcagctatatttattctttgtgaaatggacagggatttttttctttacaacaattttataatagtgcattagagatttgtcttagtaatctttttttttttgagatggagtctggccctgtcacccaggctggagtgcaatggtgcgatctcagctcactgcaacctccacctgctgggttcaaataattctcctgcctcagcctcccaagtagctgggattacaggcgcccaccaccatcatgcccagctaatttttgtatttttagtagagatggggtttcaccacattggccaggctggtctcgaactcctgaccttgtgatctgcccaccttggcctcccaaagtgttggaattacaggcgtgagccaacacacccggcccccgatttttcttagtaatctttggaaacacttcagaaatatttttaattagccctttcataatctcaggctataattttcctgtttatatgccataaaatgtgaacatgttacaccgtcaaataaaaaaagcaaggtgcagaagactgtgcataatataaatcagttatttaaaaaaaagaaaagaaaaaataagaaactatctgaaaggctaaaaaaagaatctgagttgttactttttcgatgtttgaagaatgtgaatatattatatactcaacattttaaaataaatgaactttaaaaagaatcctctcaaaatggtgtcagccacaatggcacaccagagagtgggaaggcaacacaatgaccattaactcagttttagctgccttccttgtatcataaaaacttctaatgttccattttccctgtggtaacttccaagatggcctccagtgattccccaccctctggtattcctatctgtatatggtccattcccacatagcatcagggttgctctgggtgaccaagagtatacaacagagtgaagttattttacctccaaggctattataaaaaacattgcaatgccttccttgttctcttttggatcactcattctgtaggaagccagctgacatgtcatgaggaccatatgacaaggaacagagggaggcctcctgccaatacccaagtgagtttgaaagccctagtcaagcctttcacatgatatggccccagtcaacatcttaactgcaacctcatgaaagaagctgagacagcaccactcagttaagtgaccccaaattcctgaccctcggaaaccatgagataacaaatagtggtggttttagttgataagtttgcagtaatatattatacagcaataggtaactaatacagattttagtacctggaagggaggtgctggtgtaatacctaaaatgtaggagtggctttgaaactgggcagtgggcagaagctaaaaaatcttcaaggagattgtcagtgcaagccttagtagaaaactggactctgagaaggctctggtgtagcttaaaatgaagtgaggaacatgttattagaaaattgagcaaggggttacgtagttacgtagtggcagaaagtttagtgactatcacctagtcaggtgaaagtagaaaatgtacctgagtcatctaattgagatttccagccagaatgctgaaagtgctgattggtttcttcttgctacttatagtaaaatctgaggggacagaaacaagctaagggaagaagtgttaaacaaaaaagagccaagagccaatacctgctggttttgaaaattcccagtctttccagatggcaaaagatgctaaaattaactgctcccaagcaaaggttatatccagggcactaaagaaaggtgcagaaatatgaaagatgagggtaaaaatcctttttactttttctttgagacagagtttcacccaggctggagtgtaacggcttgatctcagctcacggcaacctctgcctcccaggttcaagtgattctcctgcctcggcctcccgagtagctggagttacaggtgcaggccaccatgcccagcaaatttttttttttttttttttttttttttagtagagacggggtttcaccatgttggccaggctggtcttgaactcctgacctcaggtgatccaccagccttggattacaagtgtgagccactgcacccagtcagagggtaaaatcctttaaggctctgaaagatcaaaaatgatgcttcagagtacagtagtcccctttatctgtggttttactttccatggtttcagttacccacagtcaattgtggtccaaaaatattaaacggaaaattccagaaataaacaattcataggttttagtttatttatttatttatttaatgacagggtcttgctctgtccttcaggctggagtgcagtggcgtgatctcggttcactgcaacctctgctcctcggcctcaagcaatcctcctacctcagtgtattgagtagctgggattacaagtgcccaccaccacacccaactaacttttgtatttaagtagagatggggtttcactatgttggccaggctgttctcaaactcctgacctcaaatgatctatctgcctcagcctcccaaagtgctgggattagaggcgtgagccaccacactcagccaacaattcttaggttttaaattgcatgccattctggttagtgtgatgaaatctagtgcagtggctctgagttccattcaggacataaatcatcccattgaccagcatctctatgctgtgtatgctatgctcttgtggtgttataatatacattggttttgtccacagttcataactcccacagcccttgttacagtcttttgttataatgttcggtgttaggcctcagaggtaggcttctgaccttctgccatccttttacctgccccaaggcaggactctaatctttctgattgtgggttctaagaccctcccaagagagaatcctgccctatactctagcgggagagaatgcttaagtcatgaagcttccataaaaacccaagaagactgggttcagggagcttccagttagctgaacaacacttggaggttcttggaggttggcgcactcagggaagccatggaagctccatacctctttccacacaccttgccctgtgtgtctcttcatctgtatcttttgtaatatcctttataataaacctgtaaacgtgtttcctcaagttctgtgagctattgtggcaaattaatgaaatccaaagagggggttgtgagaaccccaacttgaagtcagtcagtcagaagttcagtatacccagacttgggagtggtgtctgggggtatggggggaagtctggaggaccgagaccctaacctgtaggatctgacactaaactgttccaggattcctgacactcagagactatgtgagttaatgtttaagctgttagttttgtggtaacctgttatgcagcaacagataacacattcccttccctgtttgcaaagcacacaatcccacccatcaaaaaacatggaaaaatggtactaaggtttcgatgtgtatgtttatacacacccatgcacacatccctcagacagcttttctgtcatttctgacattgtgcctctttctactgttttggattctatcaatccctggataggatcaaggaataaccccatcccattcacatccaaagttctaagccattagcccacatacatgaatacaggggaagatacaaatgagtctaagttataactagagcaggggtcagcaaacttttttctataaagtgtcaggtagtaaatattttaggctttgctgggtgtatatgggtctctggctctaacaatgttttgaaaatttaaacttagcctaaaagccacagtttgccaatgcttgccctaaagctaagaaagacttgtgtcttagtggcagtcttgccacacattgataattgttctaatttcaatctcataaccgggaaggaaagagtctaaaagggctaaccactgaaatggaatttactttatttatatgatgaatgcttttaaaagacaaaataactcacttatataacatttgtctgtttttttgagagagtctcgctccattgcccaggttggagcgcagcagggtgatctcggctaagcctccaccttccacctcctgggttcaagcgattctcctgcctcagcctcccgagtagctgggattacaggcacacaccaccatgcccagccagtttttctatttttagtagagacggggtttcaccatgttggccaggctggtctggaactcctggcctcaagtgatccgcctgctttggcctcccaaagtgttgagattacagttgtgagccaccataccagcatttgaaagaataaaaatcactatgggattaagtaaactcaattgtatttagaatttatcattcttttccatagatgttatcatgaataattacaattgcaaagtacatataactttgtatgttcctttcttattttgcattatagccaaataaaattgtgtactgcaatagctcctataatcactacttttgataactgaatactgtttgtagtaggtatatatttaataatttgactttcagtttggtttccaagttttgggttttttgtttgtttttgaggcagcatctcttgtcacctagtggtacaatcataactcactgcagacctcctggactcaagccctcccgccccatcctctcaagtagctggtcagactacaggtgtgcaccaccacgtcttaattttttttttttgagacgcagtttcactcgtttcccagactggatggagtgcaatggtgcaatctcagctcactgcaacctccacctcccaggttcaagtgattctcctgcctcagcctccccagtagctgggattacaggtgcccgccactacgcctggctaatttttgtatttttagtagagacgggttttcaccatcttggccaggctcgaactcttgaccacatatgatccacccacctctgcctcccaaagtgctgggattacaaacatgagccaccacgcccagctggtttgaatcctttgttaaagaaaattaaaaaataggttaggcatagtggcacacacttgcaatcccaacactttgggaggccagggcaggaggactgtttaagcccaggagttcgagaccagcctgggcaacatagcagaaccctgtctctaccaaaaaaaaaaaaaaaaaaaaaaaaaaaacctcacaaaaaacaatgctaaagaaagcgaatgagatataatgaataaaaacaaaaatagagaaaacaaaactaaagcaaatggggggttgcttcttggaaaaagtaaatcagaaacattgataaaaccaggacgaattaatgacaggaagaggaaatacactttaatattagaaatgagaaaggaagtgggattccgagtagttaaaaccatatcctatcccaaacagaactacttttgcttcaggaaaggaaggtttctaacaagaaagctgtaagtgcaaccaagtaaaaacttgggttagtaaagaaaatgattgtcttaatagatgttgtaaattataaaactaaataattctctttaaagattctaaaaaatagaaatagaaactttttttttttgagatagagcttcgcttgtttcccaggctggatgcaacctccgcctcccaggtacaagcgattcttctgtctcagcctcccaagtagctcggataacaggcatgcgccaccatgcctggctaacttttttgtatttagtagagagggggtttcaccgtgttaggctggtcacaaactcctgacctcaggtgatccacccgctttggcctcccaaagtgcagagattacaagcatgcgccaccacacctggccccaaaaatggaaatagaaattatttaagcaatatacttattacctttaagggcaaatcatttcttattaaagccaagaacaaagaagcccattaactccatcttaaatattgtttagaagttctggctgtagtgccgggcacggtggctcacgcctgtaatcccagcactttgggaggccgaggcaggtggatcatgaggtcaggagatcgagaccatcctggctaacatggtgaaaccccgtctcttctaaaaaaatataaaaaattagccgggcgtggtggcgggcgcctgtagtcccggctacttgggaggctgaggcaggagaatggcgtgaacccgggaggcagagtttgcagtgagccgagatcaggggccactgcactccagcctagctgacagagcgagactctgtctcaaaaaaaaaaaaagttctggtggtagcaataaggctaaaaatgaacacaagtggcaaaaaggcaaagattatacagtggtactaaataaaaattaaaaactaaaaataggccaggcatggtggctcactcctgtaatcccggcactttgggagaccaacgtgggcggatcacttgaggctaggagttcaagaccagcctggccaacacgatgaaacctcgtctctacgaaaagtacaaaaattagctgggcatggtggcacacgcccatagtaccagctgctaggaagaatcacttgaactcagggggtggacattgcagtgacctgggatcgcgccactatactccagcctgggtcacagagcgagactctgtctcaaaaaacaaaacaaacgtcccattttacttatggtggaaagacaatacagcaacaatacagcaacagcatttttttcacaaaacattttattactataattgatattttacttataatttttggcaacattaataaaataataaatttcacctgaaagaacaagcgagcaaaatagacaaggaaattcacaaagggcaataacaaaatagtaatcttgacatattcaatatatttgtaaacaaaacaaagtgacattgccttaaaaatatatagaggtatcaatagaaaaacagagaaagctcctgaaagaactcactatattaattttcatttggttgcaggcacagaaattgactcaagctagctcaattctaagacagaagcaaagcccttgatgctgatcgctttccagctttttcatgaaaacctaggaaatttaaatactttgaagaggaagaaaagagtggggagagagtaaagtgcctttaagaggaaaagtagaagtttttttttttttttaaagggagatctcattgtcagtggcattttaagagccttgaagctcaatgaaccaaaggaagtgtcaaacaattaagtgaggtagcaagccatgcaggcctaggggaagggcattctaagaaagacaacagcatgtgcaaagtctttggattgggaagaatgtgatttgcttaaggaatagcaaggccagtgtgtcaaaatagtgcgtcattggggaaaacagtggagaagcatgacagagaatgaaaaagagaggaaggaggtaggcaggggccagatcactggaatctacagttggcaattaatgaccatatgtactccttaagagcatgctttaatgaaactgcaaacaacagtgttgataataccaaccaatcactcaacatacaactaaaacacttcatatttttaccacagaaacagaatacgggaggtaagtatgaaaagtctgtagatctatttatacacagtgggagtatctacctgagacaagaaaaactggcacacacacacccacttgcacacacataccctttcttcaactaaagaaaggattcaggctgtaattttagcaaagtgtcttaacccaagcaacgtaactgaaaagacctagtatagtgttcaaggtgcaaatcaatcaaatgagtgtccggcaaataaatacaacagaatctatggatctagagtcagaaaattttctaaaatgtagataatatactcacaacttctttgttatctgtactgccttctactctaagagggatgctaagctcttaattatctcttcccggatttttgtgaaagcttaggaaatttaactagattgaggagggaagaaaggagtggggagagataaggtacctttaaaaagaaatcaaggaaaaagggagagatttctccagacctatgtctacagccaagatggcggattccttgactggtgaagacaggctgctgggcaccttggtcaggggtggaggaacaaaggatggcaccagaacacaagcagggagacaactccgggagtccacagaggcagccaagactgctgatgttcaggaaccaatactcaaaaggtactccagaatactgtgaaacagcccctggggagagcaagggaaaaagattcacccatagtacagattagataggatagatcagatgaaggacattaactctaagtcttaaaacttattgaattagagagacatttcttgcacactggtgtgtgtcaggtaagacccaaacagcattagtgtcaaaaaactgggaaactatacatttaacagaatagctgcaagctgtaatacattcatgtccaaagcaagacataaagttgcaagcttcacatgttcaattagggtaagatatatatgcacagaaaaatataaagccattatgggtttaaattcagtcagtcaccctgggctatttttgtccactgtacctactgttgttgggacagtcctcattccagcttaacagtgggaaaactaaatttagcccagtccaggaactggacagacaccacttgtttggcccttttcagttaaaactatgggtccagtacagttcaaattatagatattagggcttcttccccttgggaaacttgctttacagctgtggctgagaatatggccagttcattctccactaacggctagccagaagggagaggagagggaatgaatcaaattcacctttagatcacagaacaggaagtcagctagtaccaggcaccattctattaattttattgctatttcacctcaaaccaatgatacatgacggctgtttgatgtctgcaggggcccttcaccaaacaaaaccattttactttgaatggtttggcttccttggatgttttcaggtaggtaaagatactctgaagcagtgttccttttgacctggccccaagactagaatgaatgtgtgcctatccttcaactagaacaaagaaccactgctctccctcaactaacctccgccttcttggtctctgctcacgcagcagcttctctttcaattccacatcctggcttttcagaatcttttcaggttattttatgccagcacagcagaggcacttctgggaattcggcagcaagtgggccagggcataacaaagccattccagtctgactagagttaaccatgaaatgctgaatgcatggaaaaagctgtaaagaaaactaagtatttcaaaaattctatgaattctgtatatagaaaaaagagctttcaagcttaggagtaacatgaaataccaaaacaataaataggtgccaggggcagtgactcacacaacccagcacttggggaggctgaggcaggaggctcccctaaggtcaggagttcgagaccaccctgggcgacataacaagattccatcgctacaaaaaattaaaataaaaaactagctgggtgtggtggctgcgcctgtagtcctagctactctccaaaggctgaggcggaggaatgcttgagcctggaagttcaaggttgcagtgagctaggatcacgccactgcactccagcctgggtaacagtgagaccctgtctctaaagtaaaaaaaaaaaaaattaaaattaaaaaaataaattaatacctttctctctcacacacacacacacaaacaccttttatgtgttaagccagatacagttaacatgaaaaccagatgttttaaaataatacctcaaaattcagatcaaataatatatatcctgaatcttgtttaaaaagtcatatataatccactagtttcactatttttggtgctactgaataatgtatggtttgtattttttgttttatgaggttttttaatttggtttgaaatacttgctttagatttactgaaactagaattaatgggacttttttgaaattttgcttttagacctggggagtgatggttcagagtcagatgtgctcacagttatggatgctacatccactgatcctggctgaagaggttccagtgacacttgaatagtaacttttgtttcaggaggtaatccttctagttgcttaggcttcttaaacatttgatgacactgggtcttgtgctccattttctccttgaaagttaaaaactgtagccggcacttggaacactggtgtgcactctttccccagtggcccctataatgacacatgtatggtgttgctgttttgaaaattttgagacaaaagggacaaagcaaattctttgtgttttcatggcacgttctaaaatgtgtttctacatcagcaaagaccgacgatctataatggcaaacctggcacacatagggcatttcgccaggcttatgatggtccttcatgtgttgtaagaggacctgatctgtttcaaatgacaattcacagattttacagacagtagagggctcctgggcagtgtggacattttcgatgtgacactgtagctggaagggagtgggaaactgccggtggcagtgctggcaggtggtgtggttttcccagctgtcgttcctctgcttctcaaattccaaatgatgcttcacgtgattcataaacttaacattttttagaactttcacgcagctgaggcatttaaaggtggtgtgagtcttctgttccggctgcccttctcctttatgctgtccatagtaaaagtcactaagtaacacaatgggattttctttcttgggatcaaaggtcttgttttgacttgttagactcaaaatgtctgtttttgccaattcattttccctatcaagatttgtatttataggcttgaaatggatattgtcctttggaaaagctgctggaaaaggtgctccattctgaacatggcttaatgaggtatgaacattatttgagggtgtactttgctgagtattcattgtatgaaaggtatctgaagggaacgaagctgaagaatttccttctataattccatccctgagtttagcccttttgggatttatgctgtttacttcgaaagtggaaagttgctttgatacacgaggactttcatttatacctcctactgaaagtgctgtacttactggatgatgcaatgaatctgtgaatgtaatcaaaggagaaggtaattctgaagagttattaggcacaacttgtggtgaactatttctataatcaggtttagacaaaggctcaataataataggactatctgttgatctcgattcaagttgggaagctggcaggacggtcactgcttctgatgtaacggtctcatgacttttaggctgcaatttgcgagcagtatcttttctaaggtgatcatacttttttctccttgaccatgaacccggggtgactctgttcaaaatgtttgaaacgactggttttgaatttgaagtcaccccaacaaagattagctcagcatcttcatttacatgttccacaccaacaaagatgagctcagcatcttcgtcatctacttgtttggtttcttgtatgttcttctgtggttcaggctctttctcttcctcacatgattgttccattttctaatttttttattcctgaatggtggggccacaagtcccaatgcttcctttatataaactgccacctaagtacaaacatacatcagtaagtacaggaaaatgcattaccttatttaattttcctccaaaacattgtttttataaaccactattttacccacaaggacactgagactgaaagaggataaataacagcttaaaacctgtgataaaagatcaggttcctatgaatctagaatcataactttgctgtactgattgtgctctattccattttaaaaaaaaaacctaccagcagctaatcactaggcaaaattatatggaaaagacacacatttttatgagggcatcattgtgcagtgtttagaaacatgggctttggagttgaagagtaagctggaatccttagtctgccacacaccagatgcttcctctttagcaagttttttacttttaaatgtattttgctatcttaaaggcaaaaattcttatttcttagacttacagtaatagctggttttttaaaagcaccacctattcaatggcagcttgatttgtagtggaattggaagaaaattacaataaatgaaaatatctcaattgattcatatatagtaatctcataaacattaatatagaaaagaggtattaaatttatagagttagagtacctacacataaccaacaaacagcatagcacaatgtcaattgccaggcagataatctcatcccaactcatggccttaattataatccattcagtaatgcctcctaaattttcccctccagttctgacttacccactgaacttaaacacaacagtgcttcctcctcaatctcttctccacatagcaagcagattgattgtgttaaacaaagtcagactgtatcattgttcagctcaaaaccctccaacggctttctgattaactgagagtaaaagaccaagtattaccaatgcctagaagactacactaccaaccccacatactgctcctgcagttatctcatactactctccactatccacttcactgtagtcacactaacctccttgctatttattttaattttttaaattaaattttatttttttgagatggagtcccgctctatcacccaggtatatatttcagctcactgcaacctccaccttccaggttcaagtgattcttgtgcctcagcctcctgagaagctgggactacaggcatgcaccaccacacccagctaatttttgtattttcagtagagatcgggtttcaccatgttgaccaggctggtcttgaattccttatctcaggtgatccacgtgccttggcctcccaaagtgctaggattacaggggtgaggaactgcacctggccctccctgctatttcttgaacatactaagctcttttccttgctcaaagcccttgttccttccaatatgaatgatcatttgggtatccgcatggctagctcctcactgcccttagggctctattccaagtatccctctcggtgaggttcttaaatattccaaccaacctctaacccacattcctaatctcttttcccttttctttcatccccaaagccctatcaccatttaacatattacgatcctatttatcttgattattttctattgtccatccagtggaacataaaactcaaaagggcaggtattctatcttttgttgactgttgtatgcccagcacaaagaacagtgtctggcacaggacaggtgctcaacaaatacagaatttgttaaatgaatcaataaatatcgactctccttcataagatcctttatttttaaagaagattatgctccattaattccacattttctatgaatttactctgagaactttatccattggaaattccgtaggccaataaaggacttaaagctagctttttacaaatatttgaccacaaccaatagtttaaaaaaaaaaaagtgatatggagtccaattacacaagcacatacacataaataataactacctttactacacaggctgcattctaaaattttctatttcatttttcttgtctttttcttttttttttttttttgagacggagtctagctctgtcgcccaggctggaatacagtggcgcaatctcagctcacggcaacctctgcctcccgggttcaagcaagtctcctgactcagcctccagggtagctgggattacaggcacatgccaccacacccagctaatttttgtattttttagtagagacggagtttcactgtgttggccaggctggtcttgaactcctgaccttgtgattcaccagcctcggcctcccaaagtgctgggattacaagcatgagccatggattacaagcctgagctgtgcccagcctcatttttcttaaactaaccacagacccacaaaatcagttaagcctcatcactaggtcactactagttgtttcaaaaactggtctaatgctagcaaaatgtacgcactagaaaccaaggttcataactcaccaatttctaaaaacatatcaagattcactgtatccccatgtggacccttcaaatcagcataatccaaagcataaaaattaaattgacatctaataaatgccatgcacatttgttttaattttaattaggatatcagtatctaattttggaacatatagacaatatttattcctataaatatgtgtatcaccttggaagtgaatttaaaaaggaatacaatattaagtaagcattgtcaactatatacaaactggtgtatcatgaatagtgatttacaacttaattagtagatatataatgccagaaaaaatataaggcagatatgaatacactgctctctggagtcaactaaaattggtttagtctgtctatatacaacttcaatcgcctaactccaggatgatgtcacctagcccagtgtttcctaagcattactgacatttgggactagataattctttgctgggggctgtcgagagcactgtaggatgtttagcagcatctgtgatctctacccactagaaaccagcagtagtcccccagggtggcaactaaaaatggctccaggaattaccaaatgtcctgtgggaaaactcctgcccaaatccaatcttctcaggatcacttccacatttccagtaactaccttctacataattctaaatgtattttctaacatcctctctaaagaaaatatctggccgggcacggtggctcatgcctgtaatctcagcactttgggaggccaaggcagttggatcacaaggttaggaattggagaccagcctggccaacatagtgaaaccctgtctctactaaaaatacaaaaaattagctgggcctggtggtggacacctgtaatcccagctacttgggaggctgaggcaggagaatcgcttgaatccaggaggcggaggttgcagtaagccaagaccacgtcactgcactccagcccgggtgacagtgcgagactgcatctcaaaaaaaaaaaagaaaatattctaattcacaatcattaatattctccaatatcctaaaaaatcagactataatctgacaacatggccattagatttatctgaagattaattagtttattattgttattattttttctttttcaagacggagtcttgctttgtcacccaggctgaagtgcagtggcatgatctcggctcactgcaacctctgcttcccaggttcaagttattctcctgcctcagcctcccgtgtagctgggattacaggtgcgccaccacgcccagctaatttttgtatttttagtagagacggggtttcaccatgatggccaggatggtcttcatctcctgacctcatggtctgcctgccttggcctcccaaagtgctgggattacaggcgtaagccaccatgcccggccaatctgaagattaatttttaaagcccccagaagtttatgatttactaaagttatatggagggtttgtagacagagttagcactaagatgcctaattcctgaattctggttttgtgctctttctgctaaaactgacttagtgcacacttatttctgatgatattgctgttaactgcttagtctttaagaattaaagtgtctcattggattcattttttcactctctattttgtaaacctgttcaaacctcctctacctcccagaaaatgtcaaagtaccttataagccattttaaataacttttagagcatcactcattctacctctcatgtccattcctattaatggcccccagcccaggccgcaacttctaggtttaggtccactggttacttcatttttgtacacttgtactagaccctaaattgttctgtctcttttctctgtccttcaaattatataacacaacaccacaagatggatcttaaaacacaactgtaattatatcactcttctatccctaagcgttaaatgattcctccaattctagagaatattttaggtatacataatttgtgttatgctatgggctgaactgtgttccccccacccccaaatttgtatactgaagctataacccccaatgtgatggtatatagagatggtggctttgggtaataatcaggttaagatgtattcatgaggatagggccctcatgatgtgattggcgcccttataagaggagatatcacagaccttgcttcctctttctgtcatgtgagaacacagcaagaaggctgtcatccaccagccaggaagagagccttcactaaggaaccaaatcgtccagcatcttgatcttgaacttcccagcctaaaaatgtgagaaatgaattcctgttattaataaaccatcaaacaagtaaagaagaaaaacttaaactgggttctaatgacactgctggacttcctaaccagttgctcttggttagatttttggctgttgtccatactgattaaccctccatccaaccatcaatcaaggtgaaaaagaggaatagagcaaggatcaggaacaaagctaataagttaatgaacaagttcattaagaacaagagtagcattagaccatgagagttttcttctcctctagatgtccagagacccttctctacaaatgtccaccaatggatgaatgaatgcttattttccaatttgccagaatcttgagatactggggtagggaggttagacatgcaaagatatatcagatctaacaggtttgtcctcaaaaatcaattctcacctcccatgatgggagaagccaataggagggcttcaattccaaagaaagctgagagatcagtggatgataacccaccttccagattatttctatgcattcaaacaatggcccttctactagatcattgttttttgttttttttgagatggagtcttgctctgtcacccaggctggaatgcagtggcgcaatctcggcccactgcaatctctgcctcccgggttcaagcagttttcctgcctgaggagctgggattacaggtgcgtgccaccacgcctggctaatttttgtatttttagtagagatggggtttcaccatgttggccaggctggtctcaaactcctgaccttgtgatctgcctgcgtcggcctcccaaagtgctgggattacaggcgtgagccaccgtgcccagcctctagtaaaccattgttattaccacacacgagtttttaaccacacacatactcttctgaggaaaggcttccccaaactattggtccttatgatgagatctggccatatatatttttcttctgaaccccaggattgtggggctgtcacatttcctctaacagtacaccttaggagctcccagacttgaagaaaattggctgtttcccacatttgaacattttccactttttccctcagtctacctttttgaattgatttctgactacttctagataacctttttccattaatgaatattgagtgcttattgtgtgccaggcactgctttaggcacttgagagaaatcggtaaacattaacagacagaaatgaacaacaaaaacaaactatttcaacagaaggaactaacaaacagtccagtggaggaagaaagatagtaagtataataaaaatgcaaattctctggtgaactggaagatgacgttatagaattaggaaaaaaataatagagcaggcttagaagttgaggaggtataagagaattgtaattttacgtagtgtagtcagagtaagtctcatggagaaggtaaatttggacatacacttgaaggggataaaaggtcagagaggtagcaagagtggaaatagtagtaaggatctgtaaattcttcatttttctctcagtttagtctgtggcaactgtcatgtcttttgataaggaacgaccttggtttaatagttactcccctcctagactctcaggctagattttttttttttttaattgagacggagtcttgctcttgttgcccaggctggagtgcagtggcacagtcttgtgcacagtcttggctcactgcaaactctgcctcccaggttcaattgattctcttgcctcagcctaccaagtagctgggattacaggcgcccaccaccatgcctggcgaatttttgtatttttagtagagatggagtttcaccatgttggccaggctggtctcgaacccctgacctcaggttatccacccacctcggcctcccaaaatgctgagattacaggcgtgagccactgcgcctggccttttttttttttttttttttaagatggagtctcgctgtgtcacccaggatggagtgcagtggcacaatctcaactcactgcaacttctcctgagatgcttgtgcctcagcctcctgagcagctgggactataggtgtgcgccaccatgcctggttaattttttgtatttttattagagatggggtttccccatgttgtccacactggtctcgaactcctgacctcaagtgatccacccaccttggcctccaaaagtgccgggattacaggcgtgagccactgcacctggcctctcaggctagtttcaaccctattttacactcctctaccatcctcagcttacttttgaaaaagtatttattaaaaaatatttatgaaaaagttatttttgttttatttagttgccctgggatggaatacaaatgtttgctgtagttttaaggatcctataaaactcccatttactgcaaggatctctgtttaatgggcattcaattctaagatagcaaacgtgtagagttatttgtgggggtgggggacaagtttgagaaagaagcagtggggtgaagaaagtgataggcaagggaagatggtggggataggtaccataggagtcctggtggcctaaaatctaatcacagaagttactcaagtgggactgatgcctgaaaaaaatttgtgtgtggctataacagtgagtgggatctactcttttttttttttttttgagatgggagtctcgctctgtcacccaggctggagtgcagtgccgtgatctcggctcactgcaacctccacctcctgggttcaagcaattctcctgtcttggcctcccaagtagctgggactacaggcacatgctaccacgcccatctaatttttgtatttttagtagcgacggggtttgatcatattggtcatgctgctctcaaactcctaacctcaggtgatagacccgccttaggctcccaaagtactggaattacaggcgtgaggcaccgtgcccagcctgggatctactcttaagcaacagagaaaatcagtcatttttccccttttccttcccttcctcctatgagcagaatcttggtctccatctttaaaaaaaaaaaaaaaaaaaaaaaaaggccaggcacagtggctcacacctgtaatcccagcactttgggaggccgaggtaggcagataacctgaggtcaggagttcgagaccagcctgaccaacatggtgaaactccatctctactaaaaacacaaaaatttgccgggagtggtggtgggcgcctgtaatcccagctacttggtaggctgaggcaagagaatcaattgaacccgggaggcggaggttacaaaggagatttgacagggtggcagttcaaactaaaagtggtctgatagttcagagtcaagtttcttcactaaagctgagtttttaaagggcttgaagaatgatgtaaagaggggttgtggaggaccacaaaaaaagacaactaaaaaaaggcataacaaagtcaacttattaaatgcccagcaacagggtgaagttaaggggaatggtggaataaagacctacaaatagctgctgcttcataaaagcaaagagaacactagcaaaaactacaaaaatcacgtttttcagatcctggaaattaacgaaagcttgtaaaactcaaaagattttattacaaaatggcttggcggttcctcaaaatgttaaacatagacttatgatcccacaaatctaagtatacactcaaagaaataaaggtactcaagtacatgtatacatgtttatagcaacaactcataataatcaaaaggtggaaacaacctaaatgtccatcaatggatgaatggataaacaaaccatggtatatacatacaacagaatgtttattcagccataaaagaaacgacatactgatacatgctacaacagggtaaaccctgaaaatataccatgtaaaagaagtcagtgacaaaagctcatatattgtatgatttcatttacaggaaatatcagaaatagataaatccatagatattaaacaaagatttgtggttgccagaagataggaaagggaaaatggtgagaaactgcttaatgggtaaaggggttttactttggaatgatggaaatgtatcagaactagatagaggcagcacacgtacaatattacaaatgcactaaatatcactaaactgtttattttaaaatgactgatgttatgtgactttcacctcaatgaattattttttaaaaataaagagggtatattactaccaaccacacagaaaaaaagagaattataaaggaatactatgaaaaattatctgtcaacaaattagataacctagatgaaacaaattcctagaaagacaggaactaatgaactgactcaagaacaaacagaaaatatgaatggatccaaaacaagcaatagaattagtaatcaaaaaacttccccaaataaaagcccaaaatcagatagctatgctagtaaattcttaacgtttttaaaagaattaacaccaatccttcattaactcttccaaaaattagaagaggagagaaaactttgcacatctttctatgaggctagttattactcttacaccaaaatcaaaccaagaaatcatatataaaaaaagaaaactacaggccaatatcctttttttttttttttttttttttttttttggagacggggtctcgctctgtcgcccaggctggagtgcagtggcgtgatctcggctcactacaagctccgcctcccaggttcaggccattctcctgcctcagcctcccgagtagctgggactacaggagcccgccatcacgcccagctaatttttttgtattttttagtggagacggggtttcactgttttagccaggatggtctcaatctcctgacctcgtgatctgctcgccttggcctcccaaagtgctgggattacaggcgtgagccactgtgcccagccaatatcccttacagaggcaaaaatcctcaacaaaatgttagcaaacaaaatctaacaacatatataacgattacataccatgaccaagtgggatttatttaaaaaatacaaggatggttcattctatgaaaatcaaccaacaataattttatttttattatttttaattttaattttttttttgagtcggaatttcattcttgttgcccaggctggagtgaaatggcacgatcttggctgaccacaacctccgcctcccgggttcaagcaattctcctgcctctgcctcccaagtaggtgggattacaggcatgcgtcaccacgcccagctaatttgtttgtatttttagtagagacatggtttctccatgctggtcaggctggtctcgaactcccgacctcaggtgatccgcctgccttggcctcccaaagtgctgggattacaggcgtgagccaccatgcccagcctataccattttaataaaggacaaaaactacacctgcctgcagaaaaaacacttgacaaaagctaacatccttttatgatttgaaacaacaaaacgattaggaatagaaggaaactttctccaccagacaaaggcatctgtatgagactcacagctattatagtatcatacttaatggtgacactgaaagtacccctgcccctaagatcaggaacaagacagatatccactttaaccacttcaactcaacaccgtactagaggttctatagccaaggtaattaggcaagaaaaggaagcaaaaagcattcagattggaaagcaagaagtaaaaccataatggagatgacaaatacaaataactcaattttttaaaaggccaaagaacttgaatagacatttctccaaagatgatacacaaaagaccaagtaaatatattcagtgtcattaatcataaaagcaatgcacattaaaaccaccttgagataccacctcacacctagtaggatgactactattaaaaaacaaacattgttggaaagaaattagaatcctcatgcacagtcactggattgtaaaatggtataactactatggaaaacagtacagaaatgcctcataaaattaaaaacagaactactatatgttctagcaatcttacttctgggtatatatctaaaataattgaaagcagggtctcgaagagatactggcacacccatgttcacagaaggactattaaaatagccaaggggtagaagcaacccaaatgtctacccaaaaatgaataaacaaaatattatatatatatatgcacacacacacaatagaatattattcaacctcaaaaaggaagaaaatctgtcacatgctacatgtttgaaccttgaggatattatgccaaataaaataaaccagtcacaaaaagacaaatacttttgtatttgtataattccacctatatgaggtaactaaaatagtcaaattcatagaaacagaaagtagaggccggaagcagtggctcacacctgtaatcccaggactttgggaggctgaggtgggcagatcatctgaggtcaggagttcgagatcagcttggccaacatggcaaaaccctgtctctactaaaaaaaatacaaaaattagccagatgtggtggcaggcacctataaacccagctacttgggaggctgaggcaggagaattgcttgaacccaggaggcggaggttgcagtgagctaagatcacgccactgcactccagcctaggcgacaagagagaaactctgtttcaaaaaaaattagctgggcgtagtggtggcacacacctgtagtcccagctactcgggaagctgaggcagaagaatcccctgaatctgggaggcagaagttgcagtgagtggagatcgcaccactgcactccagcctgggcaacacaccaagactccgtctcaaaaaaaaaaaaaacaaaaaacaaaaaacaaaaaaccaaaaaaacaaaaaacagaaggtagagtaatggttaccaagggctaggggcagaggaaaagggtgagtctgttgtttaatgggcattgtttcagttctgcaagatgaaaaagttctagagatctgtttcacatcaatgcttgaaactactgaactattaatttagaaatggttaaggtggtaaattatatgcgtttttaccacaataaaacaattcattttaaaaacaggccccaatcggcatggtggctcacgtctataatcccagcactctgggaggccaaggtgggagaatcacttacagtcaggagtttgagaccagcctggccaacatagcaaaaccctgtctctactaaaaatacaaaaattagccggcatggtggcacgcgcctgtaatcgcagctactcgagaggctgaggcaggaagaatcacttgaatccaggaggcagaggttacagtgagccgagatcatgccaccacactccagcctgggcgacagagtgagactctgttaaaaaaataaaataaaataaaaaataaaaaataagctagacacagtggctcacgcctgtaatcccaacactttggaaggctgagatgggaggatcgcttgagcccaagagttgaagatcagtccaagcaatgtagtgagaccccttctctacaaaaaatttaaaaacacaggcacagtggctcatacctgtaatcccagtattttgggaggctgaggcaggaggacttagtcagctcaggaattccagaccagcttgtacaacatagtgagaccctacctctacaaaaaattaaaaaattaaccgggcgtggtagagtgtgcccgtgatcacatcactgcactacaaccttggtgccagagcaagactgtctcaagaaaaaaaaaaaatttaaatttagctgggcatcatggcacacgcctgtagtcccagctactcaggggtggaatgaggcagggtggcagctgagatgggaggatcactggagcctgggaggtcgatgttgcagtgggccataattgtgtcactgtactgcagcctgggcaacagagcgagaccctgtctcaaaaacaaacaataaaaaatgggcgaaggatttgaacacttctccaaagatacacaaatggccaagcagcacatgaaatgctgctcaatatagtcattaaggaaatgcaaatcaaaatcacaatgagctattacttcacatccactaggttagttataagcaaaaacaatctcaagcgttgcagaggatgtgcagctatctgaaccctcaaatactgctggtgataatataaacttgtactttggaaaagtttggcaattgctcaaaatttaaatatggcgttaccatatgacccaacaatatcactcctaggtatatacccaagagaattgaaaatataacacatatataagctagctggaatatagccataatgctgctacaaagtgcaaacaaccgaatgtaaattaattgataaatgaataaacgaactgtggtatatccgtacaatgaaatactattcagccataaaaaaactaagtacaaacaagcatacaatacggtgtaccttgaaaatacactaagtgaataacaccagacacaaaaggccgcatattttattattttacttatacaaaatgtccagaataaggcaaattcatacagacagaaataaagtagcagctgccatgggctcgatgaagaagaatgaaaggaatatagcaggtttgaaaaatggcccccaaaatatcaggtcctaatcccttaagcctgtaaatgataccttatttggaaaaaggatctttgcagatgggaaaattatcctggactatacaggtgggccctaaatgccaccacaaatgtccttgtaagagaagcagagggagatttcacacatactctaggaaaaggtgatgtgaagacagaagcaaagattagagtgacatggtcacaagccaaagaacgtcacatccacaaactagaagatgcaaagaatggattctccgctagagtttcccaggggaggacagccctgccaacatcttgatttaggtcttgtgaaacttattttagacttctgacctcccgaactaagggagaataaatttttgttgttttatgccaccaagtttgtgataatttgttatagcagctatggaaaagtaatatagggagtgactgctaatggatacaaggtttctttagagttgatgaaatgtcttggaattagatattgctgatggttgtacaattttgtaagtatataatactaaaaaccattcaatttcacaccgcaaagggtgaattttatggcatatgaactatatttcaaagaaaaacaaatgcctagtaacaggctggtataacccgccatctcccaacaactgctgctaaattttcaaagcaccattaagcagactcaattcgtagcaaggataatggaacaatgcaagctcatctagcgaacaaaaagaattaagctagtatcaggtggtcaatttacaaactgtagtgggagtcatacattcccaaggatggaacagttatatctccttgcagagtgaactcttctccgataccaaggacttggaagaccaaataaattatacgtaggattaccaaatatgctggtatgaccaagacagttatagtttaaacttctatctctgtggaattatggatagtgccactcttcaatctttaataagtccttcagtttagatgataaattacatagtcaacctagttataaggaatctagaggttgtgaaaagctgtgagagcatattctatgcagaccacataggtcctatcatgactccctatgtaacttgggtctctgcgactgggaagctcccagggaaaaaaccccagttaagacttctgcagagcattcacattttgtttcaaacttatacaacactaatgctaaagctcaactctcagaattgtattattcagtattatccaaataactgattaatttacacactgaagggaaagaacaaggaatggacctatacacacttgtagtttacaagtataagaagctaacaaagaataagattaaaataacttgtgccaggccgggcatggtggctcacgcctgtaatcccagcactttgggaggctgaggcaggtggctcacgaggccaggagtttcagaccagcctgaacaacatggtgaaaccccatctctactaaaaatacaaaaacttagctgagcgtggtggcacacgcctgtaatcccagctactcaggaggcaggagaattgcttgaacccgggaggcagaggttgcagtgagctgagattgtgccactgcactccggcctggacaacacagcaagactccgtctgaaaaaaaaaaaaaaaaaaaaacaaacaacttgtgcccacattaactaggtgttaaaagccaaaaggtgaaagtcactattctcttttcacatatcaaattgaccctaaggtaatattgctgcattagaactgagctggtgggagggatgttaagaaattagggagaaattgttaatctacagaaagaccatcatataaggttctgtgtgtagccaaacatacacatttgatgttctgatgtttgctattttagtggaactatagctataaaatgtattcaatcagtagaattaaaacatatcccagtccacaaaaaactaagagagaaattatacaggaatgatcaagaatctgcacagttctcataatctcattactagagagaaaaggagaaagggaagcatcaaggtagtatttgagacgaatttaagaagaccactcattcaataaaagtttggtgggccaacaaggtgccatgtattggtctggtgatatagcagtgatccaaagtctttcacttcagggagctgacattccagaaggagtagtcagaaaataatttttttaacaaaagtaacatggttatataaacactagggagaaaaataaagtaggaaatggaggcaggttgatactcacataacatgaatatggctgtctggggaagaatactccaacaaagggaacagcaaacacaaagcctctgagactggagcacttaacacatgcaaggactgatcaataggctaacacaggtggaccaatgaaaagagtgacaagttagaaatgagataaaaaatgagctgtttgtggcaaaggaaagccaagatcatgtaggccattctaaattcttcagctttggccaggtgtggtggctcacatctgtaatcccaacactttgggaggccgaggcgggtggatcacctgaggtcagaagttcgagaccggcctggccaacatggtgaaaccccatctctactaaaaatacaaaacgtagccaagtgtgctggcatgtgcctgtagtcccagctactcgggaggctgaggcaggagaattgcttgaacccagaagacagaggctgcggtgtgctgagatcatgccactgcactccagcctgggtggcagagcaagactccatctcaaaaaaataaataaaaataaaaataaaaataaaataataataatacaaaaattagctgggtgtggtggcgggcacctgtaatcccagctacttgggaggctgaggaggagaatcacttgaacccaggaagcagaggttgcagtgagccgagactgcgccattgcactccagcctgggtgacagagcgaaactccatctcaaaaaataagtacataaatagacaaaaaataaaaacaaattcttcagcttttaccctgagtgtgatgagagattactggaaggctctgagtgagaagtaatatgatctcactcatttcattaggattgctgtggttactgtgtggagaatagactttagagagtaatagtggaagcagaagacaagaagctactgaaatattataaacaaaagatgatggtagtatcagacaggatggagaaatagagatactaagaagtcggactctagataaaaatctagaaggcccaattcattgatggattgggtttgggatgtgaaggagaggaggaggacacacaagaggtaatgctgagcaggtaaatctatgagatcagagcccaaggaaagttccgaggtaggtacttaaattttgaagtcttcagtatgtagcattatttaaaacacaagactggatgagatcactcagggaaaagaggtctgagatctaagctctggggcattccattgattagaggtcatggagatgagaaggagctggtaaaggaaattaaaaaaaaaacaattattcacagccattcaggtgggaggagaattgagaaagagaagcatcccagaatccaatggggaggagaaaaggaactgtaatatatgctgccaatagatcaaataaaatcacgaaaatcaactaaaactgaccaatggattaagcaaagtggaattcattggtgaccttgacagcagtgggtttaaggaagaacgagaacaggagatagcaaatacggacaactctggagaaattttcctgtaaggacaagcaaatacaaattaaaacaagcagatgggagatgtggcatcaaaaacgagatctttaaggtgaggtgatggtacaatcagtatgtttgctatattaatgatctggagagatagaaaacttaaccctagacaaagagaagtcttgctagaataatatccttaaataaacaagtgcacatgtagaggttctggccttagcaagaagtcaaattattcacccagagtaacaggacaatgctttgagatcctatggaaaagggttaaatggtggataaatggttgcggtggccatcctccaagatggccctaaatgaatcccacttcctggaattcacatagttgtagccctctcccactaacagggttggcctgtgggatcaagcacatacagcaggaagtgatggtatgccacttcagaaattaggtcataaagactctgcccttcatcttgggtacaaggtctcttgaatcatttgctctgaagtaagccagctgctgtgacatgaacagccccatggagaggcccacagagcaaggaactgaggcctcttgccaacagcccagtgagtgagcttagaggcagatgatccaaaccaagtcaattccgcagagactgacaatccagccaaaggtttcactgaaacctcatgagtgaccttgagccagaaacagccagctaagccactcttggattccagaccttcaaaaactatgaggtaataaatttttttttaaactactaagttttgagacaatttgttacacggcaatagataactaatacaatgggtctcactgagctgtaatcacaaattgctgggcacacaattcactataatctcacctactggcatgcaatgacttcagatgacctcccctgtcctgctgcatgcagttacctcatgaaatacagtcgctgagaaagagggtaggataaaaggagtcagctttatataacttaacatccctgatgctcttttttttttttcaagagatgtggtaaaagaatgccactaccaccctctcctttctcaacaaagcaatttagagggttcccgaatgacctacatcaacaattggcctgaactaatcaaacgcatcattcagattccctcagtaaaatattgaataccaaacagctatgcttcagcaaaggaaagggcaagggagcgaaactgaaggacgaaaatacaactttggtcctcatcagggagacttctcttttcttacctcaggtttattacaacgcaacttttaagaacttgagctattccaggcagaaggtcacatccttgaggtaaccagagagaagcattagttacttacatgtcacaagaatattttcgatcccactgcctgacattgccatttaggtgtttatcaatcatctcacacttaaccagataagtgaactgaactcctttcccccagatctgttcctccaatctaccctaccttagcaaaggaaaacgtcccacccgccaactgcccaaatcaaaagcctgcaaatcacccgaggtcctggctctcacgggagggactccattagggtcccaggggctgcattaagagtcccgacagcgacgcagtaaatgagacaagacgctgcggtaggggagagagacccatacattcaaatgccttaaggggtctgggcctacaggtctccagaactggggagggcctggggttacaaagcagttttcagatttttaaatacattgagcgccaaaagagaccccgcgggggcgatgggggaggggagcgcactgggagccaggaaaggccccttctccaggaggcccgggcccagcccgggggtgggggcgtctgcgtgagggagtggaggctgatgtaaaagtggcgcccgctgagattagggaagggggtgtgcgtgaggggatcgtgggacctggttctgccctgcactcccccacagaaagcggctgtattgcaaaggccgctccggcagcgcacggccaagcgcggtgtcgcgacccgcagggctgcggctcgccatgaaatccctcaagtctcccctcagggaacgctgaagccgcgccacgcccccgtccttaccagtccggatcagctgctgttcgcgagctgccggccacgcaccagccccggaggcgctcccggggcacagccggcggcgactacgcctcctcaggcccccggcgccgccgacgcgcacgcctccacacgcgcgcgtccagtggagacctgcgattggctgccaggtgccggcgcgagatcggcgcggctccgagctaggagcatgcgcgcgctctgacgcccctggtggcgacggctggacgcggggttaaattgagaaggaggagggcagcagcaatacccctgaggccttgaaaggatcttgggttccggatcacggttccaggcagtcagggttccagagctgagggggtatccaagcagtcagggttccagagctgaggagcatccaggcagtcagggttccagagctgaggggcacccaggcagtcagggttccagagctgtcgcagccagggcttggggtggggggtaggcttccagtccatcaggggatggtttgcccaccagaaggccagctgttataattctcaggtgtggtccctttgttgactatccatgcttaagggattgtgaggaaacaactgaacctaacatctgtcctcttctagttacatctggggccagttgaatccagcctgccacctgtttttgtacagctggcagcaagctaagaaccgatttcacgtttttttaatggctaaaaagagaatattttgtggcatgtgaaaattatatgaaattcaaaattcagtgtccataaataaagttttattggaacaacaaacatgcccattcctttcggtattatttatgcctgttttcctgcttcaacagcaaagttgattaattgccagagaccatgtatgaaaagcttaaaatatttactgtctggccctttacagaaagtttgcccactcagtttacttgcagctttgattttttttttgaattgaccaattctgccaaaagtctattttagcaatctttttggggggcgggtaaatcgcttttggtttaattaatctataatgttattttcttatctattttatctatttcttccattctgttattttcttccttcgtgacttcataggcttgttctgttacttctcattacaacttttggagaaaaatgcctacctcgtttgcttgtaaacttttttgtttctcttgtatttaatgctataaatttacctttaagtaccagtttaactgtgtctcaccagtccgcttggtaatatgttcattatccttcaattagatatgtcctaattttgctagttgttagaaatgcttgttccctggtgccgcaaagaaatagcacttgaacataaatttaattttctcagcaaggccattttcactttctgcagaaagggtacactcgccagcagttttgccacgagagtaccccaaacaaaggatacagggttatttataacctgacgcatccaccctactgctgtgtccggtttccattggctggaacaggacctcacattctgtgtttgtcccgattggctaacaacttagaactttctaaaagaggcaaaggcagaggagaacaaaggaaggaggatgtaacttgtagaatgctgagaaaggtaaaaacacctccaaataggaagaggaacaggctatgacctaatgcttgcttggaccagtataagcatgcaagggcaaatatttaggctaaattgtgggagctaagaacacaaagtatattaatttctttattacggctagcagatatctaagaatgttagcacaggtctttgaataaattttacttctaagagaagttactatttattcgtaattagacagggaggaaagtctttgaagaggaacctctactttattttttacatagtgattctttctaacacaagggttatatagtatatgttatttatttttgaaatctatgagatttttaaaagattttttaattgtattataatcaaatcacatggcctaaatattactcacccttgcatttgaagatttctgttcagtgaagtgtaccatagtcaaaatgaagagatcatagatgtaaagaagatatttgcagtatctaaaatgtatatatgaggctgatatgtaaagatatttgcattatctaaaatgtatatatgaggctgatatgtaaagaagatatttgcaatatctaaaatgtacgtaagaggcctggcacggtggctcacacctgtaatcccagcatttttggagaccaaggcaggcagatcacttgaggtcaggagttcaagaccagcctggccaacatggtgaaaccccatttttgtacaaaaaatacaaaaattagctgggtgtggtggcacgcgcctgtagtcctagctactcgggaggctgaggcatgagaactgtttgaacctgggaggcagaggttgcagtgagctgagattgcaccactgtactccagccttgggcaacagagcgagactccgtctcaaaaaataataacatgaaaaataaatctatgagaaatgatcttcttttggcttcataataattccaatgtccatcagtaaattagtatcaactaagctccaggctttattcaaatgtcactagtttttcccatcatcctttttgttccagattcccacccaggatactgaattgtacttggtcattttgtgttcttagccttctgtggtctgtgacagtttcttaaacttttcttgcttttcatgaccttgacaattttaagaagtaaaggtcaggtatttttcagagtgtctctcaatttaggtttgatgtttttctcatggttacactggggttatggtttttagaagactatcacagacatgatgtgtctttctcataatttctcatcagcgatccatgctatcaataagacttcctactggcttctccgctgtaaattacttcccccccctttcataccttattctaaatcttgcctacatgcaggaaggccgtgaggtctcattgaaggaaaattatctacacaagttactttgcaattcttctttaaggaagatttgtctcttcttcctttagttttaaattaatcaaaaatagctttttagttttaaattaatcaaaaataaaataaaaaatttagtacctcagtcatacttgccacatttcaacagatcaatagtcacctgtagcatattggacagagcagaagtagagcattttcatcattgcagaaagatctacggacagcactgacttagatcattagtcaacctttcttcttcccaaatatatgcatttagaaatataaattcccatgaaatgctttagttccatcccataaattttgtggctgttttcaatatctttcagttcaacattttccttttttcactgcaatttcttagaggagctatgggttattcagaatgaggaccaggactggggtgagataagcaaggaggctgaggcacattaaggagagacccacgcccagcttcaggtatggcatattgtcaccttaggttccctgcttgcctcaccctagtcccagccctgtttagaaatgtattgcctaatttaggaactttgggttttttttcagtgatctttctgttactgatttgtaagttgattcccgtgtactcagtgggtaactacaaagagccccacagctaacatcacaattaaagtaaactattctacctgagtttgagaccaagaaaagcacacccatgaaagccacttcaattcgcaaagcatttggaatagccaaggcaattttgaacaccaaagttggagaaatgaaactaccacatggaggattatgcaaagctacaataattaagatactgcagcattagcacaaggatagagaacaggacaaatgaaatgaaatagattccagaaacacatatatacaatcatacctgattcacacagtttccacggcaatacagtagggaaggagtggtctttttagtaagtggtgctgattgattttgggtatgtatatgaaaaaattagtcttcatgccttatcacaccattaacaaaaaatcagtttgagatgtctcatcaaaacagtaaagcttctagaacatagaaggaatatctttatgtcgtttgtagacaatttcttaaataagactcatgaaagataaaccataaaaccacgatttagatccaaatatgggacatttccagtgccccagcacccttcccagtcgacagcccagtttttaaaaaggtaggagggggcaaaacttgaatagacatttaataaaaagaaatactcacgtggccgataactatataatctcaaggtccattaatcctcagggaaatgcaaattaaagccacaataaggtaccactacaatttcaagagaagggcacttactaaaaggactgacagtaccaagtgctggatcagtagcagtggaattcgcagtatcggtggtgggaatgtaaatcgtttcaatcactctggaaatgtatttggcagtatctacactagacagctaaatatatgcagttccagcacttctcatagctatatacacccacgagaaatgattacatgcttaccaaaagacacgcacaagctcatagcagctttattcaaaattgccaaagaatcagcctcaaagtccatcaacagtgaaataaatttatacaaaactgccacagtcactcaacaaaattctacccagcaatgaaaaagaatgtgctactgctacacacagcgaaaatgcatctcacttattttatttcattttactttattttgagacagtcatgctctgtcacccaggctggagggcagtggcgcgatctcagctcagtgcaaactccccctcccaggttcaagcgattctcctgcctcagcctcccgagtagctgggactacaggcgcccaccaccacgcttggctaatttttctattttatgcagagaaggggtttcactatgttggccagcctggtctcaaacttctgacgccaagtgatccacccacctcagtctcccaaagtgctgggattacaggcatgagccatcacgcccagccatctcacttattttaaaaagccaaagacaagaatctttgtgtgattccatttatttaaagttcataaacaagaaaaacctctgaggtcagaataagggatgccttgttgggagcatttgactgggaaagggctcaaagactttggagctacttcttgacaatagggagctgatgagatgtcactgtgaaaaacaacctgacagttgatgacattgcttgctagcatctacagccacaatgcacatatggcctagcctcacttctgcctttcggaactcctggaagtcagtcgaacatattttcagctagaatccttgctgcaagggagtctggaatctctagtgttcatagccgtcttctttttagtttttacaggagaagactgagggtcagtgttgctaacaataacggaagccataccacttgatcctggctgaactgaagtttgaataataacttttgtttcacgagggaacccttgcagttgctccggctttttaaatgtttgatggtccttggttttgtgctctatttcctccttcaacgtcaaaaactgtagccggcacttggaacactgaaggaccctccttctgctgtgcctccaacaatgattcatgtatggtattgcagttttgaaaagtttgagacaaaacagacaaagcaaattctttgtgttttcatggcacgttctaaaatgtgtttccacatcagcaaagaccgacgatctgtaatggcaaacctggcacacgtagggcatttcgccaggcttatgatggtccttcatgtgttgtaagaggacctgatctgtttcaaatgacaattcacagattttacagacagcagagggccccatggcgatgtgtacactatcaatgtgacactgtagctggaagggagtgggaaactgccggtggcagtgctggcaggtggtgtggtcttcccagctgtcgttcctctgcttctcaaattccaaatgatgcttcatgtgattcataaacttaatattttttagaactttcacgcagctgaggcatttaaaggtggtgtgagtcttctgttccggctgcccatctcctttatgctgtccatagtaaaagttgctaagtaacacgatgggattttctttcttgggatcaaaggtcttgttttgacttgctagacttgaaatgtctgtcattgccaggccagactcatttgctctctctggatctgtaagattgaaatgtgcctttccattagcatcaggccaaggaaatgttactccattctgaacatggtttgatgagttgcagatcccctgtgagggtgtatttgtgcttattgtagaagacatatctgaagggaccacagctaaagaaggtacccctgggattccatccctgagtttaacccttttggaatctctgctgtttatatctgaagtggaaagtcgctttgaatcaggagaactctcatttctgcctcctccagagaccatagctccaactagacactgagtccctggggggagcgaatctgagtaattgggagaaacaacttgtggtgagctcattttataaccaggttcagatgaagacttcatagtgacaggactatctgtcgatcgcccctcagacagagaaacgggcatgatggcttttgccatagaggtcacatgatttgcaggctgcgacacgtgagcaggatattgacggaagtggcctttctttcttcttgactttgagcctggggtgactctgttcaaaatgtttgaaacgactggttttgaatttgaaatcatcccgacaaagagaacttcagcatctctatgtacatgctccaccccaacatagatcagatctggatcttcatcatcctcctccctttgtttggattctctcaaattcttctttggtgattccactttcttacacaaaaagatatctcccattttcaatttactttttgcttgaagccactggtctcttcaacttccagagctgtctttttacaaattgccacctaagtgcaaccatgtgacaatagtcaatatttatttcgaaagacaaaatcattactttattgtatcctcccttaaaacactgagataaccatcaacatctctattttacacgtcagaaatgaggcttgaaacattttaaatggcataataatttcaaatttacctgtctctcctcccctggtcttctgcagttgtgaggcaaaggaagcaagatttcaggaggtgcagatggaacatctcagagtgcttgcctctaaattttgcactctagatgcctcactcacctcctcctcatcccacaggtactctctcagatgtctaaggtttctaaccaacttgaacaaaacttctctcaaaaacattctgctcctagcctgggcaacatagcaagaccccatctctacaaaaaaatttaaaaattaaaaaaaattagcttggcatggtggtacacacctgtggtcccagctacttgggaggctgagccaagaggaacacttgagcccaggacttcaaagttatgttcatgccactgcactccagcctgggcaaccaaatgagaccccatcacacaaacacacacacacacaaatcacaacacacacacacacacacacacacacacacaccctttgctgttcctgtaatgttccttttctcagtaaactcagttgctcagtctacaaacttcagagtcatcctttgccagactttctctcatacactacagccaatcaattagcaaagctagtctgctctatcttttaaagatatccagaatctgactactctcttccacatctactgccacctccctgatggaaggtaccatgttctctccctggatcactgcagaagttgccagtcttaaaagttttgtcagatctccccatggtggccccaatgcccctgttaaaatatacaggggagcaagtatattttgctcttaagtcttcaatgactttccatttcattcataggaaataccagcaaactttaaatttctccatggaaccttaggtcatcatcgcccttgctaactcctctgttgctctgatgcagccatcctgagctccgtgaatctggaacacaccaggcctttttctttttcagaacttttgttgttcccggacattgcgtgcctctttccccagattaaccccatctgggctcctggtctgcctcagtcccatggttcctcttcagcaaggcttacctgaccacaatatcaaaaatcacaacctccttaactcatatgttcaaaccctcaatgttatttttcaacttagcatttatcactgcctaccacacaatatgtaaaatatatcttgcaagcccaggagtttgagattacagtgagctgtatcatgtcactgcatccagcctgggtgacagaggaaaggaagactctgtgtcttaaaacaacaacaaaaaatgggacaggtgcagtggctcgtacctgtaatcccaacactttgtaaggccaaggcgggaggattgcttgaggtcaggagctcgagaccagcctgggcaacatagcaagacccatctctacaaaaaatttaaaaatataacttgtttcttttctgtgtttacccactaaactgtatgccacatgagggcagggagttgtgtttcatttactcctcagcttatagagcaatgtctgtcatactgtgcatgctaaatctttgttaaataaatagtagctgttattaatatgatcatttaggtgtaccagaggctctaatccattattccagattctctaagcatttaatgaaatccaaatccaaatgatttaatactgttgtacaagggagaaggtaaacctgtgtgtatgtgtgtgtaaattgaaacaaaagttttgtcaaatactctaataccttcaccttaccgcaagggataggctctgataccttctatgccatattttattgattctaaggtataggcttagatttccattttaacatctctaaatcagattgcatctcatcatagcatctcatcaatataaaatacatttcacaatttgtttttgcagtatatatttttatttcatagtggaatcaaaaatgacatatctcagatccttttgtgaggataagcgtgatgcttgggttttcactcatgtgagatgtgcttccctcaaaccttgttatatcagcatgtttaacatctgatgtaaaaaaaaaaaaaaaaaaaggagagtaatgtatcttttataattgatggcatctttttttttttttttttgagatggagtctcgctctgtcgcccaggctggagtgcagtggcgcgatctcggctcactgcaggctccgccccgcggggttcacgccattctcctgcctcagtctcccgcgtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcatgagccactgtgcccggccaattgatggcatcttatagtcagtgaaaaatcctatttctttttgtaagctgacagcccactaaacttgttttgtagttctctaatggatatcacctacattttggcaaacaatggtttaagacagaaattggaaaattggcccttcccctgtttttgtacagtcaggaagccaagaatgtttcttacatttttaaggtattgttttcttactttttttttattaagatttttttaaacttgtacatttttagatttgggggaataaacacgcaaaaggaagcggggcgcggtggctcacgcctgtaatcccagcacttttgggaggccgaggtgggcggatcacttgagctcaggagttcgagaccagcctggccaacatggtgaaaccccttctctactaaaaatacaaaaattagccaggcatggtagcagatgcctgtagtcccagctactagggaggctgaggcaggagaatctcttgaacctgggaggtggaggttgcagtgagcgaagatcgcaccactgtgctccagcctgggtgacagagtgagactgtctcaaaaaaaaaaaaaaaaagaaaaaaggaatattttgtgatgtgaaaattatataacattcaaaatgtcagtgttcactataaagtgttgtggaacacagccataatcatttttttagtgctgttgtccatggctgctttcacacttctatgacacagttgagtacagtagtacccccttatctttggggcatatgttccaagacccccgaagtggatgcttgaaactgcagatggaaccaaattcaatatatactatattttttcatatatgtacatacctatgatcaagcttaatttataaataggcacagtaagaggttaagcataacaaaataattataacaatatactgtaataaaagatatgtgagatagtgcgtggtggctcatgcctgtaacctcagcactttgggaggctgaggtgggtggatcacctgaggtcaggagtttgagaccagcctggccaacatggtgaaacccatctctactaaaaatacaaaaattatctgggcatagtggcgagcacctgtaatctcagccacttgggaggctgaggcaggagaatcacttgaacccgggaggcgtgggttgcagtgagccgagatcgcgccgtggcactccagcctgggcggccagagtgaaactccgtttcaaaaaaataaattaataaattaaattaaaggtatgtgaatgcaatctctcgctgacaaaatatctttatgtactgtagatcttggcaaccttagcatacgattttgttttctttccttattatgttaaaaactttcccattttcacttaaaggaagcaagcactttacagcttctttttggcatatttcaatcgccagcattgctacccttgtactttggggccattattaagtaccataagggttaattgaacacaagcactgagataccaccaggacagtcactctgataactgcgaccgctcctaagtgactaaggtacagagagcgcagccagccaacagcatggggactcaggacaaagggaggattaccatcccagggcagggctgactcaagagcttatcacactactcagaagggctggcgacttaaaatttatgtattgcctatttctggaattttccaattaatattttggaacctcaggtaactgaaagcacagaaaggaaaaccctggataagggaagactactgtagttggagcagagaattgcaatacctaaaatatttgccatctagtctttcacagaacaagtttgccagctctagttttagaggagcaaaatgaaagatagcaaatttctcagctcaccagttcctaaagttgcgagtgcatccagatgattcagtgcagctcagtatgttccactctgggccacaagggaaagcgaagctggagcttccttgtctccacctccgggagaaatttgtccagagaccggcagcactgcttccgcaggcgaacaacgccgcttgctcttcaaagtcctttctgaggccagatcagaaggtcccactccttttaagccccttattgcccaatcatttttccagtcacgtgtctgaagcagtttatcctgattggattttcagttgttgtccagcttgattgccaaaagttttcctccaattgctactcaaaggaaagaatgagggtggggcttcagggctgctttccaggttgattgagctgctgatgggcatcctccctcctctctctcttgttcagagtctaccactttctctgcagtgtgcctgggccctcagctattggggatgagaagggatgcggagtgggaggcagtccacatgtctgttccaacaaagctcagaggtgagcgagttaaaaagcagatgtctttccagtaggagccccaggggacagggtgggtctcacagcccttgaagaccgagctcccgtaggagtttccaggtgtccaaacagggtcctcactgtgagtcttcaacagctttctccaagcagcagcccactcccttcttaatccatttccaggggtcaaaggtctatcctggttccctcccatgccctctcacttccttccctctgtctctccctcctccctcctccttcactaccccctccctggaaccttctcagctgaatttcaggcccaccctttcactctctttacaggctttgcaacacagattagaaagcgggggagggggagcctcaagagtcccttgacaggtaagaaatatttatatttccacccccattccaacgcaatgcaatcaagtctcaaaattaaaacgaaaatcatttgcaaattaaaatgttctaaagtaccatctcctgataaaactttaaaaatacctttctgggccggatgtggtgactcacatctgtaatcccagcacttttgaaggccgaggcagcagatcacatgagcccattagtttgagaccagcctggccaacatgatgaaaacctgtctcttattctttataaagtaaaatacaaaaatttcctgggcgtggccgtgcgtgcctgtaatcccaggtactcgggaggctgaggcagaataatcacttgaacccagtaggcagagcccaaggtggtataaaagtgtgtgacccatggtctttattcttgtctagggactggggaaaggctgcttgagggcattgcaagtagccaagagcatgcccctggaaaggaaggtgaaatgaggcccgctactgaggtacacctgtagtcccagctatcaaaggctgaggtgaaagatctttgagcccaggaaatccagacaaacctcagcaaaatatcaagacctctgtttctacaaaagaaaaaaaaaatttttttaattagccaggcattgtagcacgtgcctgtagtcccagctacccgggaggctgaggtgggaggattgcttgaaccagggagatcgaggttgcagtgaactatgattgcatcacatactttagcctggatggaagagagagaccttgtctcattcattcattcataaataaataagcaagcaaagtgaaatgaagtgcaagacttagacagtaaagttctaacaggggccgggcgtggtggctcacgcctgtaatcccagcgcttaggcagaggcaggcaggtggcttgagcccaggagtttgagattagcctgggcaacctggcaaaaccgtgtctccacaagaaaatacaaaaaattagcctgggtgacagagtgaaaccctgtctcaaaaaaataaaaaaagaaaaaagaaaggaagacagagaaagaaagaagtaaagaaagagaaaaaaaggaaggaaagaaaggaaaggaaatgtgtattctgcagaactgatattcactccttcctcttttccagaagcagaatcctgctaggaagattccaggaagcctaggcagtggtcaggggctggctcaggtataaagcaggcccttcccctgagacagaaggttgtggcaacaatgcttgtgggaggtgagaaaattgagaggagtgtctagaaatagctcggagttgcatcttattttcttttgctcagttttaaaagtcccaaataagaccacatctagctgttctaaccaagctattctaacccactaatctagtaaaaataaaatcacatggtctgaatataaatttgcatcaggatacatgcctttcctatgaaacatttatgtttccttataaaatgtatcctccttttctgcagaaaactaactgtaatgcatccaaaggtcacagaatgtggtgaaacatcctcatcattgatttttaaaaaaatttttatttatttatttatttgttttttgagacatggtctcacattctgttgcccaggctggagtgcagtggaacgatcatgcagtcttgatgtcctggacccgagcgatcctcccacctcagtctcccaagtagccaggacaataggcagatgccaccatgtctaactgatttatttttatttttgagtagagatgaggtctcactatgttgcctgaactggtctcaagctcctgagctcaagcaaacttcccacctcggcctcccaaagttctgggattacaggcgtgaactacccgcaccctgccctccataactgattcttttttttcagacttcactctgttggccaggctggagtacagtggcgtgatctctgctcactgcaacctccgtctcccaggctcaagcagttctcgtgcctcagcctctcaagtagctgggattacaggcatgagccaacacgcccggctaatgtttgtatttttagtagagacagggtttcaccatgttggccaggctggtcttgaactcctgatctcaggtaatctgcccacctcggcctcccaaagtgctaggattaaaggcgtgagccaccacgcccagccatagctgattctttatcagtctgcctttgggaagtttccactgggaaacactctccaggactgtttcggaccagccccactttccaaacaaagaattccagtgatgagattaaagcttgtcacaatatgtttttcaaatgactggtagaagcagaccttaagattaaaaaagaagaagaaaaaatggctgaaatcttgaatcctttattgctttaaggcacagaataggaaatggatggcgcgtcgggaatggatgcaggtcagggacagaccatcactcatgccaccttgctgtgtttatgaaacagagtgctagaagttaaatttgggggatgcacaaagagatgcctaatcagatgaactcagagttggaattgctgtttgtgagacagttacatcaaaggaagaaaagaaggagagaagaaaggtgactatcaggagaattttccagccagaagaaagacacagaggcacaggcatttcatggcctgaaaaaggaagagcacagagacaagtgtggctccagttaaaggaccagcggagatgaaagatgaggtcagtgatttgggtaggggacatagcagttaagatattgttggtcaaggctgggcgtggtggctcacgcctgttaatcccagcactttggcaggccaaggcgggtgaatcacgaggttaggagatcaagagcatcctggctaacacagtgaaactccgtctctactaaaaatacaaaaaaattagccgggcgtggtggcgggcgcctgtagtcccagctacttgggaggctgaggcaggagaatggtgcaaacccaggaggcggagcttgcagtgagccaaggttgcaccatagcactccaacctgggtgacagagtgagacccagcctcaaaatactactactactaataataataataataaaaacaaaacaaactaaaacactcaggagagattagtggtctaaaagcatatttttacaatgtattcagggttattccattgtttcttaaaaactacctttgggagcatctccccaaacttagtttggaagtgttttttctgggttgcaataaacaagcaaacaaaaaactaccttttaattaaaagtaatccttaaatagagctaacaataaaatcaaacacacaaaaaaattatccattttaaaattttttttatatgaagtcttgctctgttgcccacccaggctggagtgcaatggtgccatctcggctcactgcaaccttcaccccccgggttcaagcaattctctcacctctgcctcccaagtagctgggactacagtcacgtgcgagcacacccagctcatttttgtatttttagtagagacagggtttcacaatgttggccaggttggtcttgaactcctgacttcaagtgatcccctgcctcagcctcccgaggtgctgtgattacaggcgtgagacaccgcacccggccaaaattcatccattaattgtaaagtaaatttcccttctgccccagatcacagttacctgtctctattcccaaaataaatggctgtgtagaatttctgatgtgtccttcaatatatattctctgcatctacatacacttaccttcccctacctttttatgtaaatgggtgtttattattcacatactccgtattaaaattgtgatttattaacataattttactgacattttaatttgaatggagataaatttataaaggggattgatgattaagattttatgtttaaatattcggaagcaaacagtaatgcatcttatcttctgagtaggatgtgggttgaaactgcaaaggcaagcatgagatgtttcattaacacaaagccttgagtgctccaaacccaaaagtcaaagcaacttatcaataaatgccaaaggatgctattctgacatatctgtgtgctgtggtttgaatgcagactccaaatctcatgtgtgggaaacttaatttccaatgtgggactattgaaaggtggggcctttaagaggtgattgaatcatgagggctctgccttcatgaatgaattaatccattcgtggattaatgggttgatgggttaatggcttatcatggaaggggagctggtggctttataagaagagaagagagacctgagccaacatgctcagcctccttcatgagatgccctctgcggcatcaggatgctgcagagacccccaaccaggtaagaaggcttttaccaggcatgccccctccactttgggcttcccagcctccataactgtgagaaattcattttctttataaactacccagtttcagatattttgttgtaagcaacagacaacggactaagacactgtgttatctaattatgtgattcttgttttactatttatttatttagccacttgtcagaaaaatttttttttttttgagataaagtctcactctgtcacccagactggagtgcagtgctgctctcatggctcactgctgcctcgaactccctggctcaaacgatcctcccaccttagtttttcaagtagctgggactactacaggtgtgcgccaccatgactggctactacttttttttttttaatattgcccaggctggtctcaaactcctggcctcaaaagatcctcttgcctcagcctcccaaagtgctggcattgtaggtgtgagccaccacacccagcccaccaaaagttttttcagacatgtacctgagtgattaagagtttaggattggctgggcacggtggctcacgcctataatcccagcagtttgggaggccaagacgggcagatcctgaggtcaggagttcaagaccagcctgaacaacatggagaaaccccatctctactaaaaatacaaaatttgccaggtgtggtggcacatgcctgtaatcccagctacttgggaagtctgaggcaggagaatcgcttgaacccgcaagggagaggttgcggtgagccgagatcgtgccattgcactccagcctgggcaacaggcaacaagagtaaaactctgtctcaaaaaaaaaaaaaaaaaaagagtttaggatctatattcgctctgcctgggtccaaatcctggatgttattaactgtatgactttgggcaagtttattaacacctccattttaaaaaaatctgtactaggaatataataataaatgcataccctctcaggatttgattaaatggaataaaatatatagaattcctagaacagtgccaggagtttgaggccagcctgggcaacatagtgagaccccatctgtacaaaaaatacataaaaaatgaggggggaatagcggtgcacacctgtggactcagctacttgataggctgagatgggaggattgcttgagcccgggggccaaagctgcagcagtgcagtgactgcgtcccagtaatcccagcactttgggagggcaaggcaggaggatcccttgaggccaggagttcaagaccagcctgtgcaacataaagagactccatctgtacaacaacaacaaaaattcttacgcacttagtatttgccagatataatgccaatttctagggcacaaaggcaaatggtaactacctccctggattgttgtaaaaataaagcatgcaaaacattttgtgcccccaatgatcccttcctcatggtgtccccacacttttattttgtgctgtcacaatgagcagggcaccaccaggatactgggaaataatgacgtgtgatttccaagaccaggtcacaaaaaacattttgccttgccctcttgaatcacctgctctggtggaaaccagacaactgttatttatgtcatagcattcaagcggccctatggagaggtccatgtggtaaggaactgaggcttcctgccaacagccaagtgaaagagccatcttggaagaggatccgcctcccaagttggccaagccaacattttgagtataacctcataagagtctctgagccagaaccacacagctaagctgcagtaactttgaagtaataatgatttattgttgttaagccactaagttttgggataatttgttatgtagtaatagatagctaatacagttgtgcttattacgtttggtactcgttactatcaccaccacatcagtgcattgtagaaaacaaattctatgtattaaactgttttgtttcccctctggattaagctgggctcacaaggggaaaggtgcccaccagagtttttttcttttttatgtaatcaagtttttaaaattttattctattctactttatttttttaagttccagggtacatgttcaggatatgcaggtttgttatgtaagtaaacatgtgccatgatggtttgctgcaactatcaactcatcacctaagtattaagcccaatatgcattagctctttttcataacgctctacctccctcctaccctcccgtaaaaggccccagtgtgtgttgttcccctccctgtatccatgtgttctcattgttaagctctccacttataagtgagaacatctggtgtctggttttctgttcctgcattagtttgctgaggataatggcttccagcttatggatgtatagtattccatggtgtgtatgtaccagattttcttttttcttttctttttttttttttttttttgagacggagtctcactctgtcgcccagctggagtacagtggcatgatctctgctcactgcaacctccgcctcccgggttcaagcgattctcctgcctcagcctcccgagtagctgggattacaggcgcataccaccacgcctggctagttttttgtgtttttagtagagacggggtttcaccgtattagccaggatggtctcaatctccttacctcaggtgatctgcccgcctcggcctcccaaagtgttgggattacaggcgtgagtcactgcgcctggtcagtaccacattttctttaaccagcctgtcgatggaaatttgggttgattccatgtctttgctactgtgactagtgctgcaatgaacatacacaaaattatctgaatgattgcagtaaacatcatatatttgtttgccagctaccataataaaataccatagattgggtggcttaaccaacagaaatttattttcccacaattctggaggctggaagtccaagatcaaggtgttggcagggttggtttcttctgaggccttggcttgcaagatggccaccttcttgctatatctttacatgatcattcctctgtgcgtgttcgtgtcctaattttttcttcttataaggacaccagtcattttggattagggctctttcatatgacttcattttaatcttaactgcttctttaaaagccctatctggaaataaagtcacattctgaggttactgggggatagaattacaacaaatgaattttgggaggacacaaatcagcccataacacatcattgccagcatcacatgtggagcattcaactggagaaactgccctaatttctcatttgaaggtctaaacatctcttttatcaaaataagccaggttctattaagaaggctgaatgtgcatctggctcgatcaacaggcgtctggctgcttcaaatgcttgatttttttcattctcagagaatgaaatcaatgttgaaatattgagtatattctatacaaaatcttcatgtcacaatgaataagaaaagtagttttttttgagacaggatcttgctctgtagctcaggctgcagtttttggagtgcactggtatgacataactcgctgtagcttccatttcttgggttcaagtaatcctcccacctcagcctcctgagtagctgggactataggcatgtgctaccactccaggttaattattattattattatttttgagacggagtctcgctctgttgcccagcctggagtgcagtggcgccatctctgctcactgcaagctccgtctcccgtgttcacgccattctcctgcctcagcctcccaagtagctgggactatagacgcccaccaccacacctggctaatttttcgtatttttttagtatttttttgtatttttttaatagagatggggtttcaccatgttagccaggatggtctcagtctcctgacctcgtgatccacccgcctcagcctcccaaagtgctgggattacaggcgtgagccaccgaatccagccactccaggctaattattttattgtatttttagtagagatggggtcttgctatgttgcccaggctggaatcaaactcctgggcttaagcaatcctcctgccccagcctcccaaagtgttgggattataggcaccagccactgcacccagtcaagaaaatattttctaatactgaatacagctaaagaatggatggtaaaccattattgtccagtcaggatcactgtcatccaagtgggacactcagtatttgagattctgggtggtgctataatacttgttgccttggtatctgagtgagcacttagtctaagtataataattttctggaggagtatattagggttctccagaaagacagaaccaatagaatggatgaatagatagatggatagatagatagaaagatagattgatagggccgggcgcggtggctcacacgtgtaatcccaccactttgggaggccaaggcaggcagatcacgaggtcaggagatccagaccatcctggctaatgtggtgaaaccccatctctactaaaaatacaaaaaactaaccagacgtggtggcaggcacctgtagtcccagctactcgggagctgaagcaggagaatggcgtgaacccgggaagcagaacttgcagtgagccgagatcacgccactgcactccagcctgcgacagaacgagactccgtctcaaaaaaaaaaaaaaaagaaagatagattgatagatagatatgtgagtatgtgaggggatttgttaggggaactgtctcatgcaattatgaaggctaagaagttccacagcaggccatctgcaagctggagatcctgggatgctgacagcatggctcactctgagtccaaaagcctcagaactagcggtgtaattctcagtccagtgctgaaggcctgagaagctagggagtgagggtgcactgctagtgcaagttgtggagtccaaagaccagagagccttgagttgtgacatctaagtacaggagaggaagagtgtatctcagctccaaaaggtagatcaacacattcacctttcctctgtttttgttattttcagtactggcctttggatggcacccacctacatggagggcagatcttccccacctagtccactcacactcatgcgttaatctcttctggaaacacagacacacccaaagatagtactttaccaggtttttaggtattctttaatccagtcaagatgacacctaaaattaaccatcgcaagggtatattcaatctgaatggccaaaattatctgatagagccttcagatacttgtacttaacagatgtactcttgggattaaatgagtttatgctcaagaaatgatattagccaggcataggggtgcatgccgttgtcctagctaccgtggaggctaggacaggaggagcattgcttgagactgggagcttgaggctgcagtgagctgcgatggttccactgcactccagcctgggtgactgggcaagaccccactgcaaagagagagaggcagagagagagagtagaaatggtatctgttattttacattaaaagttctggaataggggagtgctatggtctgaacgtatccctccaaagttcatgttggaacttatgacccaatgtgatagtattaagaggtggggcttttacgagatgactaggctattagaggcctacccttatgatgaatgaattaatgtccttatcaaaaagattccatttccactatgctgagagcggaaaacaaacaaacaaacaaacacaaatgaggttccacacagcactcatcctttttgcccttccacccttctgccatgtgaggacaaagcagcaagtctccattttggaagcagagagcagccctcaccaaatctgaatctgttggtgccttgatattgaacttcctagcctctagaactgtaagaaatgtttctgttttgttgttgttttttccgagacgaagtctcgctcttgttgcccaggctggagtgcaatggtgtgatcttggctcactgcaacctccgcctcccaggttcaagggactctcctgcctcagcctcctgagtagctgggattacaggcacgtgccaccacgcctggccaatttttgtacttttagcaaaagtggggcctcaccatgttggccaggctggtctcaaactcctgacctcaggcgatctgcccacctcggcctcccaaagcactggaattgcaggcacgaaccaccgctcccagctgagattttctgttctttgtaaattacccagtctcaagttattttgttatagcagcaaaagcaaattaaagaaggtataatatcaggctctcttctgattccctaggctctgctgcacgaattgttatttccagaagttcccataggaagttctcaggaaatgaaatggatatgaggtaacctcatgtcggggagtcagtctatggaggatcataatcatacaacaacatggtccacccttgctataatctattttttttttttttttttgagacggagttgctctgtcacccacgctggaattcaatggcgtgatctacgctcactgcaacctctgcctcccaggttcaagagagtctcctgtctcagcctcctgagtagctgggaccacaggcacacaacaccacacctggctaattttttggatttttggtagagactgggtttcgccatgttgcccaggctggtcttgaactcctgagctcaggcaatttacctaccttgccctcccaaagtgttgggattacagtcgtgagccactgcacccagctgttttctgttttctgacttttatttttgagacagggtctcgctctgttgcccaggctggagtgcaatggtacaatctcggctcactgcaacatctgcctcccgggttcaagtgattctcctgtctcagcctccacagtagctaggattacaggcgcctgccaccacacccagctaatttttgtatttttagtgaagacatggttttgccatgttggccaagctgttctcaaactcttgacttcaggtgatccgcccaccttagcctaccaaagtgctgggattacaggcacgagccactgcgcccggccttgttttctgttttgtttgtttgttttttaagagatagggtcttgctctgtcagctaggctggagtgcagtggcacaatcagctcactgcagccttgaactcctgggcccaagaaatcctcccaccacagccttctgagtagccaggactataggtgagcactggttaaatttttaatttttttttgtagagacagagtcttgctatgtagtataggctggtctcaaattcctagcctcaagtggtcctccagcttcagcctcccaaaatttgggaatttcaggcatgagccactgcatctgaccgtacaaaatgttaataaactggccaggtgtggtggctcatgcctgtaatcccagtactttgggaggctgaggcagggagatcacctgaggtcaggagtttgagaccagcctggccaatgtggtgaaacccccatctctacagaaaatacaaaaattagccaggcgtggtggcccatgcgtgtaatccgagctacttgggaggctgaggcaggagaatcgcttgaacctgggaggcggaggttgcagtgagccgagatcagagcactgcactccagcctgggtgacagagtgagactccgtctcaaaaaaaaaaaaagttaataaaccttttactcctggcctcaagtgttccggctgcctcagcctcccaaaatgctgggattacaagcatgagccatttatttttctttttttgagacgggagctcactctgttacccaggctggagtgtagtagcatgatcacaactcactgcaaccttgaactcttggattcaagtgatcctcatgcctcagcctcctgagtagctgggactataggtgcacactgacatgctcagctcattcaaaaattttttcataagagatggagggggggtcttgctatgctgcccagcctggtcttgaactcctggactcaagcgatcctcttgccttggcttcccagaatgctaggattacaggtgtgagctactgtgcctggcttttgatttttagacagggtcttgctctgttgccgaggctggagtgcattggtgtgatcatagctcactgcagccttgaattcctgagtttaagtgatcctcctgcttcagtctcccaagttgctaggactacaggtgtgtgccaccacgcccagctactttatgaacgttttgattccaaagtctgaaaaaagttttccagattcatctccaggtcaaataatgtccctgctgtcaggcatcctgctttagaagcaagatgtagcatttttcttcctttacttgcagcaggcagctaataactgttatcctgtgctggaccatccatgttctacgcattctaacatgtgctttacataaaaaattagcccaagtgaccctcactgtgacattacacggtacgtattattaatctttttttttttttttttttttttgaggtggggtctcactttgttgccaaggctggagtacaatggctcatgcctgtaatcccagcactttgggaggttgagttgggaagatcccttgaacccaggacttcgagactagcctgggcaacataggaagacccccatctctagaaaaaataaaaacatagccatgcatggtggcatgtgcctgtggtcccagctacttgggaggctgagaaaggaggatcacttgagcctgggaggttgaggctgcagtgagccatgatcatgctactacactccagcctgggtgacagagtgggaccctatctctaaaaagagagagagagagaaagagggagagcttttaaaaaatggcaaaatgtgcccacagctgatgggcctatttttcttttttttttttttattgagacggagtcttgctctgtcacccaggctggagtagtggtgtgatctcggctcactgcaacttctgcttcccgggcttaagcgattcccctgcctcagtctcctgagtagctggaaatacaggcacccgccaccatgcctggctaatttttgtatttttagtagagacagggtttcaccacattggccaggctggtctcgaactcctgacctcaggtgatccgcctgcctcggcgtcccaaagtgctgggattacaggcgtgagccactgcacccagccaatttctatttcttatagagcttacggtaggaggcttgaagatgggaacagaagaaaaaaggttgaagggcccagctgctgtgtgttgcaagacaggaaattgctgacagtctgcaatgccagcagcctcatgggtggttatcaccaggacagaggcctcagaacaggcaggactgggtgtgctggcactcacggctacgtgcagatagagcccgcccctgggccttggtgtgtgaccttcttcccaggtgcttctttgggaagctgtacagtgagggagatgaggcagactaagggcaggacacactagcataggagcggtggcagctaagtaggctgactgcccagggattgcagagttcacctgcacagtatgacatctctcatccttttggatagattgttctataaggtggcctccacctacccccaactcccaaatctgacattcattcatctacttcccctgaagtgctccctagcacttgccatgagtttgttcactcttgggaccccaaatccaaggcatctcactggctgagattcagtttaccacctcattgatggggggactcttatgtcacagaagtaattttctcactgataggacccaagatgtcgtcctatttttaatgtgggtacaaatactaagtaaatatgatcttagtgttttgccaaaaggaattaagatgtttttaatgggtcacaaattcagaaaggggttggacctggtgggacaggttggtgaggcccagaagctccacttcaagtgcagtactggacatccccttccagtacgggaggtctgacttgtgcagtcaagcccaatactggcacagccacaggccagggatggaggcttatgagtccactggaaaacagggaggactgagtccagggtctcaagggtttagtagtgagggctcctgtgaagaacccttcactcagtggtgttcattaccggccccttccttagtatgttccaggccctgaggatgtaccttgcatgctctgaccctttgaacaccaaagaaataagcaaggagataacagatgccccaaagagatgaatggtgtcatgagatctgggggctgggaccttgtccagcctaaaggtgtaagtaccatggatgagcagtgtcttatttaatcagcaactagagatttcctgaggtttaactgggaaagcaggttcatatactacaagacaccaggtgcttcacattgcttctctttattttcaacagtttctttacaacagtctacacagggattaactcctacatgtacttcccaagccagaatctccctttagaaattcagattctatttctaactctataagatgtatctccccaaagatcacattaactcctcaagtcaacatctgcctatccccaacttcccctttttttcctcactgaacatttgtctgaatgttttttcctcactgaacatgttttcctcactcacactgaacatttgtctgaaactgtggctgctttgttgcttcaagatgcatgcacatcctggctttagtgtccaagtatgcagaatgaagcatttgatatgtgcacccagctagttaggcatgaaacaggggcacaggatgggctccgggtcatagaaggttctgtccccacagtgaggacaggggttggcactaagccagaccatgctgggccgccccaactcacacagcaactccctgagcctggcatgcagataggcaagcctctccaggtggagggtaccatggatgtcctcataactctccagggggacaggatacagcacgtgggtcagattgctcagcccgatgaggtgctgcaggagactctgcaaggcagatatggagatggaattcccgtagaagcttaaggttgtaagctgggagcagtggctcagggaaggcaggagggcaaggagctgatcatccgtgatcccacactcatcaaagaccaggtcctggagggtggcagaggctctctccagcagagcttggaggggctcgggacttacatcggtcagcatgaccccacttagactcaggacacttagctgactgacgctgggactctgggacagatgcatcacatccccttccgaaagccggcagttagttattgagagggtttccaaggggttcatcacgtgcctgcaaatagacaaagcagttagtgctggggaatggtggtagtggggtggggagactggagagaggcccatttcaccaaaacccaaagtcttcctgatgatggttaaccgccaggatgccatgctgtaaaggagcattcaaggagtacaagttcaggtttagtcctttctccatcatttgctgtgtaagtgggtcaagtaaacaaagatctcaaacactcccttggctgatctgtgaggcagggtccaacacagacctcttaggtggtgtgagcatgaattgaattgagagcctgatttgatgtctcaagcaaggaaaggcatcagtgaattttagtatttgaagatacaactgaaaatactttctttcaactcgggcttccttctgccactgcctgggccccagtcacctctatctctgtgcctgatgaagctactagggagtattcacagtggacaaactggggcaaggtcagcaacatccaaagggggttcccaggctgcagggctaccttaggtcactgtatcatcagcaaaccacctatcaatttttgcaatttctctgttgttccttctcccacatctccagaatcctgcatttcccacctattaccctaactggaattctaaatcaccctttacagacaggaaatttgaggcaggtttagagggagcagctcatgttgagaagctggtgagcgcacagcttacaatttcaaatctcacctttgatgggctttcccttcttcaatgccctccttgcttacttttgatcatcttaggcatcacttcctaaggaagaatgcctaaagccacccttgccaggccccaacctcccattacagagttttctaacaaggagtcactgttaatagcatctatcctaatgtatacctctaacccttatgagtagtagttatgtgataccatgcttggggacagtggtgaacaagacgtgttaactggtagtgacttgctcactcttgcattattggtggctggcacatacaagatatcctttattgtttactgcaataaggaagggcttgctctggtctgcagagaaatctcaccatccctcacctgagcaactgatccaggcggcctctaaggaaaaataaagagtccacatagagagcctgcaggcactgcagactgaggaactgagaggtgaactgggcgatatactgctcttccttctccggggaaatgtaggaagatgcatggatgtgggagaggaggagtctacgcagattaatcatctggcccaggtaaggagaaaatttcgccaaggtgggtagcttccaggtacaagtcacttccaaatcttcaatagagtccagctgcaccattttcaggatcatcttgatatcctgcatgggcattgcaaaaatcttcagcttcttacagcacaggcgtagtacatttttctttcgcttcactttctcaatgaggtaggagaacaattcatcacaggcaccttccttgaggaacaggtctacgagcacctctactggaatgaagggctgctctgcctctgtgctcaaaccatctacttttcgcttctttgtcatgggctgagctgcttctggctctggaaatgagtacagactggccctgtttccagaccatacagtccagaagtcctgatgagagttcttccgtaaatccagcacttgaagtttccacctcctgtggggaaaaacaggtaattagctgagatgatgctttaagatcaactcaaaataagaccatgagtctcataatgtaggtaagaaccaaacagacatccaccttagatctgcacttttacttcgtacttcaggcatcagctgctccctttcccactaggatcctgggatccttcctggtccccaattcccaccccaccaggaggaagcaggtgcatgttccttcagacacctctgcattttaatcagtgccccatgtccagaagcccattccaagagtgacccctgcagtagccccaaggcctccctgaacttccttgctggcaaccatcagagcctctggcccagccttaggcgctccatgctccctgaccccagctgcatcctgctcaggttcccagggccccacaccaagctgctaggtcacccttacctggggcgaacctcctgggcaaggagcacatcaagtccatcaagcacagctttgaaggtctccaggtgaagatgttgtcccttcatcagcactcccagagggaggcaggtgaagggccaggcctgcaccattgccttcagggtctggctgtgtctcccgtcaaaggctgccatgaagagtggcgggaagagctccctgggcagcaactccagggcggcaatggccagggcctcatccttcagcaggctctgccctgccagctccacaagtctccgtgggcttgtccacacactcatgctgatgtatcggctctgaatggaaccctgaggaaacatacagggaacaaggcatccctttcagcccaagcataagcaactctatcttttcctcacccttctgagggaccaacttagggccaaagtcactgtgctagcaacagcaggggagttctcagtttaccccgattccactctgcactcggtggccacaaagccacagctctgctggcaccaggatgaacatctcatcaagtgtagaggaggggacaggacggccactggcaccatcttgtatctacccactactctatttaattctagtccccctgggaagtgagaactaaggagcctgagggctgaccctgctcattttgggaaaaagtttctgatgatcactcaaaggcaattcaaatgggagtgtcacatagcccaggacagcatccttctctgctccaacaaataagccagatgggaaagatgaggaacacacacacaatgcacaatggatgccattatgtttcactaaaaaattttaaatgagaaactacagaagcagcacaacagtattacatagcaattggaagtacaataaaaaaaaaacattctgagacatgtattttaagtgcgtctcttttacgtatattaagagttactactttgacatggaaatcagcggagcaaacacttcacagtaaaacaaagcctggttcttttctcccaaaacattagttttaaaatggagaaataaaaattgtgtatatttatggtgtacaatatgatgctctgaaatatgtatacattgtagaataggtaccttaagctaattaacatacatatgatctcacatatgtgtggtgagaacacttgaaatatactcttagcaattttcatgtatacaatacattattaactacagttaccatcttgtatactagatatcttgaaaaagcctccaccctccagcacagtggctcatgtctgtaatcccagcattttgggaggccagggtgggagaatggtttgagcccaggagttcaagaccagcctgggcaacacaaggagacctcatctctattaaaaaaaaaaaaaagaaaaaaaagaaagaaaatgtctttaattccaaagcatctgaaaagaaaaagaaaaaaatctatggaatattttttaaccttttagttaaaatggaatattttttaaccttgtagttaaaatggaatattttttaaccttgtagttaaaaaaaagcctaactagtaaatcactgatttaaaaaatcataaatgatgcaaattataattgcttgccacatactatttaaattgtaataaagtaaaattcaaagtagatgtcttttattttccaaaaaaaaaaaaaaagccgtttaagaaattatttttaacatatacaaaatggcagaaatcaaaatgtttgggattcaatataaataataaatgttccaggtaatggttatactaattaccataatttgatcattacatactatatatgcataaactgaaatttcacatgtaccctataaatatgtacaattattgtgtatcaattaagaaatcaatccaataaccaaataaaaatgtttgggattaaggcaaaactacatttagagacaagaacaaagcctgttcctttgtaaggaaagaaaaaggaaaaccatctaagcagcattggccctcatggcccgtggagaccctgaggtgacagtagaaggaggcagtggccatagcctgaggctcccgactcaccagacccagctgtggtgcagaagccatctgcccagacctctgggaagaccacaacattgactccatggcctctgggtccctcctctggcccctctgaagctattacaggcctttctgggcatacctcccctttcaactccacgctgccaacggaagagccaaatctaattacattcctggatctccagccagtgaatcctgatggggttttttacttacttcaggttcaactgattgaatgggatgtctatttacaaaaaggaaagaaaaagtgaacaaaaccacccagagagtataactgttaggggaatttttggccacatcaaaattacccaaatagtccagttaagatagctttatgaagagcatcatgacatcaccccttcccactcccaaacaatccccaagtatcaaattgtcacttataccccatgttccctaacacagcaaatcacatgcctatccaaggaaaaagggaggaacaacagaggggtggctggtcttccagactttgaaagtcaaggctgtcctgaaggaaggtgggtcaaaattacactacaattaggagttagtcagaagtaaggctgggcatttgtaatgggactgagtggattaccacaaagacagataggtttttttgggggcggaattgaaagactttggcctggatggagtagagaaattaaaaaggggaatggctaaggaagatgaaagatagttccagtaaagccaaggtaatcactgaggcagggagggagttcaatcttcctccctccctagagggaaagggtgttttctcccagaaagtcaggatcctcttggcaaacagccttgacaagattaaatctaggaatgtgggctggagaggtgggatagagagtaatattggtgaccaaacctaggacagcaacattttcaagtctgaaagaccttgtggtttcttaggaatcttggagccaggaaagaaataaacaagggctgaaagcacacatccctgcaattaaagaagttgtcagaagaccttctctttatggttaggtgtcctcttccacactggggctgttcacaagcagcaggtcaggcctttaccacaaacataatctccaatggccagccccttcctaagtattactaatgtttccacacttcaagaaaacagctgttctttcttgcccctaagctgctcaggtacagagattctggtcagcgagatgcaatcaggcctatcaattagactcagtttttctctatttccatgctaggcacagtgcacaaatacattttccgtcacaaaaaattgaagttatatttggcatttaaggatctgcttagggatgattcctatcctgggcctgatcacccactggtgcttttgaagttttggaacctctccacccaaagaattctccaggccattctctgcctcatgcactgtgaagtccctacaattcttatattctactggcaagtgtccagctggaatgtcttgcggcctgactttgtttactgtggcctgcgtaaggaggctgtaattcgttgaaggatgttttccattttggttctctctctggagactttctcctacttttcaccctcaacacctaatggcctttgtgaaaaccgggttaaactacaatttgttctacatttcctttaattcccaggcaatcatcttcactcatcagctgcgggagactgagattagtaataaaggtcattgtcaatgtccctaattatcaagcagctactgggcacagcaaaggccgcagcagctctcattcattacctcaaatagccttcacagagaatctaaagttcactgtcattttcatttttagtcttgtaagtccctgactctgtctggggaagaacctgctcagctccaagcaagcaggaattggtagcccttatgtgaggagtttagaaagagtttcatttccctccctatcaaacaatctaagtgttagaaagggctgataagcttcacataaaccatggaaaaacaggaaaactgagtaagtccaacagttaaggaagcttccatgggatccccgcttccaggagatccaagggaggaggaggaaccgcgatcaagtgtgagttgtgtaatctctgagctgtgcaatctccctgtgaggcagtgacactcctctgtccagcttcacactgccagtttgtccagtggcactggaggaagcagcaccaggggcacatttgcacaaaggtgctgtccttcctcccagtataagggagaagtgaaaagactggggcccagcatgactcctagggtccagacatgaattggggagatatttctgcatgtcctgtctactggttcttatggtccttgtgggctgcacaggccagagtggcctctgagctcatcaggtgggtggtctgcaccctcctctctagtcatagaatcccagtggggacccccgaagtatctgcaccaggtccttcaggtgttttttttggagtgcagtggcgcaatcttggctcactgcaacctctgcctcctgggttcaaacgattctcctgcctcagcctcccaagtagctaggattacaagcacacgcccccacacacggctatatttttgtatttttagtagagatggggtttcaccatgttggccaggctggtctcaaactcctgacctcaagtgatctgcctgtctaggcctcccaaagtgttgagattacaagagtgagccaccatgcccagcctctttttcttttttagagacagggtcttactatgtttcccagactggtcttgaactcctgggctcaagtgatccacccatttcagcctcccaaagtgctgggattacaggcttgtggataccaacagcacccgagcacggtcccacagtccaacgcactgtgccgtccttgagcctttagttccagcacaagtctcccggcttcaacccaggttgcatgttctccctgatctccccaggtggcacccaaggatgaggcagtgcaatcttgttgctcacttcccaggaccgacacttacccctaatggcccaagcccatggggcagtgagatcaaagcctcctggagctcatactctctgacaccactggaagtgtgggcttttgcgtctgattaccccggggaaaggttctgaatgtaatcgtggctttggcaataaggtccacaatgcattaagatttttttttttttttggaggaggagtttcactcttgttgcccaggctagagtgcactggcaccatcttggctcactgcaacctccacctcctgggttcaagcgattctcctgctcctgtctcagcctcccaagtagctgggactacagatgtgggccaccacgcccagctaattttttttctatttttagtaaagacaggatttcaccattttggccaggctagtctcgaactcctgacctcaggtgatctgcccacctcggcctcccatggtactgggattgggattacatgcatgagccaccatgcctggcctagggttaatttttatttttggagacggagtctcgctctgtcgccaggctggagtgcagtggcatgatcttggcttactgcaaccttcgcctcctgggttcaagcgattctcctgcctcagccacttgagtagctgggactacaggtgcatgccaccacgcccagctaactttctgtacttttagtagacgcggggtttcacagtgttagccaggaatggtctcaatctcctgacctggtgatccgcccgcctcagcctcccaaagtgctgggattacaggcatgagccaccgtgcccgaccctagggttgactctcatacaaagacagcacgggaagtgaaatgctcttttgtggaaatgaccagaaacaataaaagcggctcctgcctcttcgtctactgtgagggacctcaggatgcagctcccatctggctcgagtgacaaggacagaggggaacagggcttctctgagcacctcagacagctcaggggaccttcttacccacaaacgccttcgttccattttgaagcgacttaggctggcctcaggacctccaacgcttggatttctaggtctcagtcacttgttgccacgcacgtctgagagtaataatcaaaatgctccaaaaagaagaatacatgtataatatttacgaagcaacggcctcctgtgaaaacctccgcaaatactgctgaggaaactgacaactggcgactcaatcccgccctttcagtgcaaatctctggctccaaacctgagcaccagtgtttcctgggctgaaccagggggcaggaggaacaacagaccatgtggttggtcacaagtgacccctgtggtcaaggaccctgactacggtcttgcagcgacatttctgcctctgctcccgccttcctaggacgcctacgccactgcctgggccgtccccaacccccagcaccttcagaggggccgagtcccagagcatccaccgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggaggaatcagggctcgaacttacgtttttcctcagagagttcaccacaccgcgaagttgctggaaggaaagaacgagacaatggctcagctaagcgccctagccgctgcgtggggcggggggggcggcggtgggggccggggggctgggcagcctggtctgaccaatccccgtttctcagtccttccagggcaaaatctcacgagatccagtgaggtcgcccagagagtcgagaggggcttgttttcaaagactgggaggaggaggggcagtgggggaggggcagtggggggaggagcagaggagaagggagcaggaggaggggaaaaggggagaggaagttggagagcagaggaggctgggggtggggagcagatgggggtggggaaggaggggagatgggggtggggaaggggggcgggaggagggttaggaatgggggaaggaagacagggtgggggaggggtgggcatgggggaaggaagacagggtgggggaggggtgggcatggggaaagggagacagggtgggggaggggtgggcatgggggaagggagacagggtgggggaggggtgggcatgcgggaagggagacagggtggggaaccgagaagaaagacagtggggggggatggaggaaggaacacagggtggggtggggggtcgggatgggggaagggaaacaaagagtggtggaggcgtggggattaggaacggagacagagggtgggggaggggtggggtgggggaagggagacagggtgggggaggggtgaggatggcggaaggtagacaaggcgggggaggggtggggatgggggaagggagacagaagggggggaggggtggggatgggggaagggagacagaaggcgggccagggcgggaatgggggaagggaaacagggtgggggtggggatgagagaagacagaggttgggggaggggtggggatgtgtaagaaaaacaaagggttggggagggggagggaaaagaggcagagagtgggggagggggtggggatgtggaaagaaagtcagaaggtggggggtgaggggtggggatgggtgaatacgtgatggctgcggcctttcccaccagacagtagggtgggggcagggtggaaaaagggggtgcggtgggcgaatggggaggcggggggctgactgggagtgtgggacggggtgttctgggatcacggagacgtccaagtctggactctgtcctgggtctgtgcttctggcgacctcccttttcttcagtgggatgcggggtgcaggggccggttccaggtcccctgagctcaagtctcgccccaccccgccccgcaagtctagaaaagatgcccctgcccttggctgggtaatctctggatttacctactgtctgtaaccccccgggctgaagagaccaccccccgggagtcaattaacttactctctggagcgcgcgttcctccctgctcccaggagtcggtttcccaaaactttctgaggcccgcgcatgctcccctcgactccccgtgtttccactctccacagaaatccacgcattcacgcccctcccctcccccgagcctgcagaggactccgccctgctttccctacattcagggctgctccttttgtcgccaatacaaacctgttgacaggtcacgcctgggaagcgggtggggtgtcccggagcggtgctgaggcgctgcaggcccggcttctggctgcgggggagctgtaccctgaagcctcgccggaactcgcgtctggggccagcagggggcactagagtcaacagggactgtatgcaaaacccacttcctcccaggccctctagggggatggtcaggcttctgcagagatggggaggatcctttcctggtaaggggagagggacgggctaggagccaagcggaaggaccccgtgttcaaggcccttcaagggacgggacaggcgaggaatctctttgagtcttttgaattgttttatcagtcaggcctgggaagtactccgcctccacaaactctgttttcctgaaaggggtcgggggggggaccccaacatctcctgccacaggctatgatgggcatggtggctaagagcaacaggccgcgtggtgaggctggctttttgtggctctgccctgccattccccgaggcatccccatgccagtgaacagagctgcgggttcccagctgcacagatgaatgcacgaacaaaacataggtccatacaaaggaagtcattgcattgatccagattcgacctgggattgtcgcataaaacagggctgataaaaaccgtcgtgttttcaccctggaaacagagactcagcctccccctctttgcttgaggcattcagcaaaggtttgtccttgagtggctgtggatgctcaaggacttacgatttctgactttataaagtttagggtgaaaacaaaaaacaaaataaggagaccattgttttaaagtggccgttgtagctaattatctcaagaaagcaaacaggctggtactgaaagttacacaggcgggcggctccctgggagggttgcccagctctccttttctgagacctgagcagggagcagccagaggagcttgaagggatggtgttcagggcatgggaacaggctgcacacatcttcacggagtacggtgcttgtccagtttgagaagggaaagaaacgggagcagagggctgatgagaaggcagcagatggatagtgcgggattgaaaaggggatccatttgaagactggccaccattatttattttcatcatctgattgctgttgctccattgagatcgatgcgtggagaacaagttggggagtggaacaaatggcagggaggggagagaagtgagtgaacatgaccctggtccagcctcataggacagagcgtggtcatgaagtccacagaggaggacaggtagggaggaatcatggcatggccaggttgtagggcaagaggcagagaggagagaggattgtggaggatgcctgcggagtgccgactgtcagtcgaggctggtcctttatttatttattttttttttttgagacggagtctcgctcttgcccaggctggagtgcagtggcgcgatctcggctcactgcaagctccgcctcccgggttcatgccattctctcgcctcagcctcccaagtactgggactacaggtgcccgctaccatgcctggctaatttttttgtttttaatagagacagggtttcacgtgttagccaggatggtcttgatctcctgaactcatgatccgcccacctcggcctcccaaagtgctgggattgcaggcatcagccactgtgcctggccaaggctggtcctttcttttatggcgatgggtgtttgaaagttgcacataccaaaataaactcactatttgttgacccaaagtaaaaccctgagggtatgaaagggaagggctcatgcttacatggctgagataaaagctgtctcaggaagctgggtgtggtggctcacccctgtaatcccagcactttgggaggccaaggttggaggatcccctgaggccaggaattgaagactagcctgagtgatatagcaagaccccatctatatttttaaaaagggttggctgtctcgggacttttcgaaatagccctgcaagacattcctgttttggaatcacaacaatttagataagatgcttttgaaagaacacctgcctaggcacagcgtctccaccaatgaactgatgccaactgtggttttgagtcttcataaccggtgaactgtttgcaagcagcttatttaaatctctttttttgccaatacaaccttccctttgccctcccctcttgagatgcatatatggcttgccatagctgagcatcttaggttataatgctttttctcttttttaatttttttttgtaaatttatatttatttttatatttatttattttttgagacagggtcttgctttgtcacccaggctggagtgtagtgcataatcgtagttcaccactgcctccaactctcgggctcaagcagtcctcccacctcagcctcctgagtagctaagacaacaggcatgcaccaccatgcccagctaatttatgtatttactttattaaaaattttttttttttggtagagagagtctcactgtgtttcccaggctgggcttgaactccaggcctcaagtgttgctcccaactcgacttcccaaagtgctgggattacaggcatgagccaccatgcccagcgtataattttgtattctaattcctgaataaattcaacaaatttggaggtgttttttgtctgatggttccttttggtcgacaactggaatgggagaggaacagtgtgagggcaaacatcaagtgctttgctgagctccgggtgctttttttggataagacacagaaaatacaataagatgtctgtaatgtttgatttttttccaggtttcttgaggtataattgacaaataaaaattgtatggattcaaggtgtacaattcatatacattgatccacatataccttgtttgatgattaatcaaattagttaacacatctttcaccccagcagtcaatgtgtgtgtgctctgttagcaaatttcaattaataatatagcattattaactatagttactatgctgtatattagagtctcaggatttaccatcttataactaaaattttgtagcctttgaccaacatctctcattcctcccacccacagcccctgggaactaccattctactctgcctctatgagttccactttttgtgtttcttttttccctttcctttaattttttttgtatttgttatattaccaaaccatgtcaaaagagttccactttttagattccacatattattagctcgtacagtatttgtctttctgcatctggcttatttcacttaacataatttcctccaggttcattcgtattgttgcaaatggcaagattcccttcttttttatgactgatgatgtctgtctgcaatatttgaaaaaaaaatgcagatcacgtgaatgattgtctaatgtaattctattcatgtaaaattgtgtatgaccataacagtcactcattcattgcttcgagttctttacaatcggatgccatattcctggggctctgctaggcctgaaatggggagtaggagttacaaggttcctgggatatcagtaattcatatttgtgaatgtcttagataagtgggctaacatgtacagaaaatggtcactaaaatgataacactgtttgttataaaatacttttctgtattctcttgaactttttttttttatcatttattagactgcttcagctgccataacaaaatatcacagactggatggattaaacaacaaaaatttatttctcacagttctggaggctgggaagtccaagatcaaggtgtcagcaaggtgggtgtcattctgaggcatcttctcttagcttataggctgaggccattttgcgttgtgctcacgtgacccctttgtgcgcatgtgtggagagagagcatgggtgcttcttcttataaggatgctgaaagttatgagaacccgacccttgtgacttcacttaatcttaattacttccttagaggccccatctccatatacagccacaatggggattagggcttcaacatatgaatttgtggtggggggacgcaaacactcagttcataaacatatgatttttttttccttgatcggcaatgaaaatagaggtatcttcattttggaaagtgagagtcaacctgtgctgaattagagtgatgacaagagatactttaagactgcaatgagggaagcaagggatggggacgcatttgacagtctgttctgctgtgctcctggaagtgagagaggctgagtcgggactaacctttgcacggatgagatagagaactgagagagaaaagtatgtatttttctatgaccacctaaaataaacctggagttgaagggaccagcactctcaacctaaccattctgggaataaaaatcatagagacctcgctgattaatggaaacaatttgcctttcgattttctaagcaggtgaatgcaaggagtttgtgaactttactgctgttttcgtgtttttttaggtgaagacactgacagtaagaaaaggcaaaccacaggtccaagacaaagtggtcaagtcaagaaggaactcaggctgtgtagtcctggtgcaaggctccttgcccccagcgtggggtcacactggctggctgtgctcccacgacacttagtgcatactgggctcctgacttaataacacgtgtttgaaatggcccctgattcccaatctgctgcaggattctgcagatgcgcaacaggccacagtggaaggtcttggagagaattcagagtggcttgcctacgttcccatgaccgtttgtcctaatgggagaatcaccattttggaaaattcttttggaggccaggcgcggtggctcatgcctgtaatttcagcactttgggaggctgaggcaggcagatcacctgaggtcagaagttcgagaccagcctgggcaacatagtgaaaccccatctctactaaaaatacaaaacttagcctggcatggtggtgcacacctgtagtcccagctacccgggaggctgaggcaagagaatcgcttgaacctgggaggcagagattgcagtgagccaagattgcaccactgcactccagtctgggcaacagagtgagactctgtcttaaaaaaaaattcttttggggctagctgtgaatgagctcagagggaaaggcaggagccttcaggtagggagcagcatgattccaccccagattcaggcctcctgggtgtacagagggcaggaggatcctccccaggtatgtgagaggaagggaagatgaggtgtttgggtcagtgaacacactagaaatccaggtgctcactgatggattgtgcttggcatctctgttctgccaatccagcctcaaagcaactttggaagaggatttatgcgcttcacacgcttccagcttgggccagagcatctgcacactcccctgggtataggcctccagggcttggagcaacggaagagctaagaattgtcagtgctcaggaggcagattttcagggaggatcctcttgcatctcaggacatggaaagggctaacagagccttaagtgtcctgtcccagtgctggggtctcagaaggcagctctggggcatctccaccatggtctgacttctgctgcttgaaaccattctccctcacggcacaggcaagagtcctcaaggaagagcacctgggcacctgggttgactcttcctctctccaggtggagagaaccagtagagtttacctggggtcatgctctgagttaatccccctctgcatttctttctcttctcaggggcctgggctcagccttgactcagccttcctcagtgtctgggacttggggtaaacagtcaccatcttctgcactggaagcagcagtgacattgagggttctaaccatatctcttcgtacctacagtgcccaggaactggccccacactcctcatttattatgtccattctcaacccttagggggtcccagcttgattttcagtctctaggtctggcaacacggccttcctggccgtctttggcctctagcctgaagatgggcctgacagtcactgtttgttctgggacaaccatagcatttttacccacatgtgctccaagtccacggggaacagagaccaaatctgccatgagtgaccagtgtcacagggcttcacaccagtcaggcagtcagatggtggtgtttgctttcatttctgctcatcatcccaagggggtggacgcttcaggaatgggaccctatgcaactctcattgctctttataatgatgtgggaaagagaaaccatctcccaggggacttggctttgcaaaaatgaaaataaaagctccctcctccctctgtgcagtgaatggcctctgaatgcagacttggtctccctcttcagtggcaaggttggaggaagaacaacagcttcttattgcactgagacaactcaggggccacctcatttgaagatgtgcatcagtgtgagcccaggtattcctgtactcaatgatcgaggtctctctccttaccttgtctccacctggatctgaccaaagtgactgagatgatccaggttctagttttctcttgctgtgtaacaaatttctgcaaacctagcaccttaaaataacacccatttatgatctcccagttttcctggatcaggagtctgggatcagcttagctgagtcatctgttcagggtcttcccaacctgaaatcagggcattagcttggctgtgttttcatctggaggctcaactgaggaagattctgtttccaaacttactggcagaactcacttccttgctgctatatgactgaagccaaggttttggggggctatttgccgtcagtgcccgaagctcctagagttcctagaggtcacccatagctcttttgccatttaatgtaacctaatgaaaagagagatattccatcacctttgccatatttattggttagaagcaaatcacaggttcttcttgaattcaagtgaagagattgtgcaagggtatgactcatttggggtcaccatagggtacatcctcagtaattgtgtgcagtcaggactaggggaggagattctaattatacagagaagacttgtgccttctattcagaagttaagaagacatcctttactttttaagacactctgtcattttattcattgatttttagtggtgttctagaaagcagattttccaagcgtaaagcacaataatgaaatggcagagctgatgacagttcagatgctattagatgggtgtgcagatctaggtttagagccaagggatggagtagtgtctcttggtctccactgtggagaggccccttgggaaaacccaccacccccatttctcctcactccctgcctggacccatggtctctgcttggtctggcctatgctattaaaaatatacttcaatgatgatacttatgtcttgtgtttctctacactctttgtctatttgcagtggacagcacactgcatgctgatatcaaaaattattccagcaaattcaaaaataagacagtaaaaagaaataaaagacagttttacaatggaagagacagaaatgaatagttgcacttatgtttgatttagctgttaaatctaagagaaccaactgcgaatgagtagagaaagcggtcgttgctgcatactgaccattactagtgtgagatactgggggagctaggatggcctcctcttcctcttccttctcttgcctctcctcttctttcttttttggtaaatatctttcctagatcagcggttctcaaaactttcggtctcatgacctaatcacctcccagaggccctacctccaaataccatcacattaggggttaggtttcaacatatgaattttggggggacacgaatatttagtctagaatgctttttcaagaaaaggaggacagaaagatcatactacagtggcttttaaaaattagatatggacagcttttgtttctggaatatgtcagtgtgctgttgtgcaaagcatcccgggaacaacacctcagaatgtttcctttctgtgcctcagtaagacttgaaggctggtagggtagcctgagtcgtggctttcaatgatattcaggtcctaattcctgggacttgtgaatactgcctgtctttgtccgttttgcattgctgtaaaggaataaccgagtctgggttatttataaagaaaagagttttatttggctcagggttctgcagactgtacaagaagcatggtgcccacatctgtttctggtaaggacctcagaaagctttcaatcttggtggaagggggaggaggcatcacatggcaaaaggcagaacaagagggagaggagaggtgccacattcttttaaacaaccagctctctcatgaatgaactcactgatctccacagggagggcaccaagctattcacgagggatttgcccccatgaccccaaaacttcccaccttctttttctttttcttttttttcttttctttttttttttggagtctcgctctgtcacccaggctggagtgcagtggcgtgatctcagctcactgcaagctccaccttcccggttcacgccattctcccacctccctagtagctgggactacaggcacccgccaccacacccggctaattttgtttttgtatttttagtagagacggggtttcaccgtgttagccaggatcattctttttctttttcttaacctctgggagcacagaacataacataggatttggaggggacaaatatccaagctatatcattactttatatgagaaaaggggttttgcagatgtaattaaggatcttgagggagacattatactggattatgcaatgggccctaaatgtagtcacagatgtcctttcgagagggaggcagggggagatttgaggacagaaaaggagacatgaacagcggtgggatgatgcagctacaagccaagcaatgccagcagtatctagcagctggaagagtcaaggaaacagattctcccctgggacctccagaaggaaccagtcctgctgataattttatttcagttctgtaagccttcttttggattttagattctcagaactgcaagaaaataaattgctgttattctaagcccctaagtttttgacaacttgttgtagcaacaatgggaatctgatatagctaaggtaccatacattttgacatcttctctatatatggtaccattctgatttgtactgtgcaaggcttccttgccctctcactggtaaaccttggtatgcaggaaattatttttgtacattctccagtatattaactttggttataggtgatacattatatctattgcaaattatcattttgtctcctaatttgcatcaaccatgctgcttgtgtctatttatgactgattgtgtaggaaaattcttcaagaaaaaatcaaataggatggtaattcctgcatcttggaatgcctaaaaatcttctggcaataactgattacatagagaaaccatctgtttacttccttcaggaactacctggcaccttctagtgctttcccttgtggaccacaggtgatggaggctgggccctaatccagcacacacctccagtctagcgggcttctggtccagttatttacctacaggtattttattgatgttattcttcctctgatgacacgctgatttcaaaacatgcctaaaaccaaagacacaggatctttgaagtcccttccctcaaatatctgaggcttttccccaattgagcagcagttcacatgcttgtaagttttaaatgtgttaggcattttactggaaatgctttatatgcttcacactccacaggacttcttattcccagctcattgattgaggaaagtgaaatctgccatttgctgatgggccaatgtcaaggccaatgtcccagatcccctgtcaggacaaaagtgtgatgcagccagaagtcagccctcacctgcaaatgctctcctgaacttgcctaccctggagggatctgctcaccaggcagattccaggcgatgcccaaagcactccctaataaaactctgtgtgctcatctccgccttaacttctgtttccaggagacccagcttgtgaccattgtttccaggaagattaccaattgtctctgtttgccctggaccgaaggttttcccaggacatagatctttcagtgctaaaacaggacagtcctgagttatcttaggaccaggaatgtctatgaaaggagacacttgagagatgggattctggagccatggagaccccaatatgggggagttggaggtaggggcgcgagggtagatgcgcatatagcccctaccatggtggagcaatgcagtgtgtaaactttttaccagtggtgaatagggatgatttacctataggaggaaatgaaaaagcaggaccatgagtcagacatttgagagacgtgaagaaaacagaacattaaaggaaccaattccacagctttctctgttggaacagtgtggtagtactgatactaagtgtgattgatgatttgcaacagataaaatgctggaatgattaattagcaatgaaaaactagaagatgtggggcaacaaggctccagctccatcctcttagggtaccagctgggctcaagaattgacataaaacagattcgcaggagacaaaacatacaaatttacttaatacaagtttcacatggcacaggagccctcacaaggaaatgaagacccaaagaagcagttagagtcagttacttatataaggaattggtcaaagaatagtcagttgtgaagaaacgactaaaatatgtggggaaaaaagccccagaatctggtgtatccaaataggactccactctgatgacaggtttcttgggctgagattcctttgagccccatccaacttcttcccagctgctgagaagagaaaatcttttagaggcttcctggaattttcccagtccacactgattttgcttaaaagataaaagttattataataaggtctgttcagcagtatctcagttttgacttctcatccctgaggataagaatgttgcttttccttctagcatagggagggacagggtttttcacatgggacttttgtcttctgcttttaagaaacagaaaacagcagaatgatctttttgcaactggtgttttcaagtgccttttacttaaatagtcaatttgctagaccggtacttttttatttcttttcttttttttttattatactttaagttttagggtacatgtgcacaacatgcaggttagttacatatgtatacatgtgccatgttggtgtgctgcacccatcaactcgtcatttaacaccaggtatatctcctaatgctatccctcccccctccccccacaacaggccccagtgtgtgatgttcccccactgtgtccatgtgttctcattgttcaattcccacctatgagtgagaacatgcggtgtttggtttttcgtccttgtgacagtttgctgagaatgatggtttccagcttcatccatgtccctacaaaggacatgaactcatcaatttttatggctgcatagtgttccatggtgtatatgtgccacattttgttaatccatagactggtacatttttaactccatcagagcgcaagccaaaaagcttcctcctgggctgaaaaaaaaagcttccccctgggctgaaaaaaagcttcatcttgggctggaaaagctttttggcttgcactcttcctctgggcctgagccttccctgccctctcatctgcttggacagagggcagggaagactgaagcccagaacttaatcctaagtgtagcagaccatcgggaccctgacagggtaacagtggggtactgagtcacgggacgaggccatctggattcacgcacctgaaaatcttgatgtccttgaattttccaaacctgcagaagtggccctcccttactcattgaaacccatgtctcccttccttttgcctgaagatgatgcagagacctctgacctgtgagattgtatccaccaccacaagtgtccccagaaatctgccaccacctcctattaagaccaaaggaccaataactagaattgagtcccaaagaaacctggcaaggaatgtgatagacctgctgcagaactaaggagctgcagaactaaggagctccagaaccagccaacacgtgcagtgggccccaggcgagtgtgtatggggctggattctgagggtgtaagatcaaagtgcaaaacctaagattggattggggagggtttatctgctggaagcactctcctgggacgcaggctttaaccccctagcaaagacattgaggcattctgcaagcccgccgcaaggattgcccttaggaggacagagaaagcaatggtccgtaccaagcaaggtcataatgccagatgtgctgtggcagatggtgggagaggaatcaaaaggtcctgggaggccaggtgtggtggcttatgcctgtaatcccggcaccttgggaggccactgtgggagaatggcttgaggctaggagatcaagaccagcctgggcaatatagtgagaccctttctgtacaaaagattaaaaaaaattagtcaggcatggtggcacactcctgtagtcccagctactagggagtctgaggtaggaggattgcttcagcctggggagtttaagactgtagccagctgttccagcctgggcgacagagtgagaccctgaaaaaaagaaagaaagagagagaaagagagagagagagaaagaaagagagagatggagagaaagaaaggaaggaaggaaggggaagggaagggaggaagggaaggaaggagagaaagaaaaaagaaaagaaagaaagagagagggagaaagagagaaaggaaggaagggagagagagagggaaagaaggaaagaaaagaaaagaaagaaagagagagagagagagaagggttctgagagtgcttagctggaaaggcaataccaggtactcatggacatctccccaagtgagagaattctcaggagggcctggggactgcagtctgtaattgattgataagcggtgcactggtgagagaaatccagcatccttgagaaactcagtgggtagttctctagaccaggccagcaggggaagctggtaaggaagttgatagcaatacggatggaaggaccatgcagtgatagtgtcacattgtcagggcttaagcataggagccaggtgtgtggcaaaagatgaagtggcagcaaggcacctgacattgaatgatggagtcagtcagtatagcatggcacctctcggggcaagatgcataagccaccaagaaagggacagcttctaatctttttagcttattttttatttttttgttgagatgggggggtctcactaggttatccagagtagtctcgaactcctggcctcaagtgatcctcctgcctcagcctcccaaattgctgggattacaggtatgagccatagcttccggcctagcttttaatctatattttcagagggaagtaaggaagaagggtcaaaccccattaacaagtttctgaaagagcctaacttgcaatgtctagtcattccagagtaggatatttaccccaaggattaattcactgtagttgctgtgataaatgaccaaaccataaactgagtgactaaaaacaaagacctctaaatgattacacctggtatctttggaggagccattcaatctactatacgctgcttccaagtccttgtagaaaaacatacggaaatcatgcatcatcccatgggtggaagacctcgctccaggttagtgaactgctctgatttgtgactccaaagatggacattggtgacagcaaaaggaggacccagaatctcgtgtattcaaacagaactccactctcatgagaggtccttggatctagacccttgggtcaagcttcctctgagcattgtccaacatcttcccacttgctgagaaggaagattctttatgtgggccctggaatagcctcagtccagcctgatctctctctcttccctcctgaagttttatttcaaacattttgagactctaaaagggtttctttgtctcatttctctcctccagtcctactaccagggttgtcttcaatttatatccaatgtttctctggcctggaactgagacctacctcccaagcagcgacccgacccgtggagtggggtccctggggcaagcgaatggtcctttgcctggagaacctgggccagcagtcatggcaggtgacacattccattctggggcgaggaaccagggagggagcactgcatagatcagaagggtaaacaaggggagggagaaggagcaaacttagatttgggagggaaagagggaagggtgcagaggaagcagaacacggatgactgggcctccttcagttgttcttgtgactagaccctcccatctaagccaccaggggacaggaagggtatgagtttgaggactctaatggccccaaggtactactgtggtttatcctacttgtaggcggtcccaagagctttgttctctccagggactcaaaggggatgaacttgcaagtcttttgtctccactcagtgccttctctgattaggccaataaacatccccaggcctcagtctcaggccactgtaggggctgaggacagtgagaaagatgtgtgagcatccaccctttggagaggttgagtaggaatgagaggtcccctgccttgcctttggtccttgtgaaggaagatgttggatatttcccagcttggctggaatccgttcctcaccctccccattcagagcagggatgagtaagtcctccgctttctccgcaaccacaattgtgtttttcaggaaaggataaagtgggaaagatcagatcccatgcctcttcctcctctaagtcatgggatgactgcagagagtgagcaagagggtaaaaacagtgcactgagtgtgatgtttgctaaaggaacagataattgcatcaaaacctatttctagcagagttgtggtgcttgcctataatcccagctactaaggaggctgaggctggaggattgtgaggccgggagctcaagaccagcatgggtagcatagtgagagctcatctctaaaaaacaaaacaaaaaaccacacttatttctaattgtctaattggtatccactatcagacctttctgggaagttttttttctaacatgcctaaatgtggcttggagactgtttgggtgaggccaatagcttagccttcctacttaagttgtctccttcattcattcaacaagcaggtattattgagtggattgttgggtgcatttgtgtgtcctcagtaggatgcaggcatgcaatacatgaagatatgataattccagtcagaggaatggcctgtgcaaaggccctgaggtagagagaaccttgataattgaaagaacagaaagaaatccagtgggactggggaaagagaggaaggagatgagaggggagttacaggcagccaacagatcatgtgcagacagatcacttgaaagcagaggcaaatggctggatgtttttgttaatgaaaagagaatttatttgaagatcttccatcatttttacatgaagtgattgatgtgttaaatgaatgaaatttaacattcatggtgtatgaaatttatggaagaaaaactgaagcaggcagagcattttatggcctttgggcacaagagagtgaagcttgtcccatgtagagtcatggagagtgactgggagattcaccattagagttggcagattggctcttggattgaatatggggcatgaagcaaagagttgttgactcctggaagtttgactttgtcaatggcgtggctactactttcttttattaagagagagacagatgggagagcaacaggtttgagggaaacacataaagtgctttgtttggactcatggggattttttggagaagacagacaagatacaagtaacaagatgatgatgtctgtaatatttgggtacaaaatgcaattcataaacctgattgtataatatgatcctatttatgtaaaatcatatatatttagttaccttgattcaatttatacatcactaattgtttccagtaatattaaccaaaggtctactatatgccaaataaccttttatggctagagatagaaaaatgaacaaaacttactatgttcatccttatggaagatacataattcatatttgtaaacatcacatttaagtatggcaagaaatctggtgggatggttcctaaaatgaaacaatagtttcataggtttgtgagaatttaggtgatatttctacttaactttcatgtacactaaaaatttttcctataactcaaaaaaattttttggaggcagattagcaagatatttattttggaaaagcaagagtcaatctgaattgaactggagggatgctgagagttctagaacttcatagagagaaagaaaactgagttattgggtgggggttacacctatctttttgtcttttcttttctttctttcttttttttgagacagggtctccctctctcactcaggctgaagtgcagtggtatgatcttggctcactgcaacctctgcctccctagtagctgggaccaccacaggcatgcaccaccatgtccggctaatttttaaaatttttttggtagagacagagttttgccatgttgcccaggctggtctcagactcctggactcaagagatccgcccaccttggcctcccaaagtgctgggattacaggcgtgaaccactgcgttgggccgcttatcactttaatgtctaatgagaggcccctggagctggaacccttagccccagcctgacccctgacccttctcccatgtcctcaaattcaaaaactcacctctggctgtccattcagttgttctcaagtctgactgtgctctttgtccttcatgaactagaactagtctttctttcaaaccattttgatgagctgatcaatgtctcctcataccatttttctcattcagccttcctcctggggttggttttatttaccatctaacaatatttctgtaaccctgagcctctagagctgcctcaggtgcactaacgctgtgactaggctgccctgggacaagctaagaggttctgcgggggagggtctgggcccctggtgtggcagaaggtgcatccatcctggaggaagccagaggaccaagggccaggagcctgggggggattagaagggaccaggaggcctggtcctgagctgggatgggaaggaacgggaaggggcaggagcaggacagggatttccagatccactcagccgcctccctggggcttgggctcctccatctgaggccaccagggggcggcaagggcttggatttggggaagggaattgctgtggtttaaccagggagtgtatgaagctccatgggctgcttcctcctgagacccttctaagggagaagtggggagtggaatgtccaaaatatgttgtgtcccaatatgttcgtttctagaaaggctaataaatagcctcagcccccagcctcagagcactgcatagaaagaggacagaggtatttgagggtcattctgagagaacctagaaggtattgagtgggaataaacagtccccagctctgcctttggtccctgggaaacagagtgcctggatcactccacagtggtcatctgggatctggtccgaggtctcttccttgattctgttccctgagccttttttattctattttggatcagatccatgcacacgtagctcagagttgtgcccaagatttcataaggaatttacagggttttttccccctcaaacttatttctctccacagtctgcccattatttatggttccccagactttcccttttggtcttctggtgaaaaaactgtgactttaataagcctgcggtgctgtgcacttcctgcaactgagtccgtgtccacaccaaacaccaagaggacaaagagtaacaaaggtaaggggattaagtgccactgtcttggaaatcagctccaaagatgagaaaagaaagtccgcacagtctctactgtccctgctgtcaccacgaagaatttcctggaggctggatcatgtagaatggagagaagaacaaacataagaaaaggaaaacgtggacatttcaaatttgccctgagcactaggggtttcctttctcatcttcaagccagaacagtggagcttcttctggaacttttgtggctgcacactggtaccccttccaggtattggtctgccctgagtgcaggccacaggacactgggggaaaatgggaagctctctgctggtttgattttactaaaagtgctagtatctcccctagtctgcctccagtgatttgcttttccaagtaatcaaattgatgctccatggattctgtcccaggttttacagctgggcttggagaaaatgtggtatatgccactgcatccgaaatggaacctgaaaacagtaataatattctaaacgtgaaaattaaatcaatctgaatcacaggcagtggaaaacatcaaaagatgaaagagttttaaaagtgatttgaggaaagaaacagggagaaatattttcacattggttctatgtttactctatttatcttttttaatttaattttaaaaatagagatgaggaggtctcactatgttgcccagccaggctggtctcgaactcctgggctcaagcaattcacccgcctcagcctcccaaggtgatggattacaggcatgagccaccacacccggcccctgtgtttcttatgtgctccttgattaagaagagttgttttttgtttttgtttttgttttttgttttcttgagatggagtttcacttttgttgcccaggctggagtgcaatggtgcaatctcggctcactacaacctctgcctcccaggttcaagcgattctcctgcctcagcctcccaagtagctggattacaggcgtgcaccactacaccagctaattttttgtattcagtagagacggggtttcaccatcttggtcaggctggtctgaaactcttgacttcaggtgatccacctacctcggcctcccaaagtgctgtgattacaggggtgagccaccatgcccggccaaaaagttggtttattgtagcttgtggatacagtgagatggaagaaaacccagaaagcagaaataacacttctttgtaatatgaggaaaaaaataaaagataaagttgaatgaaatatttcatatatatatgtttcatatacatgtttcttatatatgtttcatatacatgtttcatatatatgtttcatatacatttcatatatatgtttcatatacatttcatatatatgtttcatatacatttcatatatatgtttcatatacatttcatatatatgtttcatatatatattgcaacatatatatgcaatattcatatatatagccatatatatgtttcatatatatattgcatatatatgtttcatatatgtttcatacatatgtttcatatatatatagttttttacagagtcttgctctcttgctctgtcacccaggctggagtgcagtggcctaatcttggctcactgcaacctctgcctcccgggttccagtgattctcctgcctcagtctcccgagtagctgggattacaggaacgcaccaccatgcctggctaatttttgtatttttagtaaaagtggagttttgccatgttggccagtctggtcttgaactcctgccctcaagcgatcctcctgcctcagtgtcccaaactgctgggataacaggcgtgagctatcacgctcggtctgaaatctttagataagtatgaagtctatataaaaaaaaaaggctcttactaggctagaaatggcccattttagaagctttcattttccacctcacactcatctctctatagatcctctgcttgggcagtgggtggaccttgtggtcctcagttctcaggctgagaaccagaggctgaaaaggacaagtcacctgctcatgagtgggaagggcaggattgggagcagcggactgtggctccattgctccttgtttcctccacaggcccctcccacgtgtgcccctgaatgacctagaatgactaatgtgctcaagggatttgatgctgcagatgcttcggcatgaagggtgggggtggggatgggacaaggctgcagctgaagagatgggagaccaacaacacacagcaggggtttccatggggtgggcacccccatttcctcacagtttagagagcctggaggtgggtgccaagcagagggcaccatggcgtggcccaggcctggaggttcacagagacacaggcacaacacagcagagacactgagggccaggagctcactcagatgagggacttcagcagatctttctctcttgaggaaattaggtacaaaggaatcaagttcctaccatcagaatagacaacaagttttaatctcctcagctgagccccgctgtcgagggaagcagaagtctctgagcccggcccaggtgagagtggggtgaggagaggagctcagggtgcagatttgcatgaaggccccaccctcctctgaggcagaggggataagacaagtctgggggtaggcccagcgctggggtctcaggaggcagcgctctctcgggacgtctccaccatggcctgggctctgctccttctcaccctcctcactcagggcacaggtgacgcctccagggaaggggccttggggacctctgggctgatctttggtctcctgctcctcagactcacctgggcccagcactgactcaccagagtgtatttctccctctttccagggtcctgggcccagtctgttctgactcagcctcgctcagtgtccaggtctcctggacagtaggttactatcttctgcactggaaccagcagtgacattgggggttatgaccttgtctcctggtgccagtagcacccaggcaaagcccccaaactcatgatttatgatgtcgctaattggccctcaggggcccctggttgcttctctggctccaagtctggcaacacggcctccctgaccatctctgggctccaggctgaggacgaggctgattattactgcagctcatatgcaggcagctacaatttccacagtggtccaagttcatgcgtaatgagaccaaaacctgccctggtctctcaggctctctctcgctatgaaggtgcttccttaccctgtgcagaagagggtttcatgcaacatggccttgagaatttcatccactctcagcccctctcccctccaacaatgaaatgcaaaagaaacatgctctctggttaattgtctagggacaatggcagcttcttcttttcctgtgtgatatggtcctgcatggtgactctttccaacttttcaatggcagggacagagcaataggatccatctgctcagtaccatttctgcagttttctatgaaaccctcacattaaatgcctccatctcccacactgtgctgactggcctgggtctgtgctccagaaataacgtcttactcaactccatatccaccacgctgtagtaaggatggctgtctttgctgggttatttgttcctctgcaggtctcttcccaaagcaacaccaactgagagaagatctgaagatgttgagagagtgagcataaaagtaaagggttttatttatttgctttcttttttttttaactttgtttttatttatttttttgatacagagttttgctcttgttgcccaggctggagtgcaatggtgcaatctcagctcactgcaccctctgcctcccgggttcaagcgattctcctgcctcagcctcctgagtagctgggactacaggcacgcgccaccatgcccagctaatgtagagatggggtttcaccatgttggcctggctggtcttgaactcctggcctcaggtgatctgcccacctcagcctcccgaagtgctggcattacagacatgagctaccatgcctggccttgtttttattttttagagttcctttgtctttgacccgatgtctatctatgggggcttagccagggcacatttgagtgattgttctttgcgagaacattgttctttgcagatcattaaacccctgtcctggaaacagtcctgtacttagactgtctccctgttagcatgggctctttcctaaatgatccacaggaaagcttatttggtggatgggtcttctgttcctcaaggactctatgggtagtttattttcaaggtgagccaatactgtttctagctggaatctcatttaatctcataaccatgagaattaattttttaaacctgcagggtgttctctagccattttttaattttctttgattttgtgagccacttttaaattataatcatcattaaaccttaaaacatataaacttcaattaagcagattatatattttattttattttttgagacagagtctcggtctgttgcccaggctggagtgcagtggcacaatcttggctcgctgcaaactctgactcccgggttcaagtgattttcgtgcctcagcctcccgagtagctggaattacaggcatgtgccatcacgcctagctaatttttgcatttttagtagagacggggtttcaccgtgttggccaggctggtctcgaacttctgacctcgtgatccacccgcctcggtctcccgaagtgctgggattacaggcatgagccatcaagaccagccacatatttttaaaaagtacattggttattatccacatacctttggactgctataacacaataccttaaactggtggcttataaaaacagaaatgtatttcttacactcgtggaggctgggaagtcttaagatcaatgtgctggcagatttggtgtctaatgactgtctgcttcctcatagaggccattttctcactgtgtccttggaactgaggacaaagcagctcctggtaaagttcagatgtctgtttcttgcaggaaaatttctctttacagtgatctgggctactggctccaacacacgcacccagatggatttctgagccggtcattgaccattaccattttaatattatctcaaattataaacattatctcaactattgtttaatataatatagcacataaatgtttaaagcatacatagcgaaacaagggtcttacattcaaaactgtcatttccccaatcacccatctccttgtccaccaagccccagtgccaccacttagctcattgctcctttggcttcactttctggtgctcttgcaagtgtctgtcatgtgttacaaacaacaacaaatagtcctccaagaacgtttacctccatagaatccctatcctgtttcctgagtggacatttccatttttaatctggcaaagatcagtcagccctgattagtgttttaaactcatatccatctctttctagaaaaacacactaggttaagcatctctctgtggatgggggaccctcatgaaggcacacagctctgagctgaggtggcctcaatgtgtacaatggagcaagacaaagaaaagtcccatgttctgtgtgatagacagacaggcactgatgagaggtctccagagctggcgcccttagtctaatcttgactctagtcctcgtctttccgacccttaaacactagaattcctggtctgcattccattaggtcattcttaaatctagtgagctgtatctccttcatgcaatgtttttctttcactattattttcagctttattgacatataattgacaaataaaaattctatatatttatggtatacaacttgatatattaatacatttgttgtacattgatatatttgttgtgaaattactgcaataattgtgtgaaatcacaatcaatctaattcacataaaataaccttacataattatcatcttctttcttttttttttttttttggtgagaacacttacaatctaccaaattagcaaatttaaagtaaataatgcaatattgttaaccatagtcacattgcggtacattagctatctagaacttattcatcttgtatcactgtactcttttataccctttgataaacatctccccatttcccttttccctccccagtcctgacacccaccattttactctctggttctatgagtttgaatattttagattctacatgcaaataagatcatgcagtatttgcctttctgtttctggcttatatcagttaacataatgtcctccagctttatccatgttgttgcaaatgatgggatttcctttattttttaaaacttggcaatatttgtgtgtgtgtatgtgtgtgtatgtatgtatgtatgtgtgtgcatgcaccacattttctttatccattcatttgtcatcagaaatttaggttgtttccatgtgttggctattgtgaataatgttgcaaaagacatgggagaacagatatctattcaagattctgatttcattttgttttgagatatgcccagaattggtattgctggattatatggtagttctatttttaattttttaaggaatccccatacattttctacaatggctgtttagtttacattcctttcaacagtgtacaagagtttcttttgtccacatccttgccaacatttgttatcgtttatctttttgataaattacaggcacgtgccaacacacctggctaattttttatatttttggtagagacggggtttcaccatgttggccaggctggtttagaactcctgacctcaagtgatccactgcctcggcctctcaaagtgccgggattacaggtgtgagccaccatgcctggcctattttttctatttctataaagaatgacatttgtgtattgataggtctagcattgaatctggagatcactttaggtagtatgaacatttaagaatattagttcttccaatttataaacacgagatgtcttgatatttatctgtatcttctttaacattcttcatcactgttttataatttccagtgtaaaactctttcacctccttcgttaagtttattcctaagtactaattccttttgtaaatgtgattgctttcttaattttattttcatatatttactgtctgtgtgtagaaacgtcatcaatttttgtatgttgatttttttatccttcaaatttacttaatttagttttaacagactttttgttattgtggagtctttaggtttttctacacttatgtttatgtcatctgcacacaaagattaggattttaatccttcttttccaatttggatgcgtttcatttctttttcttgtcgaatttctctggttagggattccagtgcaatgttgaattaaaataagtggagagggggcatcttgccttgtgtgggatcttaggggaaaagcttctgtttttttcccattgattatgatgttagttgtgggcttttcacatatggtttttattgtgttgtggtaagtttcttctgtacctatttcattttatttttgtttttttaaatatttattttataatagagattaattttgctatgttgcccaggctggtcttgaactcttgggctcaagcgatcctcctgccttagcctctcaaaatactgggactacaggcatgagccactgtgcccggcctatcactattttgttgagagttcttttcttttcttttccttttttttccattgctttcttttcttttcctttccttttttcctttccttccttttcttttcctttcttttctcctcctcctcctcttcctcttcttttttctttcctcctcctcctccttcttcatcttcatttaaaatcatgaatggatgttgaatttggccacatgccttttgtacatctgtggacataatcatatgtgtgtgtgtgtgtgtgtgtgaatctttcagcctgtggatgcgctataccatccttgcacatgcggaatcatccttttatccagggataaaccccacctgttcctgatgtatgatcttcttaacatactgttgaatttggtttgctagtattttactgagaatttttgcatttaatatctgttaatgtttatcagaggtagactggcttgcagttttttttcttttctggtgttgtctttgctttgttttggtatcagggtgatcccgacctcataaaacaattttggaagtgttcccttttctattttttggaagactttaagaagaattaatattaactcatctttgaatgtttggtagaacattcagctatgaagccatctggtcctgggcttttctttgttgagatatttttgattattgagtcaatctccttctttgttattggtatgttcaggctttgtattttttattgatttgcttttttttttaagttgactgtttctaggaatttatttatgtcttttaatttatctagcttggtgtataatttttcaaaatagtcccttatgatcctatttatttatttgagacagggtctttctctgtcacccaggctagagtggagaggcttgaccacagctcactgcagccacaacctcccaggctcaagtaatcctcccacctcagctttctgagtagctgggactacaggcatgcaccaccatgcctggataatttctttttctttctttctttcctttctttcctttctttcctttctttcctttctttcctttctttcctttctttcctttctttcctttctttcctttcctttctttctttctttctttctttctttctttctttctttctttctttctttctttctttctttctttctttctttctttctttctttctttctttctttctttctttcttttcttcttttttttgtatagatgtgacctcactgtgttgcccaggctggtcttgaattcctgggctccagagatccacctgcctcggtctcccaagtgttgggattacaggtgtgagcctttttatttctgagaaatctgttgtaatagctccttttttcattttggattttatttgagtcttctctcttttttcacagtgtagctaaggatttgtcaacttcgtttaatttttcagaaaaccatctcttagttttgtttttttctattatctgtttgatttatttctgctgtaatctttattatttcatttttttctgctaagtttgggcttagtttgttcctctttttctagttcgttgagttataattttaggttgcttatttgagatctttcttcttttttaatgtttgcttatctccataaacttcccacttagcactgcttttactgcatcctataggtttggtgtgctgtgttttaattttcatttgaagatatttttaaaattccctttggttttcctctttgacccaatgcttgttcaacatgtgatgtttgatttctgcctatttgtgaatttttccatttttttttactgttattaatttccagattcatttcttgttgtaaaaaaagatttttggaatgatttaattctccttacatttcttaagacttgttttgtgaccaaacatgagctctctcctggagaatataccctgtgcatgtaagaagacattttgagaacccaggtggtcttttctcataccatttttctcacccagtgctcatactgaggttagttcattttacatctaacattttctcagcctggagctaagacacctcatgtacctttgacaaagccattctagcacaagcaaaacggtcctgagaacgagtatcttagccacctggtatggcagaggacacattcatcatggaaaaagtctgaggaaaagggtcaagattagcatggatcgagggtctggtcctgagctgggaggagaaaaaggcaggttggagtgggaccaaaccaggtatttctatctctcacttagaattgtgtcttggtacttgagatgaaccatctgaggccaccagggggcagcaggggactaggttggagaagatgattgataaagtttatcctgacctttaagaagcccctgagtcggccgggcgcggtggctcacacctgtaatcccagcactttgggagactgaggagggtggatcataaggtcagaagatcgagaccatcctggccaacgtggtgaaaccccgtctctactaaaaatacaaaaattagctgggcgtggtggcttatgcctgtaatctcagctagtcgcgaacctgaggcaggagaactgcttgaaccagggagttggaggttgcagtgagccgagatggcgccaccgtgttccagcctggtgacagcgcgagactccatctcaaaaaaaaaaaagtccctgaatctcaaaaaaaagaatgtgactttatgattaactatgaacagctgctcattaataaaaagccattaaaaaaaaaaaagaaatcccaagagctacttacccttgaatatctctaaaggtactgggaagcagtgctccaaatctgttgtggcccagtgaattcctttttagaagcaccattaatggtcctagttcaacatgtcaggccccagctttaaaccactgcaggggcaggggatgtagcagtgcttagaacccaccttagctgagaggaccaagatggttgggcaggggatgagggaaatgagaagttccagcactgtctgaagtctctgggaggaggagtgattgaactttcccacccggcctgggagcagcctgtcctcacattcatccctcacagcacaaaggagaagtcctggtttcctcagcctggagctcctgcaatagtgagggttaggatatctctggactggcctgatgtcctgggcactctcatgggttcagtctcaggaaatccatgcctaggctggattaataccctcagctgagcctcacagggaagcagaagtctctgagcccaggcccaggtgagggtggggtgaggagaggagctcaggacacagatttgcatggaggccctgccctcctctgaggcggggggataagacagggctagaggcaggcccggtgctggggtctcaaggcagcgctctcgggacatctccaccatggcctgggctctgctcctcctcaccctcctcactcagggcacaggtgacacctccagggaaatggccttggggacctctgagctaatgcttggtcttctgctcctgctcctcagggtcactggacccagtactgacccagtagagtgtgtttctccctctttccagggtcctgggcccaatctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttacactttccatagtggtccaagttcctagggaactgagaccaaaacctgccctgggctctcaggctctgtctttgctctgaagatgcttcctcaccctgtgccaggggcttcctgcaacagggccttgagaattcacttctctgtcagctcctctccttttccatcaattcccaaaggaaacctcctctcttgtttactctccgggatatgacagcttcttcttcactcgtatgacggatgtcctctctgaattggaaactacttctagctctttaacaggaagtacataccggcagggaaatgcctgcctagtgcagtccccatacttctccggatgatcctcactttattatttatttttatttttgtatgcactaaagtcgtcaatgtaaatccttacgtcgaatgcctccacttcccacattgtgtagcacagcctggattcagttcttcagaaatgacgtcctcttcaatgataaaggaccactgctctgtgaacaccccactctagtgaagatagcccaccttgctgggttattcatgtacatcttttgtggaagcagtaaccactgtgtaaagctccaaagatgttttaaagcaatgaaaacaaagaggaagaagtgtgtgtgtgtgtgtgtgtgtgtgtgtgtgtgtgtgtgtgtgtagggtccatcctgtttgccctaatatctcaggttgccgagctagggagtatttgagtgacagacttggtgccctctcaggatcctcctcctctcacatcactgagtccctgtcctggaaacaccctacaggtggacaatctccccatagtatggaagtttccaaaatggctccacagggaagagttgagctgaacacacccactctttctcatgggcatcaaatatatctaatttttctggggaaatcatcaatttctagctggaatcctgattaatcgacagactgtgagaattaaaaattttaaaaatattcagacatatccagagtccagtatttaaattctctggaattttgtgagccaatctttaaacatagttattattgtagtttagagttcatgaacctgaattaaatagattctagtaaacataaagtgccttagttgtctattgttgcataaaaattactcctaaaattaacatattcttaatgagaacacatatgcattaatctgttttcgcactgctataaagaaataccttatttataaaagaaagaggtttaactggctcacagttccacatggctggggaggcctcaggaaacttacaatcatggtagaaggcaaaggagaagcaagaactttgttcacaaggtggcaggtgagaagagctggggagggtgaacttccaaatacttttttttttgagatggagtctcactctgttgcccaggctagagtgcagtggcgtgctctcggctcactgcagcttctgcctcccaggttcaagtgatcctcctacctcagtctccgagtagctgttattacaggcatgcgtcaccaagaccgactaatttttatatttttagtagagatggggttttaccatgttgaccaggctggtctcgaactcctgacctcaagtgatttgcacacctaggcctcccaaggtgctgggattacaggcgcaagccattgtgcctggccccagacacttttaaaaccatcagctctcatggtaactccctacccatcacgagaacagcaaggggaaaactgcccccatgatccaatcccttccgtccctcaacatatggggattacaagtccctccttcaacacatggggattacaatttgagaagagatttgggtggagacacagagccaaaccatattaatgtatttgtgatcttgtagttttcttgcatcaagaatctgagagctgcttagtttggtggttctgactctgggctcctcatgaaattgcagccaagctgtcaggcggggctgcattcagaggccagagcaggtggccaggcccagcctgagggggcttctactgtccctaacctctttggcagatgtagatgaagtcagggaaaaggggagctccccacagtgggtagcatcccagtgtcagagggaaggcaccatggagcagtgggaccagcacaggaccctgggggtgcactcagacctacctggagggatggcaagaaggggcattcacagcagggacaggataaagggcctctgccccatgtccagagctgtcttggcagctcagtcacattggttatcaggtaaatcggaggtaaaccctatcctgagttttaccactgaaaatgggtacaatttgaactaggagtgttttcagactttttctttccatattgacttcttaataaccgcgatttaattttttttaaccccagcctagtttagctacatagcttccaaatgtcatgctactgtgaaactgagcaattagttacttttatcagagcattttaaatttgaacaggttccttggtctttctatgtgtaattagtcaaagcttaggtatggagtagaggatctttaccaaatgcttttctagactctgttttcattggacttatagcagctgtttcacctgggccatgcaggaataggagagttgttgctccttgacatagcatctgtaacatgcctatcctttctgccactataaaaatagctgtgctttctctccactcgtctctcctgctgtttccctgtttttcctattaaatatgcagtgtttgcaatccatcttgcattctgagaagatgaggattttttttcataaagaatgacctaaaatagctctaaagatcatcagaagtcacaactacatacttactggagtgcaataccaaatgtggcctctgattacagtaacctggagcttgcagtttaagcaattcagtccctgtcacttgtggacagattcgtatgtctgtggatgagaagatgagcaacggtcactcctgtgctcatgcacagatccctccctgcccctgtcctcaaattcagactgaagtgcatggccctggagcattacatgagtgatggtttaagagcacgttggtgatacacacaatattaatggtatcttaatttgcttgttaagcataatttgaaaacatctggacaaatttggacacaatttgaagggcatatttgataatagcttgtgacaaatgattccgttctgggagagatgctatttttggttctctaaatcgccatgaaatgaaaatctcagattataaagaaatagactcaaatcccaagtgtcttttgcttttcattccccatcaactgtgttgcccaagcaccatgtggacactgcttacagggtaggcagccaccagctgaaggcaggttctttagttgtctgagctgtcctggagctgggaacagcagcgtgtgttctgtgcctgttggtccctatgtagcacacacccactgcatattctcgctgactcaccaggagggcttgcagcagccctggcctattttcttctgaagcacctgccaatggtgcattctcccctggtcataatgcaccaggagataaacatggcatttgacacacaggtgctaactggatctaggacttctaagcttaagtagactcagagtgggcaatctaaaaaaaaaaaaaaaaataggttctcaatcggtagcccaggctggagtgcagtggctccatctcctacctcagcctcctgagttgctgggacaacaggtgtgtgccaccatgcccagccaacagagagggcaatatggacttgaaatggacaatttccattacttgaaagtttttgagaaagaactgaggtttgtttaagaggaaatcagccagagactcaaagttaaatctatcaggcccaaagtctctttggggaaaggagactcttggacgtgcacgcagcagcaagtggtatgggatcccttctctgtggggaccttggcccaactgccaatcttttcaactgacccatttgcgttttccataagtgctcgccagccagcagctgtgactgcccctcagtctcaggaagggagaaagaaggaaacaggagcaaagcctctttcaatcttagcaaataaagtgggagctttgacttttttgaacacccagatgacaggaaagaggaggaaaattttcctaaagctgttattttttaatgcctcaggaagaatcacacccggagtctcatccacactttatttggaggtatttgggtctcagagtttgtgctgagttagttaatgatttgggctactgggatggggtgaatgtgttttacaagtgagaaagaaataagctttggagtccacagggtggaggcttattggctaaattgtgtccctcaagattcatgcaatgaagccttaatcacagtgtgtgactaaatttggagacagggtctttatggaggtgattaagtgaaaatgaggtcatgagggtgggttcttatccagtctgactggtgttctccttagaagagaaaatttgcacacacagaaatcagacaccagagatgagcaggcggaggaaagaccatgtgaggtcacagcaaggaggtaacgacctgcaagccaaggagagaggcctcagggaaaatcagtcctaccaacactttcaccctggactttccagcttcagcactgagaaaataagttttgctgttgaggccactagttctttggtatcttgtgatggcagcactggcaaatgaaaacaagagggaccccaaagaccttgggtagggggaacagatggagcagggtgcaggaggcagggcagggaggggctggaaggtcatgctctgaggttcgtttcctggatggaactgggactccactcactactgtctggggaacttggggaaaaaacttcacctcccaatattgattccctaataaaatctgggccctgagcatagggctcctcatcttcctactccatatgatgcaagttttcttgaagttatgcttgtaaaacactcaccaatgcatctggcatatattaagggctcaaaagtaggccaggcatggtggcttatgcctgtaatcccaatactttgggaggccgaggtgggggatcactggagtccaggagttccagaccagccaggccaacatggtgaaactccatctctactaaaaatacaaaaaaaaaaaaaaatagctaggcatggtggtgcccttctgtaatctcagctattcaggaggctgaggcaggggaatagcttgagcctgagaggcggaggttgcggtgagcccagatggtgccattgcactccagcctagatgatagagtgagactccatcacaaaaaggaaaaaaaaaaggttgtcattctgcagcccagatcgtgccattgcactccagcctggacgatagagtgagactccaccacacacacacacaaacgcacacacacacaaaaactaacccccgccccgcaaaaatcgaaggtagccattctgctgtatgatctattgatacatacaggatgacatttgtcctgtgggcaccagggggcactgtgacccctggtttgggacactaatggctccaagtccctggtagtacttgagtcatttcctttctggccccttctattgagtggaatcctgaaacccacctgactcttctactcttgaaaaattacgcagagaatgtcctcagacatagggtcagacaagaacttcgacatacattttaaagaatggagagcagatttacatccgctgcttaacagggaaccaactaacaaagaattaagaataaaggaagtagagttgcatgaagagactcccctttctatgataagaaaggcctgaaggtcccttcccagctgtggactcagaggcagagctctggggcatttccattatggcctggacccctcccctgctcgtcctcactctctgcacaggtgctgcctcccagggctcagcccccagtgggatcaagatcagcctggccctgaccttcaactcaacatagggagtgatgcagggtgtggggttctgggaatgaggccctcatcctcagactcacctctcctgtcctctcttgtgggctccgttatttcctctgggccaactcaggtgcctgcagtgtctgtggccttgggacaaatggccaggatcacctgccagggagacagcatggaaggctcttatgaacactggtaccagcagaagccaggccaggcccccgtgctggtcatctatgatagcagtgaccggccctcaaggatccctgagcgattctctggctccaaatcaggcaacacaaccaccctgaccatcactggggcccaggctgaggatgaggctgattattactatcagttgatagacaaccatgctactcaactcacagtgacacaggcagatggaaaagtgagacacaaaccctttttctgtctgtgtcactcacttcctccggccccagcaggactgtggacacagccatgggcaggtctggctcagttttcctggatctgagaccccagggtgccctgacctccaagccctccagggagactctgaagagagtgggttaggtcaggagaggacttggggctggcaggaccagactgtcctggtattgtccagagtggctgtgtcttggcttaagatgacctgagtgtaaggatagtcagagggagacagccattgagtggtaatggtccctggatttccttctgtatggtgactggacctaaggcagtgctgcttttctgtggcccaaatgccccagatcattctgaacttctcaggtttaactgagaccctcaagccccagctccatgacatcctcatattctgaacagggagggccaccacaatgggcagtgtggtgtccatcaagattcccctttcagggctcacccatccgccatacacccaaagctgccgggaggccctggcttctcacagctgctccccaccggaaaatgccattgattgcaaagaatggcctcccccaaaagtttgcccatgtcagagcgtggctcaggtgcaatgactgcttgatgcctcaatcccaaagtcaggccttaatttaggatggccttgaagtgtgttgcagctgagcactcaattgtaacacattcccactcatgcctcccatacttctttcctgagaatatatccctaaacctcactgcatggaattccccctctcagagtaggagtctggggaattaaaagatttaaaaacaaaccaaaacagtccaaagggaagagtaacaaagaggagagagttgcacagagagaggactctggagtctgcaaatgttcgtgagcaccgatgagcacatatgtgggaggaaacaacctctggaagagaaaagaaccatccaaagacacttgagagaacactccagagcgtgtgtgcacgcacacacacacacactcacaccccacataaagaaaacaacaacactcatcatcatcaaattgctaaaaaacattttagcaattttatgctaaaatgatgatgaagaaatgtggtgaagaaatgtagccttaaaagtagccagagagacgaggtggctcacgcctgtaatccaagcactttgggaggtcgaggcaggtggatcacctgaggtcaggagtttgagaccaggctggccaacatgatgaaaccccgtctgtactaaaaatacaaaaaagttagccggatgtggtggcaagcgtctataatcccagctactcgggaggctgaggcagggagaattgcttgaacctgagaggttgcagtgagctgagatcgcaccactgcattccagcctgggcaacagagcaagactcaatctcaaaaaaaaaaaaaaaaaaaaagtcagaggcaaaagacatgttagatacaggtgaacacaatgacaagagcagaatttttattagaagcaatgcaagcaggaagtagtggagctatatttataaaatatgaaaagaaaaaacttataacccagagcaatctacagcctcactgaaatccctaccaaaataccaatgacatacctcacagaaatagaagaaaaaccccacaattctacaatttgtatggagccacaaaagacccagtatagccaaaatgacactgagcaaaaaacaaaactggaggcatcacattacctaattcaaaatatgctacaaacggccgggcgcggtggctcacgcctgtaatcccagcactttgggaggctgaggcgggcggatcacgaggtcaggagatcgagaccatcttggctaacacggtgaaaccccatctctactaaaaatacaaaaaattagttgggcgtggtggcgggctcctgtggtcccagttactctggaggctgaggcagaagaacggcgtgaacccgggaggcggagctggcagcgagccaagatcgcgccactgcactccagcctgggtgagagagcaagactccgtctcgaagaaaaaataaataaataaaataataggccatatgtgatggctcacacctgtaatcccagcagttaggaggccaaggtgggaggattgcttgagcacaggagtttgagaccaccttgggcaatataatgaaaccctcatctccacaaatttttttttttaaattagccagccttggtggagtgagcctgtggtcccagttacttgggaggctgaagtgggaggatcacttgagcccaggaggtggaggttgcagtgagtcatgatcttaccactgcactctagcctgggcaacagagaaagacactgcttcaaaagcaagcaaacaaccaaaaaatcaagtaatatcattgaaaagggggcaaaggatcagaatagacttttctcaaaagaagataaacaggtggccaacaagcatatgaaaaaatgctcaacgtcactaatcatcaggtgaatgcaaatcaaagccacaacgagacatcatcttaccccagctggaaaggctatcattaaaaagacaaaaaaataacaagtgctggtgaagatgcagacaaaacagaagacaaaaaccacgtgatcatctcaacagtcacatcaaatgttttcatgtagggaaacattactgtttgtgattttccagacttgctagagcatcataaaaagtaagatttgtggtgccgatattggagggggtgttattctgtgcaaaaaacctggatatcccatatccaactgtgaagatacttactgataaatgctaaaaaattgcaatattgtgtgtccaaatgttctgggggtcaggagtggggtctcacacgggaaaggattcagtcaaagagaaaaatagagaggctagaacatagaggaaaacataatatgtctggaaataaggagtccaaactaattggagctgagtgataacaaaagaacaatggcatgaaccatctatttctctctggaaatctcattgatatattgtgctctctccagggctatgcccagctagattataaaattgtctgttcctgaaacgtttcttgcgtatatgacagggcctaacactggaatcaagctcaggttgatgagggcagggcagttaagcacccgaccctggtggcctgtgaaatacttgggggagacaggggtttgttgtctaaagcagaggaagtgagattttccactgtggcttagaccagagcttctgaaattccagtgagcaaacaaatcccctgtggagtctgtttaagatgcagatgcagcctcagcaggtctgcgtggggccccagagtctctatgtccagcagctcccaggtgaggctcatgctgcttgtcctccaagaaccacactttgagtggcttaactcctattcgccctcctcactcaagcacaggtgagactctgccaaggaaggcactgtctgagaagcaaaggtgaccttctgtccttcctcccctggtgttttagtccatgttctattgccataaaggaatatctgaggcagagaaatttataaattttaagaaagatttctttggctgaagcttctgatggccggaagttcaagagtgggcatctgcatctgttgagggcctcaggttgcttccactcatggcagaagatgaaggggagccagtgcgtacagagaccaatgggagagaggaagcaagtcttttcctaacaagaatgcagggatgtaatttaatcatatttataaagtgtttgacatagagcctgacacacccaggtactcctagttggcagcaattattactgtcgtcgcacatgaaaattggacctgggatggaggaaaggcagcgcaaaccctctgtttgggacaagagagacttaaataatttaaaattgaggcataggagataaggagagtatccctgggtgttctcctgccaattctctcagcatctcggaaactgtttcaaggtgatgaagtcaaccagagagggaagcggaggagtttgtagaaccaagggttgcaacttcatccatgaggaggaggtgtagtcaggggattgggaagaggtggctgagctcatctgaagggtgtctaaggttttctggcccccatgtcctggcccatccctccctgcccagggtctcacccctcacctgacagcccagagctggagagtggcctatgattctgattagagaccccaccaaagcccagaggggaagacatgggtgggaggcgtcacagaagacagttttctgcctgtggtgttggggcagtttcctggaaaggaaattcagacactgtaggggagaagaaaacacaggagaggaaggcccctccccaggggattgtggcgttagagaccaaagcatcttcaagaagcccagccctgcaggaggttccctgagcccagagttcctagagctgtctgtattattttgcctggggtgccataaaaagtaacacagactacatgactcaaagaacagaaatttattgtctcactaatcttatggcgatggtagaatctgagatcaaggtgttggcagggttggctccttctgaggctgagggagggtctgtttcatgcctctcccctggcttttggtggtgtagcagtattagctgttccctggcttataggtgaatcaccccaatctctgcctccatgttcatatgacgttttctctctgttcatgtcggtgtccaagttttttctttttataaaaagaccagtcctattggatttggggctcactctattccagtatgacccgatgttaactaatcacatctgcaaccacccttttcctatgtaagttcccattctgaggtcctgatggatagcacttcaccatatgaattccagggggcacaaaattcaaattcccaacaatgggccaggcacggtggctctttgggaggatcccaaatcccagcactttgggaggccaaggtgggcggatcacatgaggtcaagagttcaagatcagcctggccaactggtgaaaccctgtctctagtaaaaatacaaaaattagctgggcgtggtggtgcgtgcctgtagtcccagctactcgggaggctgaggcaggagaatcgcttgaacctgggaggtagaggttgcagtgagccaagatcgttccactgcactctagcctgagcgatagagtgagacttcatctcaaaacaaaaaacgaattcccaacaatgcctcagacatggcttaagctgcccactggggctctgcaggtgggatgtgcaccaccaagctctcaggtggggcattacctgacagcccagaaggactccgggccctctgcaaagtgcctgatctcttgcgcaccttaaaaggtagcttttcaggctgttcttgttcttttcatgctgacgtaggagattttatcctctgctttttaagtagaagcttccttaccctcctcatcatcctgagtagatgcctaggctggtttcagagaaatcaaaccagggtggattatgagttatattagccaccagctgtcaatattctctgaatgcccagcatccatccatgctctctgaccatcaccagagtgagcaaatctctgacatgtggataagagtttcttccatgggctcccagccaggctgtaagtgagaccagaatacccttccttcagtgcatggggctcagtgcagctgcctccctgacagtctccctgggacattaagcttgtcagcttctctcttccaaatgcaggtctggttgtcctaagcccagctcagcgctgctgtggactttgcatcctaaaaacattatcaactctgccttgtgcctcagtggactggcctggaggaaacaatatgaggtgtcctggctctttccacccccagcgtctctctccctcagtggtaccagtacggtcctcatgacggttcatctatacctgccaatctaggcctccacactgccgactgtggatggtcacagaacccaaaatgctaatcagccttaagcagatcatgctaatagtttctgcagatctgggtgcctcatcccagatctaggagttcacaagctaggccagctccagggagataacatgtatcacagagtctggacacgacaaagtggctttgctgtatttttgctgggacacatgatggtgatatcaataagaactggctcaggtccctgcagcttaaggcccattgaacaggaaagcagccaggaggatgtgctgccttttgacctgtacacaaatcagtgccatgtgccgactgtgtgtgaatatctgtgcctgtgtgtatatttgtgtacatgtgtgtatgtatgtgtacgtgtccaagttggtgttgcaaggaagtgttcctactgtcaaatgtttcaaactcaaatcttttctgttttcctaacttacctgcttcttctatctctagtgcctttgttctgcactaagaataaggatgaagattagggtagtaatactagcaggaggagtaaagattcatatgtgtttaatacatatcaagcagtcttccaagtacttcatatttattaattcccttcatctcaacaactctatgagttgttcattatccctccgttttacagttgggaaatctatgatacatagattttgagaaatgggaaaactaatgcagagaaaagaagaataacatgcctgatgtcagaactagaaagtggctgacccaggagtagaatctcaggtcttctggccccagaaaacctgttcttaggcaccatcctgtcgcctgtcattgcatcaatgtggtaaggcattggtgtgtctttaaggctccagaaagttctttctactttgtatttattttgttttgtttttgagacagagtcttactctgtcacccaggctggagtgcagtggcaccatcacaggtcactaaagtctcaaccttctgggctgaagagatcctctcatctcagcctcctgagtagctgggactacaggtgaatactaccatgcccagataattttaaagtttttttgtacagatggggtctcactatgttgcgtaggctgttctcaaactcctgggctcaaccaatcttcctgcctgagcctcccaaagttctgcaattataggcatgagccactgtgcccaacctttactttttaaaagtatcatattgtgactttgagtgcaccagcagtgctctagtgctggtctattagaaatgtaattttaagaatatatatatataatatacaattttttagtggccacatttaaaaggtaaaagaaacaggtggaatttatgttcataatatattgtgtttaaatgatttatccaaaatattatttcagcatgcattcagtattaaaatattgagatatttattttatttttgtactaattctttgaaatctggtgtgttttactcctacagcacatcttacctcagactacccatgtttccagggctcagtagctccctgggactcatggccgccatattggacacagcaagtccagatggataaaggtccatttgggtcacagcccctgcagtacatactgacagctacctgggaagaatggagagttccatgacccaaagggcctcctgagggaggaatggcagctctactttccagccaaagcaggaatattgagggcactaagaaacaagggaatttttacagtgtgtttcacacttcttcccttctcaaagacattaaatataacttcaattttaaaggtgaacctcggccatcaaaggcatgttttctattggtctctttccggtggaatgaatggcaatggtccctgtaaattgtgctccaaggatccctttcagtgggaagattcttgtgataagcccaataacaagtaagaaagcaattttttatacatagatctagaacaaaaagggctcatgatgaagaatattttattgaagcttagtgtattgctatttttcataaattgctgtttttgcctatcccacaagcactgatcacttttatgaaggtacattctccaagggtcgtcttagcatgtcaggacccacaagcaaaggtgttacaagtgacctgcacgagtggccagcaggacacctggaggagcccagtgagatgaggagtggatgcgcatcaggtgggaaggcatggagaagctgtgtgccacacactcaccaaggacaggagcgggcgtatttgtggcctgtggcctaatcttaggtcagttacctctttagactaaatcccaaggagtcagcacatggaggtttcggtccgtgcacatggcacctacagggcttcacatgacgttgctaattacaatgcagcggcacttacaaaggaattagtttcatcacatcctcagcagaactaggtctaaaaaccaatatatatgtataggatatcaggtgagaaatactttcttgccaatcatgtgtattaacgttaaagtggttcagtatctagtgtgacagttgttcaggcttagtggccttgaccacgtcaaaaatggaatcctgatcctaacttgtctagagattagcctggcacaaggagcatgaccaggcatctggatgtccccagtgtcactgcagacacatgctcctttttcatctgccagagggagcattaggatgtcctcacctctgtccccagaactcaggaagggcagtacacctgactaaagagtagagggttgtgaaaagagggacctagggcactggataagcaggaggagaaggagcactgggtgggaggtagagaaaggagggggctgaatggttaggctctgaggtgtgtctcctggatggagtcttggattccactcactaccatctgagaactttgagaaaaccgtgtaacctcctgatgttgggtctcttgtcagtagacatcagtgctttcctgatgtatagggttactgtagaattataatgaatgcctggttgaggtgacatgtctaatacaccctccaaagcatcaggcatatattaagtactcataagcaggcattctgtgtgaactagtcatacatggaagatgacattccccgtgtgggcacagtaggatgctgtggactttggtttggggaccctaataacttcaagtcccctggtagcacccaagtgtaaaaggcaaagggcatgactggtgcttcctgtgaggcctcttctatttggtaaaattcactctccactcatcgcacccacctggcctttattctaaacttggaaaattgctaacatgaaggtctcagcctcagggctcagataagaactcagacacatcaatagagaggatggctgaggtgcttggccgagctcagtgaacaccccagaacaggaactgaggagtgtatgcatgtgttgggggcagcactttctcactcatccagaaagtgtgaggaatctgtacagaactggggacagggcccatttttatacccttctataagcccagcccttgtctgctcactagggagccattcaccaaggccacaggagggaaggaagtagatttgcatgaagagcatccccttcctatgttaagagaggcctggaggccccttcccagctgtggactcagaggcagagctctggggcatctccaccatggcctggacccctcccctgctcaccctcctcactctctgcacaggtgctgcctcctagggctcagcccccacaggaccaagaatcagcctggccctgacattcagctcagcacagggagtaatgcagggtgtggggctctggaaatgagacccttatcttcagactcacctcttctctcttctcttgcaggctccgtggtttcctctgagctgagtcaggagcctgcagtgtctgtggccttgggatagacagccaggatcacctgccagggagacagcatagaagactccgttgtaaactggtacaagcagaagccaagccaggcccctgggctggtcatctaacttaacagtgtccagtcttcagggattcctaagaaattctctggctccagctcagggaacatggccaccctgaccatcactgggattcaggttgaagacaaggctgactattactgtcagtcatgggacagcagtcgtactcattccgcggtgacacaggcagaaggggaagtgagacaaaaaccttttctccatctgtcacactctttcttcagctccaggaaaaaactgtggacaaattcatgagcaggtcttgccctgttcacccagatatgagaccttgaggctgcccttccctccaggtctccaggtaggctatgaaaagggtgaatcaggagtcaatacacacacaattattataattttattcttgtttgaagaagaagtagaggaataattgaacatgtaaagtgaaaacatggaaaaccgaaaaagaggaattattgaacttgtaaagatgaaaactacaatgtctgaaatttagaaaatacactgggtgagtttgacaacagaaaaaagattagctgcaaaaaaaaagattagctgcaaaaaaaaagattagcaaattgtataatacagcagtagaaattgtccaagatgaaacacatatgggaaaaataattatggaaattaatgatagaaaggaacagagtatcagtgagttgtaggacaacttcaaacagcctaaagtatgtgtaattagtgtttgaaatagaaatgggtggaggagaaatagaaaaaagtatttgcataaataatggccaaatatttttcacctttggtgaaaaccataaactgaaatatccaagaagctcaacaaaattcaagtataggagacatgaaggaaacaactccaacataaatcataatcaaattaataaaatccagtgatgaagagtcacctaaataataatgctaagagcagttctcattaaaagcaatgcaagaaagaagacggcggagcaatgtcttgaaaacactaaaagaagaatcctgtcaaccttgaattctttttcttttcttttcattttctttctttctttttcttttcttttcttttctttttttctttattttttttttttgagacagggtcttactctgtcacccaggctggagtgcagtggcacaatctcagttcacaacatccagggcttacatgatcctcccacttcagcctcccaagtagctgggaccacaggcgtgcaacactatgcccaggtaattttgtattttttgtagagatgaggttttaccgtgttgcccgggctgatctcaaacttgtgcacttaagcaatctgcccgcatcagcttcccaaagtgctgggactccaggtgtgaaccactgggcctgccaaccttgaatttttttaataaaaacaaacaaacaaaaactttcaaaaaaggagacaaaataaaccctttccagacatatgccaaattaaagaattggttgctatcagactcttacaattagaaatggtcaaggacatccctagacagaaggaaaatgataccacaatgaaatgtgaatttataccgaaaaatgaaaacatcagatatagtaaccacaaggataaacatagaaacctctgaattgtgttaatgtctaataaagataattaacacttcaaagaaaagctaacgtaaatacattgtgatttgtaatgaaaatgaaagtaaattatgtgacaaagcacaaaagctgaagggatgaacaacatgttataatggtcttatactatatgtgaatatataataacacttgaaggtaaaccttgataagttatatacgtactgtaaacccaagcaatcattaagatcaacttttttttttttttttttttttggagtctggctcagtcgcccaggctggagtgcagtggcacgatcttggctcactgcaagctccgcctcttgggttcacgccattctcctgcctcagcctcccaagtagctgggactacaggcacccaccactacgcccggctaacttttttgtatttttagtagagacagggtttcactgtgttagccaggatggtctcgatcttctgacctcgtgatctgcccgcctcggcctcccaaagataaacccttttaacagaaataattatggctagtaagccatattagagttctccacagaaacaaaatcaataggatatgtatgtgtgtatatatgtataatgtatatatgtgtatatgcatgtgtacatataatgtatatgtgtgtatatacatatctaggtacatatatatggagaagaaattggttcatacaattgtggctgactaggatgaaatctactgggcaggctgaaggctggacatttaggtaagagttgatctcgcagttttgagtctgaattctgcaaggtgggacttcaggaatcctcagtatttgctctgaaaaccttcagctcattaatgatgcccacatgcattgtggagagcagtgtgcttatataaagtctacagatataaatgttaatcacatctgaaaattatcttcgtgccaacttctatactcgtatttgacaaaatcaactaggcactatacctagtcaatctaacacttaaaattaaacatcacttaaaccagcaaggagataaaaagaaataatttttaaaaatcagtcaaaaaaaggaaacagaaaaagggaaggagaagcaatgaacatatggcacaaatagaaaatgaagggcaagttggcatatttcaaccaaattatgttactaatcacattaattgtaaatagtctaaatatcacaattaaaaggcagagattgtcatgttgaaatgaacaagactcaactatacatgctgcctagaaaaaaaaccacttcaaattataaaaccacaaaaatccaagtacaaattaaggacaattccccccactcccaagtctgtttcacaaagcagtacaaagaaggattcacagtaaattttttttttttgaagtcttactgtgtcacccaggctagagtacagtggcaccatcttggctcactgcaacctccaccttccaggttcaagtgattctcctgcctcagcctctggagtagctgggattgcctgccaccatgtctgatgaatttttgtagttttagtagagacagggtttcaccgtgttggccaggctggtctcgaccttctgacctcaagtgatccgctggccttagcctctcaaagtgctgggattacaggtgtgagccaccatgcccagcccacagtgaactcttaacacacagttatagaaatatgcatcacctctcccatcaccctttcctctctctggcttccaaaaccttggttctggtaccagagctgagggaaaacattccacagaaatattaaatcaaggtgaagaagggagattctcaagatgtaagtaaaaggcaaatgagggaatggaagtcgcaatgcccttgcatgcataaggacagctcctgcatgagaatgttgtttgaaacattaccgaggaattggtgtccatgttcatgcaggacataggtctataggatatttttgtcatgcctttgtcgggctctggtatcagagtaattcaggcctcaaataggtagtagggaaatgtttgcttctcctctatattctgaaggagattgtgtatgattggtgtcatttcttccataaaaacttgatagaatttaccagtgaagtcatttgtactaggtgggcttttcttagcaggaagattttaaattgctaattcaatatatttatgtgtcatagatctattcagattttctcctttatgaatcgattttgataatttatgtatttccagatacttatccacttcatttaagtcatccataattttggcatttattgttcgcattattccctataaccattgtaccttttgtaaggtcagtggtgatgtcactctttaagtcatggttttgacaatttgggtcaggagaagatttggaggaggagagaacaaggttgtcttgatgttgtcttggctggagtgtgacttggagaaaaatgacttgaatgaaaatacagtcagagggagatatctgtcaagtggttctggtgcctggatttccacatgtgtggtgacggagcccagcccagtgctctactcatgcccagatgtcctggattattcccctgaaatactcaggtgaagctccagctacaccatggcatcctgatattttaaacagagaagaccagtgtcatgggcactggtgatctgctcctcagggcagactcactaaccgtggcagctgggaatcccaggggcctcacagctctcactaaccgtggcagctgggaatcccagggtcctcacagctctcactaaccgtggcagctgggaatcccagggccctcacagctctcactaaccgtggcagctgggaatcccagggccctcacagctcttttctccctcaaattgctgctggctacagagaactgcctccaccaagggcatgcccctttcacagtgtggctcaggcctaataactgcatgagactgaaataccaaggccctgtctcaggttaggatgaccttgcagggcctcccagatgagtcctcaactggagtcagatttcaggctgcccagttgtgcccccccatacttccttccagagcgaatatctccaaacactactgtatgcaattttccctctcagagtctgattccagggaacacaaaatagaaaacagtctacaaggaagagtacggaagaagagagagcagcacagagacaggactctggaatctgcaaatattcctgagcactgatgatcccatgagtggaaggaaaatacttaaggccaagaaaagaaccacccaaagacatttgagggaacaattgcagggcatgtgcatgcgcgtgtgtgcgcacacacacactcacacacacacacacacaccatcagaatagagtttgttcctacaaccagtgtggaaatgtgtctaatcagaggcatcaggttaactaatcagaatttctctgccctggctgagcaaagtggcttacacttgtaatcccagcaatttgggaggctgaggcaggaggatcacttgaggccaggagttcgagaccagcctgggcaacattgtgaaaccccatctctacagaaaacttaaaaaatatagctaagcatggggacatgcacctgtagtcctagctaatcaggaggttttaagcatgaggactgcttcttgagcccaggagttcaaggctgtattgagccatgatctcgccacacagtttcaaaaaaaagaaaagaaaagagaaaaaaaaatgaataagaaaagctctgccttagtatagggggaactaactatagactaaaatctgctcctatccctcctaggacaccgtaagagcaagttcagaaaggaacatactctcttcaagaaacccttctgaatcaaagaagacaaaaatatgtggagaaatataaaaatatcatgcacctaaaaagcaaaacttcacgatgtctggcatcttattacaatagcaggacaacgtgagtcagaagtaaaaaagttggtcagcgcatcatggccctgaaattgcacaggtaatacactttctagaccagaacaaaaagcagttgttgtaactgtaatccatttgtcctggagggtagagtattgatggaacaagttaaatggagacatgaaagacatttaaaaaacacctacatttaagtcctagaaatgaccacagaaatatatgaaatcaaagtactttgaatgagattgctggtatattacatgctgaaaaagaagagattagtgaatctgatgatatagtaatgagaactattcaaaatgaaatatgcaaaactactgaaaatgacaagaaaagagcatcgttgagttatgggacaactgcatgccaatgcaacctaaaataacgtaatttgtgttactgaaaaaaagaagttggtgggggtaggggagtatatagaaaaactacaaaacaaaataatgactaaaaatgatccaaattttgtgaacatcataagccatccattttcacgaagctcaaccagcccctgacaaaatatattttaaaatataaatacgttaagataacaataccaacacatatcataatcaaattgctaaagcacagtgatgaagagacactcttaaaagcagccagaaagaaaagacatgttagatataatactaagagcagagttctcattagaagcaatgcatgcaagaagacaggtagctacatctttataatattaaaaggaacaactgtcaaccctgcagtctttacccggtgaaatatctctcaaaaatgaaggccaaataaaacctttttcaaataaataaaacttacagaattgataaatcacaagccgtcactaaaagaaatgatgaaagacatccctcatacagaacaaaaattataccagatagaagtgtgaatctgcacaaagaatgaaaagcatcagaaatggtgactacatggataaatattttaatagtgcataatgtagaaataaaagggcttgaacagcactatagaacaactagacttaaccgatgcctgtagaactcttcaagcaacaaaagcagaatgcacattcttcttgcatgcacatggaacattctccagaaaaaccgtataaaacagattgataatttttaaaaagatagaaatcacacaaagtatgttcccaaaacaatgtcattagagaaatccaaaaaattgagggaagaccatgaaaactgcatgaaaaaaattgagatgaatggacaaatcactagaaatacaaattctattagaagtgactcaagaagaaatagaaaacccgattaaaactatagaaagagattaagttaataataataagaaaagccttcccataaggaaaggcccagacacagagggcctcactggtgactattaccaaatgtttaaagaagaattaatataatttatcattaaacttttccaaaatataaaagagataaaatcacttgccaactctttctctgaggccaatattaccctgataccaaaaccagacagagccattacaagaaaagataaatacagagcaatgaccttactggatatagatactaaagtccttaacaaaataccagaaaatgtaatctaacaagatataaaaagaagtacatacaataaccaagtggtgtttatccgaggaatgcaatgatggtttaacatctgtaattgaattaattaatagaaggcatcgtattaatagaagaaaggacgaaccatattgtcatctcaaaatcacttaaaatgttttcatgcaagcagactttctttcttgctgtttttaggccatcatgagaagtggagatggcatggggtagtatttcatgcaaagaatctggatattccatactcaactgtgaggatactttctgataaatgtaaaagattgtaatattacgtttctgtatgttcagagaacacttcctagacaagatatgtgtacagaaccgaaaggacaattaggattttggcaggcattgagtgaggagtggagtcactgcaagtgtcagtcagagaacaagaaagatgttaggaaccatgtatttctacctggccatcctactgggataccatccccttcctaacacatcacccatgtggcttgtaaaaatgtccatacttgaaacattttgtccacataattacaggtctagtgctggaatcaagttccctttgatgacatcaggacagttaaaggatctgcgtgtctaactgcccccaggtgatgctaacattgctgccctctgaggaccacaagcaaagtagctcagctcctgacctcctgctcccagcacaggtgagatgcacctcagctacatctgtgaagcccaggagactttctctccctcctcaggctccctggagtgatgacccaggactcatgcctctgcacatttatcctttccctcagagtttggggccttatcagtcctgttacatcttctcagcatctgaaaccactggagaggtggtcaccatctcctgtgctgacacagcagtgacattgggggttataattctgtctcttggtaacaaaagcaacagggaagagccccatatgactgaggggtgagatcaggaaaaagcctcagagattccagttctaatctcaggccgttctttgtattcttttatgagctagttagtcagctggtcagtcagctgtggccacaagaagaaatggaagagaggttcagaaaacagccctagagaccatagacccagagctctagagacagcaggcccaatgtgctacacagggccacagggaaaggcatcaggttcattagaagacagaagacaggagggcaggggatcccttagaccatgacttttatcagaatttcctcaggaaaagcagggcaagctaaaaaatttatgattggccagcctgaataatgtcagcaggctttgggctactaaggtggtctctagctgcttggtacctggccctgggacgataaaggcagaggaatattgtatcctgggatgcacaaaccagacaggggtggtgaggctctgaacacgttagtttccatatgaaaggcaggcttctggctgagcccattgctctttcaaggaatagagaactggggagacccaggaggggtggtcttttcccagacagaaatgttttttaagatgtcaaaatatcaaaatatatagaaaattatatacagttgacccttgaataacattggtttgaactgcatgggtccattgattttcttctgcccctgtcacccctgagacagcaagatcaacccctcttcttgctcttcctcttcagctactcaacccgaatataaaaaagataaaatcctttatgacgattcagttccatttaatgactagtaaatatattttctcttccttatgatttttaaaataacattttctgttctctggcttacttcattataaaaaatactgtatataatatacataacatacacaatctgtgttaattgactgtctaagctaggcctggctctgaccctgatcctgggagacactttaggcagattactctggaaataagtccctcagtctctgaccatctctctctcctcggcgggttctctgtcctcccatgggagctcagtgcccatggtgcagacagcccctctcagctgctcaggaccaagtagggaagctctgctctgtcttggtacccgcagaacccaggctggtgcccatgctgggactttaatgtggtgacaaaactcctcatgcagtgctgattgattctctgacagtgtctaggaatgtaattcccctgaccaggggacaggttgaggatgagtttcaggggggatgacaacaagacttccaatgacacagccacagggagaattgagatgcacaatctgctgtccccagcctggatcacacgctccccctgcatttaggaaagttgcttagaattaggctgaagaggtcaggattcagttttaacattgacctctctctcattttctcttttactctcttttctccttctctcttcctctctctttctttctctttctctatgatactgaagcccttattcacccccattctcagctatgaaatggacatggaaccctgacatcgtgagtttcctcaaggatcacaggagtggagtaaagatctgagccctgtctccaggtgtcctcaagggtctacatcacaggctcctccatcctgctcttcccttacacaggggctcccctcagatcctgcccatgcctaaatttaggccccatttctttgagacctgtggacacttcatcctgaggttcctgagggtttttctccctgctgacgggagatcccactgatcacatggtctgcttgttgtttctcaatcctggagcacagctgcaagtgtcacctgagacacggccaatcccccatacaggacagcagtgaaggtggaagaatcccagagtgaccgggtaccgtcattcattcaaattccatggggctcttgctgcatcactgggtgtcatcctttgggaacctggacttctaaactataagactcagagttagaaaacagaatcataaattccccatgtaagccactacttccacccctggtcctggactcagatatgttactaatgaggaacacagttcctcatagtggctgctgattgaggacatggtgggcaaactgtggttgatggacacatctgtcttgcatcctgcattggaacacagtcttgctcatgtctttatgagtgacatgtggctgttttcatgctgcaatacaaggcttggttgtggtgacagagatcctatggtctgaaaatctgaaatactatactaaaggtcccatactgtatcatgtcttctacatgaattatctacaatagacaaatccatgcaggcagaaagaagatgagtggttgcccagaattggagaaggtgatgaaagaggagaggctgctcactgggtgcagaattttcttttgggtgatgaaaatgtaggagaactacacacacagctggtggctgcccaacaaagtgaaggtgctaagtgccactgcgttgtacattttgaagtgattaattctaggttatatgaattccacacaatacaaaactatgattttcagaaattgactgttataattgtgttattatatctacaactttatgatggcactaaaggaccatgagcagtcaatgcaaaggatccagacaatatttcaagggctcttccagagtaacaagacatgaaaaggcagctctggttctctcttgcctggcgtattttaccctcggagttttttgtttttttgtgttgttgttgttgttgttgttgttattgttgttgttgttgttacagagtctcgctctgtcgcccaggttggagtgcagtggcgcgatctcggctcactgcaagctctgcctcccgggttcacgccattctcctgcctcagcctcctgagtagctgggactacaggcgcccgccaccgcgcccggctaattttttgtatttttagtagagacggggtttcaccgtgttagccaggatggtctcgatctcctgacctcgtgatccgcccgcctcggcctcccaaagtgctgggattacaggcttgagccaccgcgcccagccaaccctcggagtttttatgagcaccgaagggtgcagggagctggaagctacccaccaggtgcctggctcactcatgtctgggtgcagcagctcccccaacaggcagctggcagaactgaaagggaagagctatatccttctgagcccccacaattgtggtgcaggattgttcccgacactcccatccagtctgcttgctcctgcacacttagaaatgatcattatttctgcccaggacctccctggtcttgctctcccctcttcctccccaggcgaccttgggaactttactcaccctctggcccttccctcctctgtccagtgttttccccacccactgtgatcagctcagatcagcgagtctgtgggacattagggatcagtcacccatgtgaggccctcgacggggtcccaggatggagcagtgtatgtccccacaaggctgcttattgcacaagtaatggaggaacaaaggggtgggtaagccccctcctgggcagcttcagaccctgctaaaataggaaacagcctggggcaggtctgaccccacttgtgtctctcctgcccccaccccagcagcagcgtcctggaggccataccatgtgctaagcagatgccaagatcacgtcattcatcatcacctggaaattcccctaaccacaccttaatacgctgcactcgtgcctcagctaaaagtatcacacactgcattgcaatgagtttggatcccagacccccttgatgtttgtcactgctctttcagatcctcgaaaacacctacccctccctgcaggtcagtgacagactcttcttcctcacacttcctttcactgtttcttccttcctgagagcagctccagagactcctcttcagggaggcgccccaacctctgattacacagcagtctgcctgtcattttctgtgtatgcattctattaatgatctgcagagcacctaaacttcatgcctcttttcctaacatgtttattaattgattttctggtgctaaatactcctacaatcaatcaaaaatgcttctcctctgcttggacactcatgagaaacagtcatgaaccatttgctattttatcctcaaaaagtaagtgtggagttcactgctgttccccacatactcaccaaataatgagaaacccagcaattacccaactttctgctccaccatcatgacacagtaggcttttctttcatttgtgtggacttaagacctcaggatggctgctgcagctccagctattatacccatattcaagagcaaaggtgctgcacgaaaacagtctgtttatttccatcacaagagaaaatgttccctgagaagatctccaaccacctgacccttacagccctggggccagcatgggaccatgtggtcagtccaagccaagagtgaccagggaaaacaaggatctttttgtaaataaatagaggagaaaatacacaggtagaagatggtgcttctactacaaactgtttctattacacagccccaacccccatgtaggaaactcctggggtcagagacagtctttctcgtgctgaattcccaggatggaatattgccggatcagagtgggtctcaataaatactggctgggtggatatgctcctgcctttgtttttggggcaggagccaccactgcctcatgtttttctacacctggagccatgaaacttggtgtctgaggtctgcggcactatatgcagagccttggtaagatgcactggaccacttaccaacccagtgacagtagagggatgtcttaggtgggccctacccattttcctccaataggacgtgctcataatttcatgggtaaccgagccccttatgcctggtattgaggcatataaggccaaataaagaagaggaattcctctcttggaaccagcagtccatggacaagggaatcagggacctgagcagcaggttctgaatccacacctgatctggggcaggacccagaacctatcaaagtcttctgctgttaactatagaatgggctcacaaaatgcagacagaatgatctgtgaactccacctggcctggctagctgagaaccaaggccaagacatagtttaaggtaaagatgttggcccagactttgggaccagcaagtgaaggagaattctgtgggctgaggtgggtctgtagggtcctcccctcccctctctgtgtcccttggggctgagcccttctctggaaactacaaagctactccagtagcagcccctgattctgctgacttgcatcacgggccgctttctccatcaaggggataagagaggcctgggagaaacctacccgccctgggccacaggaagcagcatcagggatgtctcagtcatggactggacctttctcagcctcctcgctcactgcacaggtgctgccgccagagtcccagccacccgcccagccccgggctgtgggaccaggctggccttgattgtgagctcagcagggctctgcctgtggtggaaaggatgctcatgaccttgctgcagggtgaggggctggtaaggttgaaatcttcctgtactcctgtgctcatgggcactctgaggggcacagtcaggctccctttcatcccagaagctctgtcccagccaggcaggtgcaaaggaatcctgaggatcagctcctcagcttcaagccttttctccctcatctcctgcaggtttcatggccacatatgagctgtctcagccaccctcagtgtcagtggccccattacagatggccaggatcacctgctgtggaaatactgttggaggtggatatgtttattggtaccagcagaagtcaggccagacccctgtgccggtcatctataaagacagcaagtggccctcaaggacccctgagtgattctctggctccaacttgtggaacacagccactctgaccattagtggggcccaggccagggacgaggctattactgtagcacctatgatggctgagggagcagcaggcagtggctcacagtgaaacagacagatggggatgtgggacaggaacctctaatataactaggctcaatatctcacatcctctctaagccaggatgtccaacattttggcttctctgggccacattggaagaagaaaaattgtcttgggccacacataaatacattaacactaacaatagctgatgagcttaaaaaattgcaaaaaaatctcataaagttttaagaaagtttacaaatttatgtagggccacgttcaaagccatcctaggctgcatgtggcctgcaggctgcaggctggacaagcttgctctaagcagtgaccatgactttggtctcagttcactcaggtggtttctcatggtagccaaagcagcaggagaaactgtcggatttctatttaaccatgaattttacaattacattcattgtaaatccaaacatcttgtccctttattacctgggccctacagagactagtgcacaggttcatgggataagaaatgtctccagagagcttggtttctgcactagagacagtcgtttccctccctttcaacacagagtgtggcaggaaaggaaccagttctctgagctaaccctgagaacttgggcttgagaaaaagaaagcattttgaaccagtaggattgtgcccacagaatgagatgtgctactctggcccagcccaactcctttcatttcaggagctctgtctgggccaggcaggtgcaatggaatcctagggatcagctcctcagtttcaagccttttcttctctgggtgtctgagaacaggagttgtcttgcacgtgcacatgagaaagaagtgcacacacgactctcaggtgtgagcagcaaagacagaacaaacctttccagaaggggcaaatttcattaagatgacagggccttgttacacaaccccacatgtctggactgggatctcctattggatcttgccataaatgcaaggtttcttctcccatcataaattcctgcattgcagtagacccagctgggttctagggctcaaccagcagggcactcccaccactgtgtggacctgctgcagagccttcctgctctaggacccacagacatgcaacttttctttgtttttgctatttgggttggagcaacatcccaagagtgaataatgcttcttccagaatccatcatgaccatatatacttcttgatgcgaagttaggatgtaataatgtgtcctttttttctatgggaggtgctcagctgttccaaacaagaagaccctaaacatttctgctcatatgaaggatgactccctaggtttgctttcctattctctgaatgcatgggtctccccaaatcttccaatgacctttcactgcatgcacatctcatccaaataccaccacatggtggatgcttgggcatggtagcgggtgcctgtaatcccagctacttgggaggctgagacaggagaatcacttgaacccaggaggcaaaggttgcagtaagccaagattgcaccactgcactccagcctgggtgacagagcaagacttggtctcaaaaaaaaaaaaaaaaaaaaaaagaaagaaaagtttatatttttgttctaatggttatcttaatatcttcattctataattatatgttttatataattataatagctatataagatataatacccctagtatgttgttttttggatattctacttgctcctgatggttaatttatgtgtcaacttggctaagctatggtgtcccgttgtttggtcaaatacttgtcaatatcttgctgggaggttatttcatagatgtgattaacactgacagtcaattgactttaagtaaaacagatcacccaccataatatgggtgggccacctccaatcagttgaaggccttaagaacaaaaactgaggtttcccagagaagcaggaattctgcttcaagactgtaacacacaaaccctgcctgagtttctggcctgctgactgctctacagattttaggttccagacttcgagatcaactcttacctgaatttatagcctgctggtttgccctacagattttaaacttgctagtccccacaattatgtaagccaattcctaaataaatctctctatgtataacctattggtttagcttctctgaaaagctttcacatccagtttcctggatgttaagaattactgaaactagctagtaacttactttttttttttttttttttgagacagagttttggtcttgttgcccaggctggaatgcaatggcacaatctcagctcacctcaacctccacttcctgggtccaagcaattctcttccctcagcctcctgagtagctgggattacaggcatatgccaccatgcttggctaatttttgtatttttagtagagacacggcttctccatgttggtcaggctggtcttgaactcccaacctcaggtgatccgccgccttggcctcacaaagtgcctcacatgagccaccacgcctggctcctagtaaattcttcttttccgtgatgtgtctcttacctctaataatacttttcttcttaaagtctacttcattaaaaatagttatgctgggcatggtggctcatggctgtaatctcggcactttgttggaggtcgaggtgggtggatcactgaagcccaggagttcaagaccagcctgggcaacatggcgagaccctgcctctacaaaaaatacaaaaattagctgggtgtggctaatataattctaagttggcacacttgtagtcccagctacttgggatgctgaggtgggagaatcgcttgagcctagaagggagagattgctgtaagccaagatcacatcattgcactccagcctgggagacagtgaggctctatctccaaaaaaaaaaaaaaaaaaaaaaaaagttatacagctttcttggttagtacatgcatgacatatttttcattattttctacctctctgtatccttatataaaaggcattagttgggttttactttattttcaattattttaatttttattgtccttttaaatgtaactaatgatttatttacgttgaaacccaccaccaatttgttttccatgcctattctatttcttcttatctcctctcacatcttgttttggatttattatttttattatttaatttcctccttctctattagtttcataactgtgcagtcttagagttattttaaaagatgacagtggattattttagagcttacaacatgcatccttcacttatcaaagcctaacatgagctagtactttttgttgtggttgagacagagagagtcttcctctgctgcccaggctggagtgcagtggagcaatcttggttcactgcaacctccacttcttgggttcaagcaattctcctgcttcagtcacctgagtagctgggaccacaggtgtgcaccactatgcccggctaatttttgtattcttttttagtagagacagggtttcaccatgttggccaggctggtcttgaactcctgaccttaagagatctgcttacctcggcgtcctaaagtgttgggattacaggcgtgagccaccacgcccagcctatgagttagtacttctatcctcttcctagtcagtagaagaaccttggaacaggaactaaatttacccccagtgacttatatgctaatatttttgtgtattttaaacatatgtgtgtgcatagatgtatctgtgtgttttttgtgtttttattcttatttatgttgagagtgtagagctatgtaagagtaaagagaattgtgtaatgaagccccgagtatccattcaatttcaacaacaatcttatggccaagctcatttcatgtatactctttcctgcttccctctaccccacattatttcagtgcaaatcccagatatataactgtacccatacatatttcagtatgttttatttattttaaaccccacaagatatcattttctatactactgtaatttcataccaataacattcatttagatttacccacacatctacctcttctgttaccctttatttttatttataaaaatatctttgggaaaaaatatccttcagcacatggtcaaggatctcctgagggctatgtcatggacaaaatatacatatatattccatatatatacacacatatacacacacacatatatacacatacacacacacacacacacacacacacacacacacacatatatattccactttcacttttttgtttgttttttgagaccgagtcttgctctgtggcccaggctggagtgcagtggtgggatctcagctcactgcaacttctacctcctgggttcaggtgattctcccgtctcagcctcctgagtagctgggattacaggtgttagccatcacgtctggctaatttttgtttgtttgtttgtttttgagacggagtatcactctgttgcccaggctggagtgcagtggcatgatctcggctcactgcaacctccatctccctggttcaagcaattcccctgcctcagccttccaaggagctgggattacaggtgcatgccaccatgcctggataatttttttgtatttgtagtagagaccgggtttccctatgatggtcagactagtcttgaacttctgacttcaggcaatccgcccacctcggcctctcaaagtgctgggattataggcatgagccaccgtgactggcctgttttttttttttttgagatggagttttgctctgtcaccctggctggagtgcagtggcaagatcttggctcactgcaacctccacctctcgggttcaagcaattcttgtgcctcagcctcctgagtagctgggattacaggcatccaccaccacatctggctaatttgtgtatttttggtagagatggggtttcaccatgttggccaggctggtctcgaacttctgacctcaggtgatccacctgcctcggccttccaaagtgctgggattacagggaggagccaccatgcccagccattttcacttttgaaggatattgttagtgagcatagaattctaggttggcagatattttctttcctcagtttgaaaacatgattccttgtatctgatttctcctgcttttattgggaagccaattctcaatctaattttgctcatttgaaggcaatggctttttatgttgttgtgttttctgagatggagtcttactctgtcgcccaggctggagtgcagtagtgcaatctcagctcactgcaacctctgcctcctgggttcaagtgattcttctgcctcagcctcccaagtagctgggattacaggtgtccaccatcacacctggctaattgttgtatttttaatagagatgaacttttgccatgttggtcaggctgatcccaaactcctcatttcaggtgatccgcccgcctcagcctcccaaatgctgggattacaggcatgagccagcccccaaccctggcctgaaggcagtatcttttttcctctggctgctttgaaaagttttgtctttgttttgagcagtttacactgatgcattgaggtggctcttcattccatgacttgattcttttttgtccattttagaaaattgtcagctttatctcttcaagtattacgtcttccccatcctctctctactctccttatgagactccaatttcacatgacttatgccttgttaaagtatcccccatgtctcttaatccattcctgtatgttctatctatttttctctttgtacttcaatttgtatagtttgtatcaaactatctcccaattagccgggcgtggtggtgggtgcctgtaatcccagctacttgggaggctgaggcaggagaattgcttgaacccgggatgtggaagttgtagtgagccgagatcatgccactgcactctagcctgggcaacagagtgagaccctgtctcaataaataaataaatacatacatacatacatacatacatacatacatacatacataccagttcactattttttttatgtttgtgtctagtgtgctgttcaaattgagttcctaattccattttttttgagacttttttttttttgagtctctatctgttgcccaggctggagttcagtggtgcaatctcaactcactgtagcctccatctcccaggttcaagggattctcatgcctcagcctctcgagtaactgggattaccaccatgcctaactcatttttgtatttttagtagagatggggttctgccatgttggccaggctggtcttgaactcctggcctcatgtgattggcctacctctgtctcccaaagtgctgggattataggcctaagccaccactcccagcctccatttttttttttttttttttttttgagacggagtctcgctctgtcgcccaggctggagtagagtggtgcgatctcggctcactgcaacctccccctcccagttcaagtgattctcctgcctcagcctcccgagtagctgggactacaggagcatgccaccatgcctggctaatttttgtaattttagtagagatggggtttcaccatattggtcaggctggtcttgaacttctgacctcaggtgatccacccacctcagcctcccatagtgctgggattacaggcatgagtcaccacacctagtgcatccattttttgtagctgccagttttctgatgaaattcttaattatttctttatatccttgatacacatgtaaagaatttattttaaagtacatggtctgatgattttatattctggagatcctatgggcctttttcaaagttgtctgtgctttctcttgagttttgttcctgctgtcttatttccttgtttgcttggttgtttttaatttggcaatggaagttgtgtataaaaattgttacaaataattttttttttttgagatggagtctcgctttgttgcccaagctggagtgcaatgatgtgatctcggctcactgcaacctctgcatcccagggttcaattctcctacctcagcctcccaagtagctgggattgcaggcaggtgccagcacgcctggctaatttttgtatttttagtagagatgggttttcaccatgttggtcaggctggtctcagactcctgacctcgtgatctgcccacctcagcctcccaaagtgctgggattacaggcgtgagccactgcgcccagccagaaataatttttaaaaataatttcgagcccaagcatgatggctcatgcttgtaatcccatcactttgggaggctgaggcaggcagattgcttgagcctaggagttcaagatcagcctgcgcaacatggtgaaaccccatctctacaaaaaataaaaaattagctgggtgtggtggtggtgtgtgcctgtagtcccagctgtttgggacgctgaggtgggaggctcacttgagcctgggtgatcgaggctgcagtgagccatgatcctgagactgtactccagcctgggcaacagagtgagatgctgtctcaaataaataaataaataaaaataaaataatttgaggcctagggctctgaaattctgagatctcctttatgcatttgagtgactgagatgatctgaagctggatccagtgctcctgagggctgctttatttctggttgactgtgactcctagagtaagaaacctgcaccccatgtgtggggtattatggcatcccctccctcagccacatgagtaagtcaacagcactgctctagaccaggtgtggtggctcacgcctatagtcccagctactcgggagactgaggcaggaggattgcttcaggccaggaatttgaaaccagccagagcaatatattattaggttggtacaaaagtaattgcggtttttgcctttaaaagtaatggcaaccctgtttcagcaaagtaaaaagcaaaaaaaaaaaaaaaaaaaggaaggaagaattaaaaaaagaatcagctgggcgtggtggctcacgcctctaatcccagcactttgggaggccaaggcgggcagatcatgagatcaggagatcgagaccatcctggctaacacggtgaaaccccatttctactaaaaatacaaaaaattagccgggcgtggtggcaggcgcctgtagtcccagctactcaggaggtggaggcaggagaatggcatgaacccaggaggtggaggttgcagtgagccgagatcatgccactgcactccagcctgggtgacagagtgagactccgtctcaaaaaaaaaaaaaagaatcactgctctgtctctcagcctcctcttccaggattggccgtcgccttgaggggaatgctggccttgcctgtctccagccctgtacctctctgcctcctatgcctttaagcacatgttttctatttgctgggctgtgaaatctgctcttcatctgatggggtttgctttataggtgactagattcttttctcttggtggttttagatttcgcattttcacattgaccttaaatagtctgattatagtttgccacggcaaagaccctttgcattgcattgtttggggatatttgagcctcctctatctggatgtctaatctcttgttagatgtgagtagttttcattattattttattaatgggctggcatgtgggccttggttccaggcgggctcagaggggcagctgcctgatgtctgggcagcttctctttctgtcttttcttacctggactctgggttgcttgttagctgcttctgccagttctgagttttcaaggggagaggggcccagtgatggctgttctttgaaggaaagggaagaatgtctcctgtttaacatgtttctatgtttccagttacttggttagttagttagagccagggtctctcgctctgttgcgcaggctggagtgcaatggcatgatcgtggctcacagcagcctccaccttccaggctcgagcaatgctcccacctcagcctctcaagcagctgggactgcaggtatgtgccaccatgcttggctgcctttttaaattttttttttttaatacagacaaggtctcactatattgcccaggctggtcttaaactcatgggctcaagtgatcctcctgcctcggcctttcaaagtgctgatatcacaggcagggtttccattttttaaagctcccagcagtggtataaactcctcctttccagagaaagcgcactctgtccgcatccctcatgttgtcctctcctgcctctgcttagggttcactccgggggaaagtgccacttgagagtttcctttttatgtgtggttctgactgaccgctccctgctcacagatgctgcttctcagggtggggtccctgaggcctggagtgtggcctctgacgaccttcagggccaggtgcggaatgagagcctgtggccacatggcccccggtgggagacgtcccgccgccctttgcttctctgtgccactctggctgcacagttcagagccttgggaaacgttaaccagtaggacctagaaggggaggtgagaaggggtcaccccccaggtgtgcctgtggtgagccttcgtgctgagcaggtgcagggagggaggcccaggtgcacacacctgtgaagtaggggcagctggctgggctccttgacctgctccagagcttcttattttctggccacttcacctgcagaaggcccaggtggctgtagccgctagggtcccttgcagtggaaatgatgcctgtcctcagcccctctctaggcctggcgctgtgctcagcaccgtcgtgtgtgtgtatgtatatgtgcacgcatgtgaatgtgtgcagacatcatgaggtgtggtccctgctgttaggcagcttgccttgtggctgaagtgaaccatcacctgaatcaagggatggaaacacaaggccagatgcagtggccttctatggagtcagacggtggctccgtgacctggcttcactccagaactacctggggtttctagctgtgcaaatcccaggtcccactcagattatgagtccagttctctgcaggtggaacccaggaaggtgtatttttaacaagatggtactgctcattcacccagcccagccagtggtcttggcatacccaggaaccgctgacatagagcttgtgctccccataaagtgggaaacagagcgttcctgggtgggggacatgtggcttggtcatgacagtcagggtgttacataccaggacagactgtgttcgggtgacattaaggacaagctcctgcaggctagctgcctggatagtgctggctgggggtagaagttagaggggtcacagaggggcttcctcccggccccctcatcagctgcttgatttagggcttggttctgggtccttctgggcctgattctgaaccatgggactggtgtggcctgcaggctcctcccgccacaagctgttcatggtgcagggggagaacagtgtccacaattccccagacagcagctgtggatgccaggcccccaggagttgttactgaagttgctgctggacagctcgcctttcactgagctccacatagcacccgtggtgatgggagccggatggagagagcctgccagcctgcacatcagctcccaactgggcggggcagagggaggagggggtggggaccccaggcagcagggctctgggagcagtggggccctgggttccaggggtgtctggcaggcccctccttactctacgtctctcagcctctggatggaggtgctggccgcagtcgggctctgcctctgactaagggttggggaagtggcgggtgtgggctgctgccccgtggggcctctgaacagaccccagggcctctgccaatcatgactccttcctttcagctggacccacaggccctgcaggacagagactggcagcgcgccgtcatcgccatgaatggggtacgtgtccgtgggactctcctggcgcccacttcccccagaaggatagggtggcctctgttcatttcaaatcagtcagaggtggctgagcctgaggcagcatctgagagggagcctggttggagaagggagggcccccaagagcagaatcaccatgcacgggaatcgtcattcattggctggaatgcagttgccagccaggccctgagcatccctcctcaaacaaaggtctcatggcaccaccaggacaggtggggcctccactcagggacctgggggctgcccatagaaatggagacccctgatttgtctttaggtaccccagaaaggtttaggccttaaaagcaatgacacacccaaaaaggcccgggtataaatggtaaaatgttaatatttgagattcttggctttttcttacattattctgtctttcctacttaatttttaattgttactaagagaaagctggtcacagtacactataatctcagctactctggaggctgaaccaggagaatcactggagcccaagagtttgattacagcctgggcaacattgcaagatcccatatcttaaaaaaaagtaagcaagcaagagaagcagcggggattttaggaggtgcttctgcagaaaccagtcgtttacatcatcttcaacaatcctggctcttgctgaagtagactaggggcttccccgaggggcggctccacctcatgctgagacctctgcatgccttgggggtggaaatatttgatgagactcccaggggtccttgggaccttgggctatgaggaccagaaggattagaggactgtgccccttctccccactgtagatcgaagtaaagctctcggtcaagttcaacagcaggaagttcagcttgaagaggatgccgtcccgaaaacagacaggggtcttcggagtcaagattgctgtggtcaccaagtgagtggggaggggcttgggctcacgcactgagggtgcctgtcccttcagctgtttctgcagaaaagagcatgtgtgggtctctcctctctgtgcgtggccactgcacggtgaggtcaggccccagggaacacggcgtcttcagctacctcctgtgtttcctgcaaaccagctcaggaatgtccttgccaccttgcttggaagcagtaggctggctccaggaactgcccaagtgcagggttttctgcccttgcttggaattagtcacggtcccagattcctgttgaatggttgtaacccctgcccctttgtcacgagtcagttgccaagagaagcctgtttgttggtttgagagcagttcatgcagacatagaccacttcctctgagaattcatttgcctccctaggatggaatctggctgggcctctgaccttgctggtcacgtgggccggggcctccatcagtcataccctggactcctatctgtgtctaaacaccacgccccacccccactcgcatagcactctgggagggctgtgggcatgagcagcgaggactccatcagcagctcccccagataagccctgctaatgagggggcttgcgaagcagctttgatgtgctggtaaatccaggtgcaaaacagaactcaagttaaggcctccgcacagcactgcgttctaactgtgaaggattcttactctagtgtcctgtgtggaggtattggaattgtccattgctaagactcagaggagaaaagcacttagcatcgcaggacttggagcaccggtgctgaggcaacccttcattcattcgtcggatgtgtgttaaggcccaggcccagggcaggggtcagggattctcctctcacacagcacgtgggtggcaggaccaacaccgggtctgacctcccagacgggggcacaggctgctaaccccaggcctggaatctgtcagatgcccttcccgtgctgacttgacttagacaggcctcctgaccttcccgcaaaggtcatgtgtgattcgcaggggttctggccgcttgaaaggttcctgagaaagtacatgccatgaggacagagcttgcagagggaggacaggcatgcagaaggctctgtgtgcagccccagacctgggtaccttcgtcaccgtcctcaccccacctccgggtgtgcacatagggagcaggtctcctgtgttatggcccaagcagggctgttaggacactgagaacattccctcctcccgcaggagagagaggtccaaggtgccctacatcgtgcgccagtgtgtggaggagatcgagcgccgaggcatggaggaggtgggcatctaccgcatgtctggggtggccacggacatccaggcactgaaggcaggcttcaacgtcagtgagtgtcggcctgcgcaggacgggatggaggtgtgggcagtggtgtccgcgatgagatctcagagtgctccatggcccaggcatgtcacatccttctctgtgtcttttcttcatttactgttttattattttaaaaaaagagaaaacaagagttgtacaaacagcttctatagaagccagtttttacaccatcgtacccactcatgccacttggtggagtggaccaggggcttctgtggggacttggccttcctgccttgggggtggacaggaggtggaagcccaggactcagtgcggtctgtccactgccctgtatgaggatgtggtgggcagagggcactgatgaaattcagcgcaggccggggctgcagcatctccgcctccatctcaccaaccctcacaggctttgaaggacccagactggcctcaaatgccaggggagggcactgagaccccagagggtccctcccagcatcttcaaagcaacaggattttgtgcctgcaggcccttctttgcagcacacaccacccaccctgaccaggacccctagaatgcccagcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgctatcagacgacactggtgcaggggtggttgctatgtacagggcagagccacccaatccccacgcaggcgctgtgtcctgccatgctggcctcctcctggccatcacatcaggccaagcaggggagaggaatgggaatgcccacgcacccctatcaactctgcagacacagaaccatgcacagctcttgggaggagtcagatgagctgctcaaagcccaggagggacccgcacagtggtcagtgtggcagggacggtgctttagccaaggcagggatggcgggtgactcactcaggatcttcaaggaggccgctgcatttccatgctctttccagataacaaggacgtgtcggtgatgatgagcgagatggacgtgaacgccatcgcaggcatgctgaagctgtacttccgtgagctgcccgagccccttttcactgacgagttctaccccaacttcacagagggcatcggtgagcactggaggccttggcctcgtgggagatgtctcccccatgtgcactgctgccctcggaggctgtgaaaagcgaggtgtgggaacctgagttgtaacccctctgccatggtcggcattttaacccaacctcaaaaagcaggggaccagaaccgagcctgtcctggaaggccttgcccatccccagagggctccccatccctattcctcaaggaggccaagtgggtgaaatggtcagcactgccgtgctgtggggtcctaaagtctgctgtcctccttcctgcagaccagggctaaacactggtgcccaggtgctcttgccatgggtcctggtccagccaagcatggtttcaaacatgacctgacccttagtcaacctggaggctgatgtctagagtgggcgctggagcgtgcagcacctgtggcctctgcatcacccttagggcaggtctgcctcccgggcccatgcacagaggacctggtctcccagcctgcaggtgcccctgtggtgtccaggacgacgagggggtctctgcgtacttggtggggctgggaccctcccacttcccacctccttgtgtccctcactccgctgtttcattccatgctgagcctcccctgccttgggctccctggggagggggtggtggcaggagttgcccaagggctgctctgcccatgagcagctgctctagcggctcctcctgctgctgttcgccaggtgctgctgacccctgcgaggtagagaaaaggcgttcaggtggttcacaccccacacaggtgcccctcacagggtcctcactggcggccagcgctgtgggtgtgacgatgatgacaagcctaaactgcgcaaggactcgtgtcccgggcgctccatgtgaccacctcgggagaggtctccggcttgtcgtaacccaggggagtgacccactgcctcctgcagctctttcagacccagttgcaaagaagagctgcatgctcaacctgctgtcgtccctgccggaggccaacctgctcaccttccttttccttctagaccacctggaaaggtagcccagctctcttgtggctgcccaggactccaggtctccaggccgttggggtgcccctctgctcccaccagacccccagcaccaaggaccttttcccccgacccctgtctgcagtaactcactgcttctaaggactagcaccactgccacccctgcccctgcctctcctctttgccacccgcctccctctgcactgtggccttaacaaagagctcagagctttggccgtggccagcagtgcatttggaccgcccccacttccctcccaagcacatcatgaagacctccccatcagcccagagctggccccttgtcccgggccactgagacccagaagtaccaaggctggagtcagcttgcagcacagccagggtcgaggtcactccctccctgaggactctagcatggcacagcccctctgcctctctcctggtggtggcgttgaaacagcaccctctgcttcggtcctctacagggtggcagagaaggaggcagtcaataagatgtccctgcacaaccttggcacggtgtttggccccacgctgctctggccctccgagaaggagagcaagctccctgccaaccccagccagcccatcaccatgactgacagcaggtccttggaggtcatgtcccaggtatgggaagacagcctccagcccatgcaaccccagcctgacagaggtggcctctgcctgccccacccccagtcctgcccatcttcccacttgcattgtatgtggtggtggctgagattcagagagagggacttgcctaggtttgcatggatgggagtgatagggggtgcccaggccacctcctggtcctgctggtgcatcttgctgggggcttaaaaccaccccaagtgttcgggtgtggtggctcatgcctgtaatcccagcactttgggaggccaaggcaggacaaccgaacccaggtgtttgagatcagtctgggcaatgcagcaaaccccatctccagaaaaaatagaaagaaaaattagtcaggcattgtggcacacatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtttctagcacctgaggtggacttgggggcttgggccccaaagacctccccaccagcagctgtgagcccccctctgagccactctcctcttccccactctgcgagggcaggtcgaggtgctgctgtacttcttgcggctggaggccatccctgccctggacagcaagagacagagcatcctgttctccaccgatgtctaaaggtcccagtccatctcctggaggcggacagatggcctggaaacctctggctaatcgggccatctgtagagtgggaatcaagattttctgaggcatccttgggccacccccaggtgtcaggccatctgccaagagacagtggcccaaagcagaaggacaggtggcctgggcagatcccgcccaggtctgaaagccccaggctggcctcagactgtgggttttttatgtggccacccgagggcgccccaagccagttcatcttggagtccaggcctggccctgggagacagggtgaaagcagtggtttttatgaacttaacttatagagtctaaaagatttctactgaatcacttgtcaagaagcgccctctctggggagaagggaacgtgaccggattccctcactgttgtatcttgaataaatgctgctgcttcatcctgtgggggccgtggccctgtccctgtgtgggtggggcctcttccatttccctgacttagaaaccacactccacttagaacagggtttgagaggcttagtcagcactgggtagcgttttgactccattcttggcttgcttctttttctttccagaaggatttttgtgcagaaatgggtcttttgttgccgtgttagtcctccttggaaagcagctcagaaggcccgtgaaatgtcgggggacaggacccccagggagggaatcccaggctacgcaccttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggtagcagcttgctgatgacttgttttaaaactttcatcctaaataaccttttgatgcttgaatatttttaagttttatacatagtttctaatttttttcccagcagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccgacagctgcgggggagcccaggcattctttgtaagccctcctgactacctgactcaaagaaaacagaagcatggaggccgccaagtattttcaagaaataaccccatgaatattccatcacttttttagaaagaggggcttggggcaggcagaggagagaagggagagcaaactgagagccaagtttccagacagtcctgcaggaggagaggatgcagctccccagagggaagcaggatcacatttaaggaagtgtgtggggtccctggatgacaccagcacccagtgcggctctgtctggcaaccgctcccaaggtggcaggagtgggtgtcccctgtgtgtcagtgggcagctcctgctgaacccgcagctcactggggagcctgacagtggggccatgcgcctgacactcctctctgcttgtggacctggcaaggcagggagcagaaaacagagccccttgaaggcttcctgtctgcgtctgtgtgcagtgtggatttagttgtgctttttacttgctgggagagcacagccaccatttacaagcagtgtcaccctcgtgggtggcgaggacagaacaggagcctctgctctctgtacctatctgggcccggtgggctcccttgtcctggcttccatctctgtctcagcgaccattcagccctgcgcaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcaaaggcctagatgccagtgtgacctcccacaaggcgtggcttccagactccccggccggaagtgatccttttttgccgcgggccctgagtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaacccctgagccggtggggtggggctggaagcagcaggtgcagtgatggggctgggtgcccaggaggcctcagtgctcaatcaggccaaggtggccaagcccaggctgcagggaaggccggcctggggggtgtgggtgagcacaggcaggcaccagctgggcagtgttaggatgctggagcagcatccgtaaccccactgagtggggtagtctggttggggcagggaccgctgttgctttggcagagagagatgatccccactggggagaggctgttctgactctgcaggtgggacagggacagatggccaccagggtgacccggctggtcttcctttgctatgctaagccctgggacgtggaggattcctgccacacagcctgggcccggtttcttacctgtggccaccgctctggcacgagcccctcagtcttgggtggtttctgcctggtccgggatttggtgttcctgctgagtccagcctttctgccacctccgcatgggccgtgggtggtgttgtcagctgcctcccaccttggcttcagtagctcacccagctcacaggggagctgccctgggctggagatgggcatgcaccctgggtcctacttgaatgaatgcagcttgaggagagccggccatatacactgggccacaggttaccctcggcaatgcccacatcagccgtcagcctgagcctccccaggagagcaaggctcacacgacaaaggctgcccgtggccaatgaggtggctgagcccagccaggacctttctcggactcccgggatgtggctctgctcgtgagctgcctggtcagctctctcggggtgagaggggcttgtcacacgggcccctgcctgcagtgtgacccttctcagcttctctcagcagccctgcctgcggagtgtcaccgccaccatgatcatttccctgacactgcgagggtgtggggacgtcctgggtagagacagggcccgtggcagcagcaggctcaggggcgccctacactggtgggctggggacctggtggagaccacgccaagggctggacaaggggacgagcctccaccctggcctctccgcaggcctcagcagcccctcccacaggcagaagggttgacactgggttctgccctcactgcaagagctgcaagtgccacgtgctgttctgcccaatctggtgtctgcaggtgaggaaagggctgccgctggcccgtttctgagtgttcagcacctaaggatgacagcactgtctgtccctaccctccgggtcctgtttgaaaatcaaacccatgctcacaggccaatttttttttcttttagagacagggtctcactttgtcacccaagctggagtgcagtggtgcgattatagctcaatgcagcctccaattcccggactcaagggaccttcctgcctcagcctgccaagtagcttggactatagctgtgtgttttcttattattttgtagacatggggtctggctatgttgtccaggctattctcaaaattcccggcctcaagcaatcctcccgcctcggcctctcaaaggttgggattacaggtgtgaggcaaggcacccagctcagccacagagccctattgcatctctcttactaggagcaagagctgactgccccctcatccccattccagagtgttggggctgtgttcagccgaggccgggccactggcatggcccagggagcgggatcattcactgctgccccaaatctgagatcattccaccttgacaagacttcctcatccaatccctttacttgacagctggggaaaccaatgcgcacagagcacccccagctcactcggggtctcagagctgatccatgagcggaggctgagatcctgggatcttgtcccccagcctccctgcaaccttaatcccgttctgctgaaagagatggggccggacctcgaccagcagccctggcctggacatgactgtgctcatgcaggtattgaggccgagatgccccggcatcatatgtttttctattttcttttttttttttttgagacggtgtctcactctgtcacccaagctggagtgcagtggcatgatattggctcactgcaacctctgcctcccggttaaagtgattctcctgcctcagccttccaagtagctgggcctacaggcttgtaccaccacacctgactaatttgtgcatttttactagagacggggtttccccatgttggccaggctcgtgtcgaactcctgacctcaagtgatccacctgccttggcctcccaaagtgccaggattacaggcatgagccatggcgtcacttaaatgtagtgagaggccgggcacagtggctcatgcctgtaatcccagtactttgagaggacgaggctgtcagatcacctaaggtcaggagttcgagaccagcctggccaacatggtgaaaccgtgtctctaaaaaaaaatagaaaaaaatagccctgcatggtggtgagtacctgtagtcccagttactcaggaggctgaggcatgagaatcgcttaaacctcggaggcggaggctgcagtgagctgagatggcgccactgcactccagcctgggtgacagagcaagactttgtctctaaataattaaataaataaatatggctgagcatggtgccttaggcctgtaatcccaacactttgggaggctgaggcaggtggttcatgaggtcaggagcccgagaccagcctggccaagatggtgaaacactgtctctactaaaaatacaaaaattagccagctgtggtggcaggcacctgtaatcccagctacttgggacactgaggcaggagaatcacttgaaactggaagtcagaggttgcagggagccgagattgcaccactgcactctagcctgggcgatggagaaagactccatctcaaataaataaattaataaatacagagcaagattccatcttaaataaataaataaataaacatacacctgtaatcctagcagttcgggaggctaagacaggtcgatcacctgaggtcaggagttcgagaccagcctgaccaatatggcaaaactccatctctactaaaaatacaaaaattagccaggcgttttgatgtgtgcctgtagtcccagctacttgggaggctgagacaggagaattgcttgaacccaagaggtggaggttgcagtgagccgagatctcggctgcacttcagcctgggtgacagagtgagactgtctcaaaaggaataaaaaaaatacaaaataaaaaaaatgtagtaagatggcagagtcgtgccgcggaagcgtgctggtcctatccatgtagtgaaggctgatttcatacagaaatgtcacaagaactttttttctttttctttttttttgagacggagtctcgctctgtcacccaggctggagtgcagtggcgcgatctcagctcactgcaagctctgcctcccgggtttatgccgttctcctgcctcagcctcccaagtagctgggactacaggcctgtgcagcagatgcaggggggccactaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggcctggtcctcaacctgcagtgcactgttgatgcactggaatgccgcctccttctcccagtccaggtcttcagcagtgacccggtaccccagctctaagggaggtggcagcatcaaaggctcccctcgcctgcgtggcagcaggggaaacttgcatctacggggcctagaggcctgggatatgggggagccacccctgggagcgagtgtctgccctggtgctgtatctgccgtcttttcacactgggtgtgacccgaagagacagcctgaggtccgtcctcactcactgtgtttgaggaactgagggtcagctggcagtgggatgaggctggcccctcttccactttcgttccgggaggcctcccgtagagctgtaggggctcgagatggcatttcatttggggcacgagctggtccgggaggtctgcgatctctggttctgacctctgggcacctgctgcagctgtggctgaggcccagaaatgtgaagggcctccatccactccagtagtgaccccaacgtggggttcaatgcggaggggggaggggctgctgcggcagctgcaggagcagaagtgccacgccttgttcttctcatgcccgcatccatgcttgcagctgggaagggggcaggaatcagcgaggtgacctgggctgagtcctgggaatgggaagaggtggcaggaaggggatctgaggaggagaacagggggcctggtggtctgtgcttcttcccagacatgggagctgtagaggggacctctgcagcagatgctaagggggccagtaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggccttgtcctcaacttgcagtgcactgttgatgcgctggaatgccgcctccttctcccggtcaaggtcttcaacagtgacccggtaccccagctctaagggaggtggcagcatcaaaggctcccctcgcctgcatggcagcaggggaaacttgtgtgtactgggcctagaggcctcggatgtggaggagtcattcctgagggtgagtgtctgccctggtgctatatctgctgccttttcacactgggtgtgacctgaagagacagcctgaggcctgtcctcactcactgtctttgaggaactgagggtcagctggcagtgggatgaggctggccccctcctccgctttagccccggcaagcctcccgtggagctgtaggagctggagatggcatttcggttggtgcaggagctcgtccaggaggtctgggatgtctggttatatctgatttctgacctctgggcatggaggtctgtctgcagaggcccgggcccgggcacaaagggagagaggcctccattgtcccgcaggggccgaaatgcagacggtgcatccccggtgacctccgggacccttctctgatcaccaggattctcttggactctagggtccttgtcctgctcaggcatccctgccccgctctccttgagggccctcaacactatcttccctggacacaagtctggggacagccgggtgttgtggaccccaaaggggtgactcccggctcctgggccccacagagagtccatgttctcagtgcagtggctgagctggaggacgccctggaactcggagcacacagcactggcttgctgtggtacctgtgcaatcaaattgaaggcaggatcccaggaaggaacgcagcgcttgcaggatcaccgaaaaccttcttagagttgtcttgacaccactgatgtcaagtgtctgggtacttgtaggatggcctgccactcagtgcacgggcaggagcaacggggagatcccacaggcaaagtgaactgggggatgggctgaacgggctccaggcaactgagccctactggcaggtcctcggcctgggcccgaacaggaaggaggggcacagagtgcccaggtaaccgctcctgggagcagtggggaaccgtcggttgcttgaactctcgagagctgggctctgagcgtcctcgtccagccgccaactcggccaacggctaagccagcagtttcttctgttgccgggcaacgcgccttttaaacctgagggagcgggcgcgtgagcacatcacggcgcccgtgacagagccagcttaacggattaataagcgcagccaggtacccgcgcgaggcacttgctggcaatggcgggaggcggacgtggggggtcatgcaataggtactggaaggagagaggcgggcacaaaggtcgcgggaggaacaggtgcccacaatggcggcagatctgcccgtggatcactgaagattcctgctctcctgctgaggtggagattgcagtgagctgagatcgcaccattgcactccagcctgggcaacagagtcagactctctctttttttttttttttttttttttttgagatggagtctccctctgtcgcccaggctggattccagtggcctgatctctgggctcaccgcaagctccgcctaccgggttcacgccattctcctgcctcagcctctggagtagttgggactacaggcgcccgccaccacacccggctaattttttgtatttttagtagagacggggtttcaccgtgttagccaggatgatctccatctcctgacgtcatgatccgccctcccaaagtgctggcattacaggcctcggcctcccaaagtgctgggattacaggcgtgagccaccgcgcccggtgttgaaactcccttgaggcattttcttcggccttcgggtccatcctctgtctcctccttgacctcctcatctcctcctcgccactgccttggggaccttggccaggctcatggcatccagcagccactcaatgtcaatacctccatgttcatctctcagcccgcccttgcccgtgaacccatgcttatttatttattttttttatacgtgcacccatgctcttcaggtctgatgaagtatccaaaatcaagctcctgaccatcctcaaacctgccccttctgcagggtttacctcgctagtcggcgccatccttgattcttctctttctcccacccaggccatcatctcttgcctggttgatacccacagcctcccctttgggctttatccttatccccgtcatagctgccagagggaccctgtgaaaacactccccagcctgctcattcttctgccctaagcctgcatggcacagagcaaaagccagttgttatgggacctaggaggtcctgtgggatgggccccagcctgcatcttcatcctcttctccccaccccactccattcactctctgcctatcgctcaccagcctataccacctgcctcagggcctttgcactgaccatttaggcaacattccaggctcttttcacacgttgcctcctctgagaagccctccctgaccactctgcccatacctcatgcctcttgattccccttacctggcttgtggtttcagcactttccctgtgtgtgtttgtttttcttggcatgagggcaggacctaagtgtctgttccctgttgattccccagttccaggcatgcagtgcaaattctagaaatattttttgcatgaaggaatgagtgattgaatgcagcaagggtctggaggctgaggaccaggcagacagacattcagagttgctggaatgcgacagagacagggagtcagactggtcatgcaagatcctgggcctgcccttgggtcctggggagccacggaaggttgtgggtgccagagggttgtggtcagagccacagtcaggggccttctgagacctgtgtcccctccccaccctccctccccacctcctcaggccagctctggggtctcggcaggtggtccacaacatgacctctgagttcttcgctgcccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctagtaggggctgctgggccgcctgggtgggaaagggccaggggcgggtggcccagggactgcccacttatccagtaaggtggctccatcacctcttttcctggtgggaaactgaggcccaaccttggtagcttatcctgggcctctcagtgagtatgtttgagcctcagtgggtggatagggaccaggctgggccaggcaaggtcaggtgctgtctgacctggctgggcggtagctttggctccaaggtccgctccccggtcagcgagatcctgttcaatgatgaaatggatgacttcagctctcccaacatcaccaacgagtttggggtgcccccctcacctgccaatttcatccagccaggtatggggtggaggtctggggatgggggactggggtggagaggggcgggtgtcctgggcaggcagctgacgggcatccctgtcttctcccatcggccacagggaagcagccgctctcgtcaatgtgcccgacgatcatggtgggccaggacggccaggtccggatggtggtgggagctgctgggggcacacagatcaccacagccactgcactgatatgtgtcaccccttttctccctggccgtgcccaccctgcacagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggtgggccgggggttggagaaactgagtcacggtgtggggccccagggcatcctgggctggaggcctggatcatcacagagtggacaattgttggtgtcctctctctagtgcctgggccatctggagcccctgtgccatgagggccaagccccctgctccagtgagacccagcaggccccaacctgctcttcctgatgacctggcccgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggactggcttcccctgtgagcagcagagcagcacaataaatgaggccactgtgccaggctccaggtggcctccctgccctgtctccccactctctgggcctcagtgtattgtgtgtgaaatggagccatctgactggggaggaacagagaggtgggattcggagatcttcacaatgcggacactggaactagcctcagcatcttcagcatggggagagccaggcacatggctgggggccaggggaaggttcacaccaagccctgcccctttccaccctgatccctcggactttggggccaggccctcccttactggggctgggcagtgacactacctaggatcagccaccagggggtgccacgaccctggcactttcttaggcagagggtggccagctgatgctgggaacccgggcgccttctcagacccgtaggcgtccagctcaccctgccgatgacactggaggtgaagctgaggtccgaggaatggggactgggcaacaggctggaggaaaacatctcggtcagagccacgcccctggggggtttccaagagcaagcccagagtgaaacccaagcttgtgatcctctccagagggaggcctggttctcagggaacagcaaacgggaagatgtccccagatcccagggatcagggcttggaccagccggggacgcagcccagagggagtgggtccagaaggaaacagctagacacagcagccttcaccatccgcagcccctccaggcctccctcggggcctgctccctcctctgtgcacagttccaacacctggggcagggttctgggaagggctggtggaggtgggctggtgggaggcggtgatcacagcccagcacctggatatcaccaggggcactggggccaggggccaggtgaggccaggtcggggctatccttcaggagccccgaaaacctggtgattccaaagggcccatagacaaacaggtttttatgcctgtggagtcaagtcccactgggtctgagctctgcagggctgtgtctctggggctctgcaggggtgagatggaggtgggctcaaatggtgtacaagtcactcctcaatccttattttatttatttaatttttttaaaaaaaatttaaaccaatagagatggggactcactatgttgaccaggctggtcttaactcctgacttcaagcagtccccccatctcagtctcccaaaatgctaaaattacaggggtgagccagtgcacccagcctcaatccttattttggcctgagaggaaaggccgtggccccatttgcaggggagaagactgaagctggaggggcaggccttgctctgggttgcacagcagcaagagaagtgggagctggccacgaggcttcctcgactcgacacactggtggggtacaccctggttctccaggtcccatggggctcagcccaggactacctcggggggtgaggtacttaaatcctctccttcattctcatcgccctttcccccatcatttcctgaggaagaacattcagggacctgaaggggtggcctgcccctccacatctgtgggtgtttctcatcaggtgggacaagagactgagaaaagaaagagacacagagacaaagtatagagaaagaaaagtgggcccaggggacctgcgctcagcatacggaggccccacgctggcaccagtctctgagttccctagtatttattgatcattatctctaccatctcagagagggggatgtggcaggacaatatggtaatagtggggagagggtcagcaggaaaacatgtgaacaaatgtctctgtgtcataaacaaggttaagaaaaaggtgctgtgctttgatgtgcatatacataaacatctcaatgcattaaagagcagtattgccaccagcatgtcccacctccagccctaaggcagttttctcctatctcagtagatggaatatacaattgggttttacaccgagacattcctttgcccagggacgatcaggagagagatgccttcctcttatctcaactgcaaagaggccttccttcctcttatactaatcctcctcagcacagaccctttacgggtgtcgggctgggggacggtcaggtctttcccttcccacgaggccatatttcagactgtcacatggagagaaaccttggacaatacctggctttcctaggcagaggtccctgcggccttctgcagtgttttgtgtccctgcttacttgagattagggagtggtgatgactcttaacaagcatgctgccttcaagcatttgtttaacaaagcacatcctgcacagccctgaatccattaaaccttgagtcgacacagtacatgtttctgtgagcacagggttggggctagggttacagattaacggcatctcaaggcaaaagaatttttcttactacacaacaaaatggagcctcttacgtctacttctttctacatagacacagtaacagtctgatatctctttcttttccccacagggaccttcctggctgtgcctcgggtcaggaccagaatgacacccattcatttccctgggcctttgctccggtggtccctgcaccctggcctctgcctgacgaggatggtggggagaggaggggggacgtcccccacactgctgtctccactgttcctgctgcccaggcctctgggcttccaggactacagcgggtgggtgggtgggctggcctgagcccaggaatgcacttcagttcctggttgagcaatgtcactgaggcttgggagtcgggtgggggcgggaggaggcgtccacaggccccccctaccgtgagaggcagccgtgggaacagcctacctctaaacaatcactgcagcccaggctgaccaggggctctggccggacataggggcctggcaggctgtgtgccctgtaaggacacagtctgtctctgtgcctcagtttctctgctgcccagatggaggggcccagactccaggtgtacacatctggagcaggcagtgttcagttggggaggaagcggggaggactgtgggggccatgtgggaaggattccaccccacatcacctgcacccctgctgagcctggtcaacggagcccctcagtgggtcctcactctcctggctgcctcccatttaggcaccctgaggcctggggagaacagagccaggccagtgtccctagagaggctgcgctgccagcacagtagtagcggatttggattcagggaagcagacctgcagccagggtgggaaagagctgcaggcggggtggagcccccacatggcacagcccccctccctggaggtccatgctgcatttccaggacagcaagtcccagggatggatggtgcctggtgccaagggctagaggcatggtctgtctgcattccctacaggggcatcttgtagtcaccagcatttgatgctgtcaagtccccctgtcctctgtgcagactgggaagcccttggtcaccctggggggtggggggacccaggccaggctgcagaagcataaggacttgaacccgggtcctgagtgacaccaccttgggtcctcctccctctgcctctgttcagctccaccttgatgctgactaggctgggccatgcggagagggttaggggatagagatgagagctggggagcagggctccactctgggaggggggcagccttgcgggatccagggcagagttaagcggccccagctccgctttcctagagctgctgagaacccgggaaatggtgtggaggttccggggagccctgcccctacctggcaaccgcagtgcaacaggcaccaagttctcctgcacattgcgacagtgggaccctgggctctggcgggcggtaggtggggcctttggacctaccagcagtgagggagttaacacagcagctgacttctctaggcaaggaaaactcccctcagacgctttgctgcctggcctcctgccagcaacaagcaggagctgaaaactagaagctgaggcatgagtttggtcactccgtagtgtgcacttggtgagggcagcagctggccacagctgccagccgtctgtccattcgcccatctgtccatctggcagcccgctgttcagacctgtctgtctgtccgcccatctgtaagcccatctctgtcccattgtctatctgaccatctttctcttactgtcctctttgtctagctatctggcctgtctgtcgatccatcttcgtgtctgtcttcagcccccacctgtttgtccatctgtccaattacctgtgagtctatctatgcatcttcttgtccattcatctgcccacccatctgtccctccgtctgcccaccggcctcccctctccttctgggccgcagagccacggcccaggactgcagagccatggttggcctggtcctgctggggctggggctggcgctggctgtcattgtgctggctgtggtcctctctcgacaccaggccccatttgacccccggcctttgcccacgccgctgttgctgctgactccaaggtctgctcggatattggacagtgagtgagatgtgggaggaagctgggtggcccttggcagccagcccctcctggagaaggcgtgtgtgtgtaagcgtgtgtgtgtgtgagagattatgtgtgtgtgtgtgggtatgtgagtgtgagtgtggggtgtgggtgtgtgtaaatgtgtgtgatcgtgtttgggtgtgtgtatgtgtgagtgtgtgggtgtgtgggggtatgtgagtgtgagtgtgtggggggtgtgggggggtgtgaatgtgtgtgattgtgttttgctgtgtgagagtgtgtgtgactatgagtgtgtgagtgtgtgttggtgtgtgggtgtgtgtaaatgtgtgtgattgtgtgtgtgagtgtatgtgtgggtgtttgtgggtgtgtgtgagtgtgtgagtgtgagtatgggggtgtgggtgtgtgtgaatgtgtgtgattgtgtgtgggtatgtgtatgtgtgggtgtgtgtgtgcatgtgtgtgtgtgtgcgcgcacgtgcactggcccaggaagcaggagccgtgtgtgtgggcttcagcacctgcaggacttgagcgcaaggagacagcctcagggcccttgcacagaacaggtggcagggtgtgcccgtggggcagatggggacttggggacaatggtggtgtgtgagtccatacctggctccaggattcaggaggcccatttgcatatcccaggtgggaacctgtctggccccggctgaccctgctggccggtgcaggccccttcagtgaggccaattctccaaggctgcggtcttctcccagggtcatgggtgaaggggtttggaggctccctgcgtgggtactggcctgctggggtacacacaatgctgccatagccagtctgcccctacacccagcccggggccacatctcaggtctctcagtcctgaggagcccggtgccccacccctcacatcctctctccctgagtcagggcctgggtctcgtgagctgagtgactgatacttggtgtcctggatgagggcgtggtggagaggggccacagcgggtgtttcctgaccctcttccaggaaggtgctgctgccgctgcagggaggacacatacaggatgccccttcctgccccctgcctcccattgggcccacaaaagccagggcaagcctcccctccctgccagccacctggtctgcttcccagaaattctgtcttgcaggctgttgggaggatcccagtactttgtaaactaaagcaagggaggagtggccgttctctctctttgctcattcattcaccttttcattcattccttcttccctccattcccccatctgtccatccttccctgccctgattgctcatgccaccccccctccagcccctcctgacctggtcctttggtttctcttcagggctttctgtctcctcccacagggctgagaatggcagctcagggacaagtgggggctggggactgcttagtctccccagtggctctcaggggatttgagggtttgacgccagctgccaccccaggctgtgcccctcctctgctcaggaggacatgcagagatgcgacacccacttaaactcgaagttgcaaagatgcaaatgagactggggtctcaggcaccagagaccacccatgggcacgtggcttttgggagtggggacctgctgccacagatctctgaagagtctggacctgctgggtctccccgagtgactgtctgggggtctccatagcatgccctgctgtgtgcgcgacggtcactggttgggtaggggtctctactctaaagctccctctgccggcatcccctcgaactctcccttggtgaagagaggatgtggttttcccccagtgttttatcaaacaactctctccacttcctgttttaagaagctgggagtggaagagagcctggggctggccccagctgctgctgcgaaacaggggtcactggacgctgggaccctggccgggctggctggaggcctcaggaagaggcctgctacagtgtcatcctggccaagattcctccctgcagaggaccctggccacactgccacagggtctgctggggccaccagaagcccatgctcctgcctccatctctcccctttgtgctcacctctcaccaggaggccctcccagagttcagtctcctgcttttctttttttttttttttgagatggtgtctcgctctgtcaccaggctggagtgcagtggtgcgacctcagctcactgcaacctctgcttcgttggttcaaatgattctcctgcctcagcctcctgagtagctgggactacaggtgccagccaccacgcccagctaatttttgtatttttagtagagacggggtttcaccatgttggccaggatggtctctatctcttgattcgcccgccttggcctcccaaagtgctggcattacaggagtgagtcatggcacccggcctcatctcctactctttcagcaccaggttttattcttgggattctgctacagccgcagcccctgggtgcgagctcctaagctttctgcgagtgtggacccagcaccgtgcctagtagacatacaaaaggaacatggtgacagtgaggtctgtcatctccagcataatgactcttttgatccttgtaaaaaaggtgatttttggctgggtgtggtggctcacacctgtaatcccagcactttgggaggctgaggggggtggctcacttgaagtcaggagttggagaccagcctgggcaacatggtgaaaccacgttctcctgggtgtccaggtggtccaagaccccatgactatatcatgacaggaaagagagagttaataaatctgagggcataaaatgtgaacatatactgtttccatcccacatgaaggcacatgtgtctgagcctactctctgggaggaatagagatctcagtttccacatcagggttgcattctatgcacctgcagccatgttattctgctgtagcagatgctacacttggcaccgacattgcagatgggaccatgaccttactggagttgtagaaatctactttcaccttccagaatccatttaatgtttataggagctagtccaagaaattagatggaaataaagtcctgctacaacctgagaatctttaggcctttaaaggtaacactattacatgcaactcccaatgaagggtgaagcatgattattatttaccttttttgatggggtgaaatggggagagagtcggaattcatcacatacataaaaggcaggtcgtataaatgttagtgtttgtgagtcacaaggtctgtcttgcagcgactcagatctgcacttgtggcatgaaagcagccattgactgaacataaatgaagggatatgggtttgtttaatgaaactttatgtacaaacgtaggtagtcactatggtttgctgaccccagcttttccattgccccatggaactttctttgggatgcctttttgcagtgggttctaggtgagaaaaattggctcggatctggatgctgaagttgagactggtgctgtcatgtggctactgccctcgtccatcctgggtgacttctgactgttgtgatgagcagggccctttgtggctgcctagctcctggtgccaagaatgatgaaccctctgcattgccctctgcaaagcagaccacaggacagccaccctgaattgctcgttctcactgtgtccaccttgcctaagatggttgggcacattcactggctggttaattccagatagtgttatctcattaatgccaggcagtaccttctagaagaggctcctaccatctgcactagactatggagcttctccggggtgctagtgctctgtcacctgaatatgcttcagggatttgctaaacagaatgtccttcaggccctcccatagaacacagggaaacattttgttttcccttgtgtgactgcaaaagggaaaacaaaaataagcctgggaaagggtgatttaggactttgatgatgtcgaggctgggaactcccatcagagtttctatatatgatggggaggggccaattttttgaaagtcagcattgactggccattggacacaggtggccctacattgactctctcttgcccaggacctctcctcaaaaagtctcaggtgattcagccccacagcagcaggggcacgacaccttctgtcctgaaggctgataaccggtgatgtggacagctgccattcactctggggaagatgctgcctaattccacacccaccgcctgcatgtctagtgagagcctgcctattcctatggggacaccccaaaattagctccaccaagaagcctcctccacctccattctccacagaagacactcatcttatatgcttggctacaggtcctgtttgctctgctattatccctatcacctgtccctgtctgttcaattgtctcacatgagcagagagacgatgtctcattcagccttatttcccatgggtattaataaatattcattgagtcaattaaaaattcatgtaataacctatcaatgcatgtctctgtgtgaggtaaagaaagcatcctgattgtaaatataactctcatgttaaaagctgggagcagtggctcatacctgtaataccagcactttgggaggctgaggagggtgaattacctgaagtcaggagtttgagaccagcctgatcaatatggtgaaaccccatctctactaaaaatacaaaaattagcagggcatggtggcgtgtgcttgtaatcccagctactcgggaggctgaaacaggagaatcacttgaacctgggaggcgaaggttgcagtgaaccgagatcatgccactgcactcctgcctgggtaacagagcaagactccgtctcaaaacaaacaaacaaaagcattcttacagattatcttggcttttattcctttattctaccaataagttgttagcctctcttatgtgccatttgttacaaaaaatcagctgtcatttttatggagactgagaagtcccctgatctgtccattgtaagctgaagacccagtagggccggttttatggattagtccaagccccaaggcttgagaaccaggggagccactggtctaagactcagtccaagggaaggagaggatcaaggtcccactcatgcagtcacacacaaaggaggaattctccctgctggtgccttttgttgtatccacgccttcagtagatttgatgatgccaaccacacagaggagggcaaagtactaacttagtccaggcattcaaacatgaatctcatctggaaacaccctcatagacacactcagaaatagtgttcaatctgggcacctcatggcctagtccatttgacccataaaacttaccattactatcattaaaatggcatacgttatgtatattttgttaccataaaaaatttacattctgaaaataaagtacagtgtcttagctcatttgtgctgctacaacagaatacttgaggttgagtgatttacaaagaacagacagttatttctcacagttgtggaggctgggcagtccaagatcctggtgagggcttttatactgcattctcatgtggcaaaggcagaagggctggagaaagctaaaggctgcatgaagcctctttcctaagggccttaatcctctcaagagtgaggagctgtcatgccctaattgcctcttaaaggccatctcttttaacactaccacactggcaacatctgaattttggagaggacacattcaaactatagtagcaagtttaatttggaaataattctactcaaaaaagcattagaattgagtaatgaaaccctgtatatcccctccctggatgcaacaatggggtacgttgagtccaatccagggagcattctcgcttcctctctctactccatcttaaaaaattaacaataattttctgtccactccataatcccatttcaccaattgcccaaaatacctacagtagttatttaattatgtttactaacagaatcctcaagattccaacccttatatttgatttttacttctctctgatcgatctggcatttatcgacgaagattccatcaaaccctgggcttatgaaaaattttgcaaaaattccacagataggaaagtgttcattgtgtgcagcagaaaaatgttcatcatgcagagtggaaacatgtttatgtgtggcaagcaatggtaaagtgagtcctgcattttaaaatgaaaggacagtagatggaaattagaggtcacactgtgaaataatgaattctgttaaaggcaacaacataggttagtataaaaggcagcattatggtatttttggttagtaacttctctttggaaacctatcacaagcagagagactgaatccataattaaaaccttccagccaaagaaagtccaggaccagatggcctccatgttttttatatcagccatttaaagaattagcatcaattcttatcaaactctgaaaaactagaagaggaagaaactattcctaacgagcccaacatgaccctgaccgaagtcagttaaagaccctacaagatgtgacaactaaagaccaatatacctcgtgaatataggtgcaaacatcctcaaaatgtgtgccagcaacatgaatccaacagcatattcaaaagattatgtcatataactaagtgagattaatatcaggaatgtaaggagggttcaatataagaaaatgaatcaatggaatatacaacattaatagctcaagagagaaaatacatattccaaataacatagaacaacaaaatccaacaccttctctaaatgaaaaaaaaaaagcacccagaaaactagaagtagaaggaaacaacctctgtgtgataaaaggcgtttgtaaaaatcccacaacaaacttcatactcaataatggaagaccgaaagctatccctctgacatctccggatgcctaaccttatttaagtgagttcagcaaagttgcaagatgcaagatcaccatgcaaaactcattcatatttttttttggggggggatggaatcttgctctgttgcccaggctggagtgcagtggctcaatttcggctcacctcaagctccgcctcccgggttcacaccattctcctgcctcagcctcccgaatagctggaactacaggcgcctgccaccaagcccagctaattttttgtattttttagtagagacggggtttcaccgtgttagccaggatggtctcaatctcctgacgtcatgatccacctgcctcggcctcccaaagtgctgggattacaggcagagccaccatgcccagcaactcattcatattttatatgcaccagcaatgaacatctgaaaaagaagttttaaaagtaactctatttacaagaccaccaaaaagaatacaaataaatttatccaagaagatgaacttcttgtacactgaaaatgtcaagacatttctgaatgaaatgtgcagagatgcctcaggtggctcctgcatattccgcccctggtgaagcatgtttgcattttcttgggaactgagcacctcctgcttggtcgtaaggcagacaggccacacagagaagaataattcctccctttgggccagcagttcagggatcaagaaatcctagacctgaggagtaatttctgaatctacacctagaccaaggtggtgtctgagcctccagcagtcagtgaagagcaaccagcagtggtcaacagagagtcacatggcaaagccgcctggagctgggctggacctgcatgtcagggagatgctgacatgcagggagggtcagtgaccatgacctaacactggggggaaaaatgtccttctttttctagagtatcatcgttaacattgatgtacaaactcttttgccccatgtctcttacatctggctcttttagaatttgcttatttcacagcaacaagttcaagtcttatactacattgcatcccagcccacccaattatgctaaaactctggatctgtcaaacactttcagagcagcagatttgtacctggccctaaacgcatagtggggacactgaggcacagctcctagggccttcccctgaagctccaccaagggcaaaaacttatacaagcttcatggatattaaaaacctccatgttcacttagcaagggagaaattttattcaagttctgcagctcaggagctgtgctcaagagcaagacccagaacttctcaaagcctggttttggcacctgtagaatggagcccaaaaacgcagacagacttacctcggagctctatagggccaggacagcccaggagtaaagccagtttgagacacaatttggggtgaagatgtcggcccagaatagaaccaggagaggaagaagaaacccgtgtgctgagagtgggtctgctgggaccactcctctccttcctgggccctttggggctgagcccttctctaaaaaccacagagctactccagcagcagcccctgactctgctgatttgcatcatggccgctttatccagcaaggggataagagaggcctgggaggaacctgctcagcctgggtcttgggaagcagcatcgggggtgcctcagccatggcctggacccctttcctcctcggcctcctccctcactgcacaggtgctgcccccagggtctcactcacttgcccagccccaggcctctgggtccagcctggccctaacactgagctcagtagggccctacctgtggtgggcaggatgctcatgaacctgccgcagggcagggggctggtggggcagaaatccccccacactgtgctcctgttctcttggtgccctaagggcacttttattcctggggctcaggtcagttcaggcaagtggcaagatattctttggttaatccccagagtttcaggccttttcgctcctcttttctctccttgcaggctctgtggcctcatatgtgctgacacagccaccctcagtgtcagtggccccaggacagacacccaggatcacctgtaggggaaataatattggaattaaacctgcttaatggtaccagcagaaaccaggccaggcccttgtgcaggtcatctatggggatagcagatggccttcagggatctctaagtgattctccagctccaactcggggaacatggtcaccctgaccatcagtggagcccaggctggggacgaggctttcctctcaggtgtggggcagtggcactgcacacagtgacagaggcagacaaggaagtaagacacagaccccttccccatctgtgctgctgtcgtcctccagcccggcaacactgtggacaaagccatgagcatgcatgacccagttcacctggatctgagacccccagtctttacttccttcagccctccaggcaggctgtgcagagggggcatccagaatggatttagggctgaggtgaccaggatgtattggggttttgtggactccactgtgattcagggaaattagatcttccaagcagaccaaggtcaatatcctcagttatctctggatttccataggtggtgataggccagtccttggccgaaatgtcctgaatcagtccccagaactgcccagctgaggctcctgtcattctctacagaaaaactagtggagtggacactgtgggatcctcccagatcccctcttatgagctcacccacacagcactcctgggagcttctggcagctcagagctgttcggtgcagaaatctgcctcccccaggtttatgtctcttctcagggaggtttggtttcatgactgcctgtggccaaggtctcaagactcttcctcagtataacaggacctgaaaatcctccaagatccatagctccttgtagggctgactgaagcctcaatatgtgtcagggcctccttctgcctggtgttgcctccatcactttcttaatcatctgtgtatgatattctccatctcagagtctgtttccagggaacccaaactaagatcaccagccatccccaacacgggccatgagggagctgaagaggccactgtacactagaaagcatcagtttactcttaaattaccactgcgagtctgcaaatgcccagcgagacctgagtggttttttttttcatttgtgtgaaatgaaaagggagactgacatgccagatgctctgggttctgagggagagttggagtcagatcctcctgcaggaatccaggggcagcaggagcagcctcgccccatgcagggaccacagatgcacccagagggtgagctgcaggatggacactgcccacctccaatctgtatatcctgtgcaaaaaaatcattgttttcaccccttcttcagcctatcaaagttgtcacttaaaaagccactacatctcatcctgtgaacaggaaacccatccacatctccatcagccacataatctccacataaagattcttcaaaaaatagtaataatagctgtgaaaaagtatctaaaatattgcatgacaatcatacttagattacatatgaaaatggcactatttttgatatgctaggtaaataaaatatattatttgaagtcatttaccttcttctctttatatgtctaatgtggtgactagactagcctagtgggattcccattaggctcatcatactgtgattgaacagtgctggtctgcacctcttcaggttaacaggggctgtggagtgacctggtgcaggaaatatcatctccatccataggatatcagtgtgaacccagggagaggcactggtgcaagagagatgagaacaggggtgtggagtaggggactgagccttcactttgagccgaagaagtttcctttcctatcctcaatcctgaacaagagggatttctggacttctttttgttttcaagtttgtgccccttcagatttggggctgtctggaatcctgccaggggacaccgagaaaaaataggagtctcacactgactgttgtatttcatctgctggggccatcccaaaccactgcgtacaatttcctttcctggtgctcaaatagctgctccacgcacttgttgtggtttcagagatgaatctgggtgggaagacaggacagtgtatgttataatatttaaatggaacccaaatccattaatatttattttaatatggaacattaaaagagttttgtaataggcaatgggaaaaggtaaaaaagataaaagctttttgagaaaaaaaacaaaaacaaacttatagaatgtctatgtgtcttcagtgttgcagggttgagagagatcagctttatggtgccccatggatgtgctgagatggggaaaatcaagaaagaaggaagtatgtaccactgtgactcaacaaataaatcaaagtaaaatggacttaaatctttcaataagtcattcacaataaatatcactctggtgcacacagaaatgcctgttagcaaactttcccttccccctggccatgtctccatggatcacctgtgtgcagagtggctccggtcagtgctctgtgttccctccacagggctccccacaacatgtgccctgtgtggatgtgggtgcatcgcctggggtggctgatgtgctccagggattcgatgctgcagatgcctcagcaccaagggtgggggtgggaatgggacaaggctgcagctggggagaccaaggatcaaccacacacagcaggggtttccacggggtgagcagcctcatttcctgacagtagagcgagcctaaaggtaggtgccaggcagtggtatctgtggggtggcccaggcctggagggtcacagagacacaggcaccacacagcagagacactgagggccaggagctcactcaggtgagggacttcagcagatctttctctcctggtacaaagagatcaagttcctaccatcagaatagacaaacaaggactttaatctcctcagctgagccccactgtccagggaagaagtctctgagcccaggcccaggtgagagtgggatgaggagaggagccaggacacagattttcatggatgccccgccctcctctgaggcagagcggataagacagggctgggggcatacccagtgcttgagtctcaggaggcagcgctctcgggacgtctccaccatggcctgggctctgctcctcctcaccctcctcactcagggcacaggtgatgcctccaggaaaggggcctcagggacctctgggctgattcttagtctcctgctcctcaggctcacctgggcccagcactgactcactagagtgtgttttttcctttttccgggctctcgggctcagtctgccctgactcagcctcactcagtacccgggtctcctggacagtcggtcaccatctcctgcactggaaccagcagtgacgttgggcattataactatgtctcctggtgccagcagcacccaggcacatgatttatgaagtcagttataggctctctggagtctctgatcacttctctggctcccagctctggcaacatggcctccatgaccatctctgggctccaggctgaggacgaggctgattattactgcagttcatatacaagcagcaacattttccacagtggacataagattgattctcaggctccaagtctggccagtgagcttctttgagactccctgggatcccagcagtgacactgatcactattgctgtcccacacatcccaagtgatgaggaagtaagaccaaaaccctcctgagattcctgacttgtgtcctgacaccagggctgttgggattcctgtctttccttcaagattgttcaaataagcagtgacagtcacttccatgtgagatatgagaagaagaataattccatatgaaccaaatccacgaagcctacactgaagcctgccaagttctctgcagtccagcgcgatgaagggagcattttcgtgggaacttttgggaatatgaggggagccaggctcagctatgggttccagagacaaagctcctggatgtttctccccggccttggtccatcacctgctacctctcctcactctttccacagacactgccccaggctaagcccccacaggaccctaagcctattcctgaccctgagctcagcccaggtgatgcttcaggagatgggatcctgagaatgagccccaacatctctttaacctaaggtgtggggtcatgagacacctgttagccataagacacctgtcccccacctgctcaggagacagtggagcaggcaacagtgcagagagaaccagcaggagccaggccaggccctgcatccaaagcaggccccagtccccacagattctccagctctagcctgtggtacagcccccactttctgcaggctgaaatgggcttctcaggatgggcaggccatgatgggggatggcagtgtgtccacaggacacagccctgctgcctgcctgaccctcatgccccctccttccccaccctggttaatctccaccagaaagggcccaggttcagaactcaggacacctggatcagctcctggacttgcccccactgctctctgttctcctgagccacttagtctcttttggcctcagtgttacctgctgtgaagtgaggaggcttatactgaactgaggaagctcttttcttcattcaaaattaaaagacagaaaaacaatgaaagtcatgtaaattaaagcctgctgaggggatgtcatttaatgggcttcagtgggtttcagacgtggaacttcttgtcttttctctgcagggattccaagacaggggctcaaaagagcttgctttctgtatggtgggaacagcggtccctagctgagaataagcaggagattcccagcttcatcaggaaggcagactaggctagtgtagaaatcctctccgtacaaactctgagaggtgttgaataaaataaagataaacataatttcatgttttcatggtgccgatgatggtgatgttagctcacaactaagctgcagtgcctggaacatcaggaaatcacagtgaatcacagctgctcttattgggtgggaggtgcaccagtttgatgcctaagtacatagaaagcctgggtccctgtaggatggcacatgcatctctctggactttgaaagctttgcagaagagcttcagttgactcactctaattagtccggactgaacaaaaccactagaggagggcatttcaaccctgagacacttctatagccccaacttcctaccctgcgtgtgcgaactctctgtgctgggctgggcagggcagattgggtcaccctgcacagaatggggctggactgtctggtcctcaacttctgaggtgacaggtgctgtggaggcacgtggaagaaaaaagctcctgggctgagtctcctccaccagctgggggcagcagagctgcagccaggagcagtcaggattaaggctggggctgcccagctggggcaaagagaaggccagcctggcgttcaacaggtgtccaagaatcagtcttcagactgaaagtgagtgcagttcatcctatcccctcaggctgcagtgaccattctctgagggtcagactcatacagtgtcaccccaggacactgacagaagcccggcacagtgaaggcctcacctgggaaatgcagctggaggaggctgggaccaggtgtcaactggggcagcttactcaggaaggggatttctttggagacatcccaaggttgaggtgctctaggagggggcacagcgtgaggtgacggggctcccagggcccgggttcttcacccaggatggctgtctgagcctcctgccactctcagggccttgtccctctcagtccagcagcaacctggggagctgagccctctgtcctgggcacttccagatacaccatacctcacttccttctgcctcaccttccagctccaggcggactctgactcagggggaaactcctgtgctcaggggagtctcgggtgggtggggtgaagcatttgggatcctgatcccttcatggggcatccccagcatccttaaggagacactcttcagagggacagggcttctcacctgcctcagctctgaccatggggctgtccacactcagtgacaggacactgaccagggatctgactggagtgaccaggaacctggctggggcaaccagggaccacccaccctctggagctcacatgctgtgcagagaccatgaccctgggaccccttcagagaccatggggcctgaagttagattttcagtccagtgtggttttctcctgctttttgcaagtttacataaaacattgatgagaaaaacatacataaataacagacgagctgagggtgccaattgctaatctcttgtggcaatgaggggtgatgtagcaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctgggccacctgctgctgagtcaggtgtcagcaagatctctccgcagagcccagctcagcccatggccaacctcctggaaggtccacagctctgctgagcctggcccaggacagaccccaggtcagcgaggtttgggacagtggtcatgagattaattcccagaaaggtgactgtgatcacagggcttgaaggctgcagctgattttctaatctgagaccctgcttcttcctcctgttgcctgtgctgccctcacagctggtttgagtgacatctctccaggaggaatcgcagaggatgtaaatttgcataaacgccaaacactgactgcccccaaaagctggagagggaataagagaggcctggggagcccagctgtgctgtaggctcaggaggcagagctctgaatgtctcaccatggcctggatccctctcctgctccccctcctcattctctgcacaggtgctgcccctaggctcagtctccacagaccccaagttgagcctgacctgaatcctgagcaaagccctgccactgcctctgggggggattcctggcaatgcgtcctttgtcctcaagccccctctcctgtcttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatctcacagtgacacaggcagatggagaaatgagacacaaaccccttgccatctgtgtcaccttcttcctccagccccaggaggactgtggacaaagccacgaacaggtctggcccagtacacccagatcagagactctgaggcctccttccttccagatctctacggaggccctacagaaggtggatcaataataaattcggggttggcaggtccagtaggtcctggtgttttctgggctggagtgtgacttggggaaaaatgacttgaatggaagtacagtcagtgggagacatctattgagtggtgatggtcccagtatttccttgtgtggtgactgaacctagggcagtgccactactctgtggcccaaatgccctgggttattcctctgagttccccgtgtattattgagatgctccagcccccactctcatggtatcctgatctgaagaatcatggccagtgcccattgcagtgtctccatctaggtgccattttcaggactcatgcatccagcatccaaacaaggctgtgtgggagaccgtgacttgtcacagctgttccccactggaaaatgccactgagctgcagagaactgctctcccagtgatgttcccccttcacagtgtggttcaggtgcaatgcctgcctggtccctagattttaatgccatgttttcatttaaaataaccacgaagtgtctcttgctgagcgctccggtgtaacacattcccagtcatgcctctcacaattttctttctgacaaaatttcctgaaaccctattgcaatgaattctccctctcagagtaggattgcagggagttcacaaattaacaaacaaaccaaatactgtctagaagaaagaggatcaaagaggagagagctgcacagggagcgcactctggagtctgcagatattcatgagcaccgatgagcatgtgcatgggaggaaaccttctgtgatagagaaaataaccattcaaagacatttgaggaaacactccatagagctcacacacacatccatgtgcacacacatgcacaatcagaatagtgcctgttcctccgctccatgaagaaaggcccgagttaaagtgggtgagatttaccagtgagaagagctttgcctcagtactggggaaaacattgccctagacaaaaggcatctctggtgttaactaagaaagtgtacggcccctgtgctgatgcccatgtcaaagaccatcacacgtattttaaccaactagcccagagttgtcaccaagagtttgatcttacaataattctgcaatgaacatccctattcagactccttggagttcacctatgaagattaccatagaataaatctctagaagttgaattgttaggtcaaaaagaagtacgtttgtaattttcactgattattctcagattcctattcacgggggggttgtaccaatttacagtgccagccataaatctttgacgtgagtatgctgttgaaagtttgggtttttgccaacatggtagattaaaattttgttgtcttgtaacagtgttattttggatttctcctattctgcttgaggttgaacattttctcaaacatttcagggctcttatattttaggatttagtgagcttttttctaaaatggccaggtaaggagggttttagcccctgtgggccaagagtcaactttgaccatattatgagggaacttataactccagttacaatgtaaccatttaaagctataaaaaccactctcagctctgggaccacacaaaacaggtggcaggccaggggtggccacaggatgtggtttaatggtccctgttttgtagggtcatttgaagtttaaaaatttcaccagcatatattttaggtggagatctttttgtgggtaatactgtatttcaccgcctatagtggcctgagatttctctctagataagaacacacttttcttattttttggatggattttgggtctatctgtgatagccctgtgtcataaactcataacttttgtgtccgtccttttactgtgatttttgggagtgtgacagtatatcaggaatacactatccagggtggaaaatcagagagagggggaggagcaagtgggcaaggaagcttgtaccaaagctggaatatccactgcagcaggctcagagaaaagggtcctaatatcagcatttgactgaagccaaaaccacaagagaccatagaggttctgaggatgacaaataaaaacatagtttaagttttaatgcattcattatttttataatccacaaaaattctaaaactcagaatttaacaatgggataaggaaaagagtttgagatgttaaacgataaagaccccaaggaaagttgccaggaaaagaacaggacctttttggtggaactatgtttatgctgtaaattaccctcttctatatgtctatatatatatttaggtataagagaacatctcatggaacacccttcttcaccacagtcaaagatcaccctcacccaaggagggaaccgaaagggaacgtcaatatgagacagaaaacataatgcacttttgtataaacattaggagagtctctatttgcatatcaaatgtggatgcttaatgttaacattggaaatagtaggttaatatgcatgtgaggtgagttttcttttgactatttctgtctgtgatttatctttcttaatagggacatttctgcccttagaacaacttaacttgtgatattttttgttctattatctgtatcagctctgttttttttttttcaaacagtggcaaagatatcccatgactaatgattaataaattcaattaatgggtatttaaattatttcaagagtggacagttgtgacttccccacatctaactcacagatgtcgctgatgctgactcactcttctcttccaatcatagcaaataaagtgggagctttgacttttctgaagacccagatgacaacaggagagaggaggtgaaaccccctaaagctgttatcctttaaaccctcaggaggaatcatcctggagaaacacccacacttgagttggattatacctaaatgagagtttggtcttagagttggtgctgagttagttcaggatttgggttgttgggatggagtgaatgcgctttacaagtgaaaaatacatgagtttttgggtccataggttggagagttcttggctgaattgtgtcccccagagttcatacaatgaagctctaatgcacggtgtgtgactgaatttggagagaatctttaaagaggtgattcagtgaaaatgaagtcatgagggtgggttcttatcgaatctgactggtgttctcgtgagaagagaaaatttgcacacacaaaaatgagacactcgagatgagcgtgcagaggaaagaccgtgtgaggactcagcaaggaggtagcgacccgcaagccaaggagagaggcctcagtgaaaaccaaacctataaacactttcatcttgactccccagcttcagaactgtgagaaaataagtgtctgctctttaggccagcaggtctttggtatctcattaaggtagcactagcaaatgaaaacaaaagggaccccaaagaccttggatgcgggaggaggaggagatggagcagggtgcaggaggtggggcagggaggggctggaagttcaggctctgaggtcatctcctgggtggaatcctgactccactcactgctgtctggggacttggggaaaaacaattaaccgcccaatattaattccatagtaaagatcgggccttgagcacaggattcctcatcttccttttttatatgatgaaagtcttcttgaggtcatgcttgtaaaacactcagcaatgtatctggcatacactatggtctcagaagtggttattatgaattttctagtgatatgtagaggatgacattggtcctgtgggcagagggggcactgtggaccttggtttgaggactctgaaagacaccaagtccgctggtagtgctcaagagcgaagagcatcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgaggagtagatttgcattcactgctcatcagagagcccacccaacaaggatacaagaataaaagaagtagatttgcatgaagagcctctccttcccatgataagagaggcctgaaggtccctccccagccatgggctcagagacagagctatgtggcatctccaccgtggcctggacccctcccttgctcaccctcctccgtctctgtgctgcctcccagggctcagcccccaaaggaccagagatcagactggccctgagcttcagctcagcacagggagtgatgcagagtgtggggctctgggaatgaccctcatcctcataattaactctcctgtcctctcttgtaggctctgtggcctcctccatgctgactcaggagccagtagggtctgtggccctgggacagtcagccagggtaacctgccagggagaaaacctaagaagccatggtacaaactggcaccagcagaagccaggctaggctcctgtgcaggtcatacatcgacaaaataaccagccctcagggctcccagaccaattctctggctccaagtcaggaacacagccaccctgaccatcactggggctcaggttgaacatgaagctgactattaccatcactcatgggacagcagtgctactcacctcacaatgacacagacagattgggaagtgagatctaaagaccttcactgtctgtgtcaccctcttcctccagccatagcaggactgtggagacagccatgagcagggctggcctgggtcacctgcatcgaagtcctccaagctgcccttccccccagctctccaggtagtctctgcagagaatgagtcaggataggatttggggctggcagaaccaggctgtcctgctgttatttggaatggatgtaccttggctcaagatgacctgagccatcttactggaaggacttactggaaggacggtaagagggagacagctcctgagtgctcatggtcactgaatttcctcctgtgtgttgactgaacccaatgcagtgcctctactctgtggcccaaataccctggattatttttctgaactgcccgtgtttaactgagaccctcaagccccagctttgtgcatcctgatgttctgaacatggaagcctttcacagtgtgcactgtgacatccctcagattcccgtttcaggacttatgcacccaccatcctcccagggctgcagggaggccctggcttctcacagctctccccaccagaaactgccatgcagtacagagaatagctttgctcaaagaattgcccatttcagagtatgtttcgggggcaatgactccctgatgccttaatctgaaagtcatgctttaatttaagaccctgaatatcaaattgaagtgccttctagctgaacactcaattgtaaaacattcccagtcacacactccacacttctttcctgagaatatatcctgaaaccctattgcatggaatcctccctctcagagtaggattccagggaacttaaaaattaaaaaaaaaaacaacacaccagtctagagggaaaaatattgaagaggagagagttagggagttgcacaaggaaagaactctgaagtctgcaaatatgcatgcactgaagagcacttgtgtgtaaagaaactccctctgaaagagaaagacccttgagggaacactccaaagagtgtgcatgcgtgcgcacacacacacacacacacacacactccagtcacagaggaaaggcctgagttacagagcatgaggtggactcatcagaagagcttcggctcagtattggggaaaatgtcggacagacatagggctactccactgtcaactaagaaagtgtagaagcaaactgggaaaagttaagacagtttccaagtaactttactgaatccaaaaataaaagaccaaaatagagaagaaaatgcaaaaggattataaactcaacaaagaaaaattcacaatgattggcattctgtcaatatttcttgcaagcaaaaaagaaaatatatgctttaacacagagaaaaatgaatcaatccaaagtggccaaaaattgcacacatgatagaccttgtaggcacgaattttggagcaattctttttttttttttttttttttttgatggagtctcactctgttgccaggctggagtacagtggcgcgatctcagctcactgcaacctccgccacccgagttcaagcgattctcctgcctcagcctcctgagtggctggaactacaggcatgtgccaccacacccagctattttttttttttaatttttagtagagacggggtttcaccgtattggccaggatggtctcgatctcttgacctcatgatccacccgccttggcctctcaaagtggtgagattacgggcgtgagccaccgcgccagccttggagcaattcttataactcttttctccttcctcatgagaatggaggatctattgaatgtgttaagtggagaaatggaaagcataaagcaagatgcaagttaaacttttagaaatggcccctaaatatctgcattgaaaaaatacactggatgagactcattgcagattagaagctgtgaaggaatagatgagtgaacttgaagatatggcaatggaagttatgcaagatgaagcacaaaaaaagtgaagagagcatcagtgagtttcaggacatcttcaagctgacttactggttataattaaagacatgaagggagataacattggtggggggagaggaaaggtagaaaagccatttaaaggaatcatggccacaatttcccaaatttggtgaaagctagaaacccactactccaaaaagcttaacaagtcacatacacacacacacacacaaacacacacacacaaataacacaccaccaacactcaccataatgaaattgctaaaaacctattataaagacatacttttaaaagtagccataaagacatggtatgtacagatgaacaacatcataaaaagaacagatttctttttctttttaaaattttcttaaacatctgtgggtacagagtaggtgtatatgtttgtgggatacatgagatattttgatacaggcattgccatgtgaaatagtcacatcatggagagttgggtttccatcccctcaagcatttatcctttgtgttacaaactactcaattacactatttcaggtattttaaattgtacaattaagttgctgacatgttatcaaatagtattgatgtaactctgacatgctatcaaatagtaggtcttattcattctttctattttatttacccattaagcatcccctaataagagcagatttcttcttagaagtcatgcaagcaggaggcagtggagctatatttataaaatattaaaagaaaaaacttactaccaaaacccatccacagactcaatgcaatccctatcaaaatacaaacgacattcacagtagtagaaaaaaactctatagttggtatggaaccacaaaatcccctgaatagccaaagcaataccaagcaaaaagcccaggctgaatatgtcacattatctgaatcaaaatatactacaaactacagtaaccaaaacaagatcgatggtattggcttaaaatcagacactgagactaatataatggaatagaataccccaaaataaattcatatatttacagccaactgatttgcagcaaaaatgccaaaaacatacgttgagaaaatgacatacttttcaataaatggcgctgagaaaaactggatattcataggcagaaccttgaaactagacttttatctctctccctatacaataatcaactcaaaatttattaaaactccgaaatataagacccaaaactataaaactactagaagggaacgtagagaacacaggggaagttcttcaggacgttggtctagacaaaaattccatagctaagacttcaaaagcacagggaacaacacgaactagacatatgggacttcattaaactgaaaatcttctgaaaagcaaaggaaacgatcaacagagtgaagacaacttctagaatgagagaaaatatttgcaaactattcaactcaaaagggcctaagatccagcataagaaaataagacaaggagctgaaataactcatcagcataaaaaacaaataatacaattaaaaagtggataaatgatatgaatagacttttcacagtcaaagacatacaaatggccaacaggtatatgacaaaatgctcaatatcactaatcatcaggggtacgcaaatccaaacctccatgagatatcatctcatcccagttggatggctatcatcaagaagacaaaaaaataacaaacactggtgaggatgtagagaaaatagaagacaaaaccacatggtcatctcaacagtcacatcaaatgttttcatgcgaggaaacattaccatttgttgtttttctagtcttgctagagcatcataaaaagataagatttgtggtgccactattggagaaaatgttattacatgcaaagactctggctatcccacaccaaactacatgaacacttactgttaaatgctaaaagaggccaggcacggtagctcacactcgtaatcccagcactttgggagaccgaggcaggcggatcacaaggtcaagagatccagaccatcctggtgaaaccccatctctacaaaaatacaaaaattacttgtatttttgcacggtggcacacacctgtagtcccagctactcgggaggctgaggcaggagaattgcttgaacccgggaggtggaggttgcagtgagccaagatcacgccactgtactccagcctggcgacagagtgagactcaggcaaaaaaaaaaaaaaaaacctaaaagattacaattctgcatttccaaatgttctggtggtcagagaccacttccttgacaagtggtgagtacggggatctgatgggataggtggcatttaggcaggtattgggtgaagaatagtgatatacacaagaaactttcaaagagaaaaacacacggaagttggaacacagaagagaacataatatgtctgagaaataaggaaagtccagactcactggagctgagtgagaacaagaaaaatggcataagccatgtatttctctctggatatctcatcaaaatattgtctcctccccaacacaccacccatgtgaattataaaaatgcccgtttttaatttttgtttgcatgtcgtgacagagtcaagcacgtgaatcaagctgagtttgatgagtccagggctgttaagctccagacccaggtggcctcagaaggacttggtggaacaagggcttgttgtcaaaagcagaggaagtgagattttccattgtggcttagaccagagattcttaaattccagtggacacacaaggccccttaaggatctggttaagatgcagatgcagcctcagcagttctggatgtggccccaaattctctgtgtccggcaactcccaggtgaggctgctgctgctggtcctcccaggaccacactttgagtggctgaactcttattcacccacctcactcaagccacgggtgagactcacacaaggagggcaccttctagaagcacaggtcacttctcactcctccccttgtgtcttagatcctttcctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggcgagccagtgtgtgctgaggtcaatgaggggaaggaagcaagagagaaagggaagataccagtctcatttaaataagcagctcttctggaaacagaggaaattcactcaccccaagtgagggcattaatctattcatgagagatccactcctatcaccctaaaagctcccattaattcccacccccaacactggggattcaatttcagcataagatttgcaagggatgaagatcaaagccatagcaccctgaggcttggccacacacttgctcatctccacatttgtcccttccttcaggaccgggatcctgactgctctgactcagtctccgtctacctcatggacacctggcagtcggtcatcatcggttttgctgaatcagcagcaacattgggggtaacaattgtgtctcctggttccaccagagacagagtagagacccacacagctgaagtgtggggtcaaatattaaaactaagagacataagattgattctcaggctccaagtctgacaagtgagcttctttgagactccctgggatcccagcagtgacactgatcactgttgctgttccacacatcccaagtgatgaggaagtaagaccaaaaccctcctgagattcctgacttgtgtcctgacaccaggtctgttcttccctcccctagaataaaacatctcttaagcacaaggctgaagaaatgtggcctcctcctttctcccacagctggtcaaagtggatacctgagagaattggctcactgaggcctcttgggaacaaaggctgggttcctgcctgtgatctgtgtactgagacacattccggacctgcccaggaaaggcaagtatagatgatgtttagttgtcacagagtccaagtagggacaattcagcggtgtcttcttgggacccctgcctctggctattttcatctactttataatgggccagggccattatttccaacttgtcatatcctttttctcctttcctcaccaggtaaggaggtggaggacagttgatgagggctggcttatgagttaccccaggatgcaaatgactttgaagtcaagcccatgtggggtcaagctcagtctataaccagggtcttttgagctctggaggagccaggcatcccagccatcaaagaggtcttgcatttgctaataaatcctcttcttccaacccacagcttatcttggctgcctaccctcatctctgtcaggaagcaatccttcgttgtttaacaccaaattattcttacttggtcagtttaaaagtcccttcctcagaaaggtcatctgtggcctgaagacaaagtgagaaggctttgctgcattttcatttggaaccttacattgccccttctgcaatgttctaaccacacatggcacatatttacaggacagcgtgataattcacttttgaaaatacagaatgtgctcatggaacaggacaatgtcatacttttggggcctgatgagcatgtccttttcacaggaccccccagagctgcccatgcatccagaaggtaccattctactctatgcaaaacgatggggcatttctatattgcagtttcttagggttccttagaaagaggccacccccaacacagagctgcacaccttgtgaccacttactgtcaattcctcaatgctgtctccaagtctcaccatgcacaagggaggaacacagagaccctggattcctagagacttgcatttcttggatgaacaaatctggggtttggttggtggcagagagctcagggctcatgtgtgagcatcacctgatgcttcctccagggtcagagtccagcccctaccctggaaggatgaaagatattgtccacagaagtggtataaaggtaacagcatcgaggacggagctgcctcttgaaatgggctattgctttgcacaacgctggagacctaaattatgttgactataatggaagagtagtccctgcggatggcctctaattgggtggaagaaagcagagggtctgcgtctgagagagcagcaatgggcagattcagcacaggcatgggcagagcagcaatcaagggtacctgagcagcaatggccccgggagaggcctggcacctgccggaagtgacgttggagacagagaaacatctaagacttaaggcttctctttctgtgcaatcccccaccccacagtttatgtgtcacagatattggcacctccttactgtaaggggtcatatgaataatacagtcctcaggggcatgggttcgaggggcagccaggtttatcctcgaagcccacttctgttacctgcagctgtgtggctgtaagcaaggcatttaatctctcagaaaaccatcctaatgagaggttaagaacctctgagaaaaaaacttagacaagaattgacagtaattcttcactattgaggctgcagggatgtaacttaatcatgtttgtaaagtgcataacacagaccctgacatgccccagctgctcctgagttggcagcaattattcctgacatcactcatgagaattggacctggaatggggatggagggaaggcagtgcagagggtttcagagggttaggaaaagagagactttaatgatttaaaatgaaggcctaggagtggagacaagcgtcctgggacattctcctgccaactctcacaatgtctcagagactgttccaaggtgaagtctactagagagctaagggaggagtttgcagaatcaaggtttgcaatgtcatgcatgagggggcagagagtcagcgggagggaagacagctgagctcatctgaagggtatttatggttttctggccctagagtccttggccatccctctatgaccagggcctcagataagcagagagcttatctgcttctctcctccaacgatagttcctggttatcctgagcccaggtcagtgcagctgtggcccattctctcctctttgtgctcagtggactgacctggaggaaacagtaggaggttcccctgctctctgtccccagggtcctttcctttcagtggcaccagcccagccctagtgtccatccatctgtgcctgcccagtcaggcctccatgctgccccctgtaatggccacaggtcaaaaactgattgtcagtcttgagcagattgtcctgactctttctgcaaaactgagcctctcacccagcaccaggacgtcacaagcaaggccagctgtaggaaggcaagtaggggagtaacgtgcatcacagagtctggacaagacaaagtagttctgctgggacacatcctggtgatgtttctcaggatggttcaggtccctgcaattgcaggcccagagaacaggactgaaggctggaagatgtgctccctttctcctgtacacaaaacagtgccatgtgtgcatgtgagtaaatgcatatgcctgtgtgcttgtgtgtgtgcacctgtgtaaatgcatatgcctgtatgtgagagagtgtgtgtgtaaatgcatatgatgtgtgtgagtgtgtgcatgtgtgtaaatgcatatgcctgtgtgtgtgcatgtgtgtaaatgcatatgctgtgtatgagtgtgtgtgcatgtgtgtaaacgcatatgcctgtgtgtgtgcatgtgcatgtgtgtaaatgcatacactgtgtgtgagtgtgtgtgcatgtgtgtaaatgcatatgcctgtgtgctggtgtgtgtgcatgtgtgtaaatccatatgcctgtgtgtgagtgtgtgtgcctgtgtgtaaatgcatatactgtgtgttggtgtgtgcatgtgtgtaaatgcatatgcctgtgtgtgtgtgtatgcatgcgtgtaaatgcatatgactgcgtgtgagtgtgtgtgcatgtgtgcaaatacatatgcctgtgtgctggtgagtatgcatgtgtgtaaatgcatatgcctgtgtgtgcatgtgtgtaaatgcatataccttgtgtgtgtgcacatgtgtaaatgcatatgcctgtgtgtgagagagtgtgtgtaaatgtgtgtgctgtgtgagtgtgtgcatgtgtgtaaatgcatatgcctgtgtgctggtgtgtgcacatgtgtgtaaatgcatatgctgtgtgctggtgtgtgtccatgtgtgtaaatgcatatgcctgtgtgtgagtgtgtgcatgtatgtaaatgcatatgctgtgtgtgtgtgtgcatgtgtgtaatgtatatgcctgtgtgtgtgcatgtgtttaaatgcatatgctatgtgtgtgtgcatgtgtgtgtgagtgtgtgtgcacgtgcatgtgtgtgtgcatgtgtgtaaatgcatatgctgtgtgactgtgtgtgcatgtgtgtaatgcatatacctgtgtgtgagtgcatgtgcatgtgtgcacatgtgcatgttagtgttgccagggagtgcttcaagtatcgaatgtcccaaattcacaacttttctattttcctcacttacctcctccctgacacatgcttctcagttaagtgagttcatatgcgcaaggcctacaaacaggcaaggcatgggccatagtcagtgctgagtcagtgtcatcaaatattgttatgcttatatagaaccttgtccagggtgggccaaatgtatgcccctgtcttgtcctgacagagcagcagaaagggagactgagacaaaacaatggccagggccctggcaacacggagacaccttcccactcctgtgagcttcacagacaaccctgggtatgggattcctgtcattcctttaagattgttcaaataaacagtgacaatcactctcatatgatatatgagaagaagaagaattccatataaaccaaacccatgacgcccacactgaagcctgccaagttctctccagtcgagcccaatggagggagcattttcatggggacttttgagagtatggagaagacctgaggaaaccaggctcagctgtgggctccagaggcaaagctctgggatgtctccccatggcctagacccttcgcctgccacctcttctcactctttgcacagatgcttcccccaggctaagcccccacaggaccctaatcctagtcctgaccctgagctcagcccaggtgatgcttcaggagatgggaccctgagaataagccctaaagtctcctcaacctgcaggctctgtagtctcttaaagactcaggtacctccagtagagttggccatgagacatctgtccctccaactgctcaggagcaggcaacagtgcagagagaaacagcagcccaggccaggccctacactcaaagcagcccccaatccccacagatcctccagcgctaacctggggtacaggccccacctctgcaggctgaggtgggctcctcagcatggctaggccatgacgggggatggcagtgtgtccatgggacacagccctgctgcctgcctggccctcatgccccgtccctccccaccctggttaagctctgccccaaagggcccaggttcataactcaggacacctggatcggctcttggacttgcccccactgttctctgttctcctgagccacttagtttcttttggccacagtgttacctgctgcgaagtgaggaggcttatactgaactgaagaagcacttttcttcattcaaaattaaaagatagaaaaacaatggaagtcatgcgaatggggggatgtcatttaatgggcttcagtgggcttcagacatggaatttcttgtctttcctctgcagagattccaagaaaaggactcgaaaagagcttgctttctatatggtgggaacagcagctgccagctaagaataagcaggagagtcccagtttcatcaggaaaacagactaggctagtatggaaatcctccctgcagaaactctgagaagtgtggaatgaaataaacataaacatgaaattaatctgccaacgatggtgatgttagctcacaactaagctgcagtgccagaaacatgcggtgattgcagtgaatcatagctgctcttactgggtgggaggtgcaccagtttgcttcctaagtgcatagaaagcctggcacgcacgtctctctggactttgaaagcttggcagaagagcttcagttgacttactctaattagtcctgacggaacaaaaccactagagtagggcatttcaaccctgagacacttctgtagcaattgctcctgccccacatccctgcactgcatgtgtgacctctctgtggtgggctgggcagggcagattgggccacactggcacagaatggggctggactctctggtcctcaacttctgaggtgacaggtgctgtggggtcacctggaaggaaaaagctcctgggctgagtctcctccaccagttgggggcagcagagctgcagccagcagcagtgaggagagaggctggggctgcccagccggggaaaagaggaaggcctgcctaaggttcaacaggtgtccaagaatcagtcttcagactgaaagtgaagacagttcatcctatcccctcaggctgcagtgaccacgctctgagggtcagactcatatagtgttactccaggacactgacagaagcctggcacagtgaaggcctcacctgggaaatgctgctggaggaggctgggcccaggtgtcagcttgggcagcttcctcaggaaggggattccctggaagaagtcccgaggtcaaggtgctctaggaggggcacagtgtgaggtgacggggttcccagggcctgggttcttcacccaggatggcggcctgagcctcctgccactctcagggccttgtcctgccctgtccagcagtgtcctggggagctgagccctctgtcgtgggcacttccagatacaccctgcctaccctccctctgcctttccttccagctccaggcagactctgactcaagggcagctcctgtgcttaggggagtctcaggtgggtggcgtgaagtatttggggccctggtccctgcatggggcatcaccagcctcattgaggagacactctccagagggatggggattctcacctgcctcaggccacagccctgaccccggacctgtccatgctcagtgacaggacaataaccaggaacctggctggagtaaccagggaccacccatcctctggagctcacatgctgtgcagagaccatgaccctgggaccctgggaccctgggaccctgggaccctggaaccgtgacagaatccatggggcctaaagttagattctcagtccactatggttttctgctgctttttgcaagtttacataaaacattgatgagaaaaacataaataaataacagacgagctgagggtgccaattgcttatctcttgtggcaatgagggaatggtatagaaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctggtccacctgctgctgagtcaggtgtcagcatgatctctcggcagggcccagctcagccccatggccaaactcctggaaggtccacagctctgctgagcctggcccaggacagaccccaggtcaacgaggtttgggacagtggtcatgaagtcaattcccaagaaggtgactgcgatcacagggcttcaaggctgcagctgattttctaaccagagatcctgcttcttcttcttcctcttgtcgcctgtgctgcccccacagctggtttgggtgacatctctccaagaggagtcccagaggaagtaaatttgcataaacaccaaacactgactaccctaaaaagcctgagagagaataagagaggcctggggagcctagctgtgctgtgggtccaggaggcagaactctgggtgtctcaccatggcctggatccctctacttctccccctcttcactctctgcacaggtgctgtccccaggccctgctccaggccctgctccagtcttattccccacagatcccaagttgagcctgccctgaatcccgagcaaagcccagacgcagcctctgggtgcgactcctgggaatgggtcctttgtcttcaagccccctctcttgttcttccttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtacttatcccacagtgacacaagcagacagggaagtgagacataaacccctccccctctatttcatcctcttcctcctgccccaggaggactgtggacaaagccatgagtaggcttggccaaattcacccaaatctgaacccccaggctgcccttccctccagccctccaggcaggcactgcagagtagtcagtctggagtggatttgtgcctggcaggccaggctgtcctgtgtttctttgcctggggtttgagttgtcgatggagggtctgactggaaagacagacacagggagacatccatgcaggcatgtccaaagggacatggggaactctcaggtctcagttgaatgcagtcattgttgtatcctctgggaaagcattcctctagtgcatctaagacctccagacccacagagcctgagatcaggaggagagaatgttaaatttttgctaatggaccactgaagacatttttgagtggagccactacaatttactccttgattctggactcatggatcctgactgtgggagaaacagcaccatctattgggcactgatgcacagaacatgccctatcctggaagacattgtccagccctacacatacttgccacttgcctggtgcagtaatggtgtctccaagcagtcattaaaccattcatataagccatatgtctcagaatgtttgggacaagagtaagaatcttgattgccagaagaaaaggcccatagccctttatttgcagtgaaatgaattccttggtcagaacctcctgtggaataccatcatgatgggtgcgtcattctgtaatccagagacaacagttttggcagaagcattgctgtcaatgaaagcaaatcctctgtagaataaatgtcaattctagtaagaaaaaagagctattcctgccatgatggaagagtgcaaacgaaattaatattaagcaggcccctggctgttttccacagagaaagtcatcctatagggatctctgtgttagtctctgctgttggcagatggtcactcagcagtggctacagccaggccagctccagttagtggaaatcgacattgatgagcccatggacagcctccatccctgccaccatgggcgcttttttttatggagcccactgggcattgacaagagtggttgagggaggctgcctgatgtccacagaacaagtcaccctactcacctgattagcaaaatcacttcattttcacagaagacttggtgagtattgacatatggaaaaaattctcttactttctgcccaccggaggaggtctattcacacatctctccccctgacgtatttgtgatcaatattctcattgtgtctctctcaagtccctgaacatccttgagcatctttcaagaccctgagtcacaacctgtgaattaggaacctctgcccatctcttggcaggtgacatgagccaattgcactgcttaaaattctactttaatgagaatgttcctccaacactgctgttcagggattctcagaggccaggtggagtactagcactgtccacaccagtagtggctgcatgtcctgcagaaaactctgtaaccccagcctaagtgcctcctcctaggcagctgatctcagggagcccctcaggacgtcaaggctgtagggtgagaggaagacatggtgcagggctccggtcatgtctatttggccaactcttcatgaaacttacttgggcctcgtgacctagtccctcaagtcacaaatacatccctgccatgtgattgaggagctgctggaaatggccaaccgggactgtggttcagaccaaacctagcatactggcaacttgggtcgcatggtgagctgtgtggccacaatcacacagagcctctgctgaggcccaggagcgttcgcagtctttctcaaatggagctttctgctcattcaaaaaaataagtagagggaggctgggaccccaggaccacttagaccacgcacatgatcttgtctgattattctgaatccttgcatgctcagctatgcattatggtaaccaagccacagtgtctttggcaataaaatgccactacttggcccccacctaacctgggatcccctcaaccacatcttgctacccaaaacaggtttcacctccactgagagaaatttatttttatattgagaagatgaaagattaattatttcaattgtgaaaattttataggacagtaatgtgaaaatattttaaaagacactttacgaagagtgaaagaccttccattaaaccactcaatatatgacactgtaattggcctacccaaaccctaagttcagctccgggttgggaccttctgggaatggacccttcatcctcacgccctcctctcctctcctctcctctcctctcctctcctctcctctcctctcctctcctctcctctcctctcctctcctctcctctcctcttctgtcagccctgtgcctcctatgtgcagagacagctggtctcagtgttggtggccctgggactgacaatcatgagcacatactctggagataaccttgagataaacatgcattaaggaaccagcagaatccaggccagtccatggtgctggtcatctagtataacagcaactgaccctcagggacatctgcccaattcttaggcttcaactcagggaacatggccaccatgaccattaatggagcccaagcccgggaagagactgactattgctgaactgcagataataacagtgggagcagctggcagggactcatagtaacacagagagacagggactagccacagaactgtcccatctcggcctggctctcattctcagctgccctgtgagcagctgaaggtcaggcctcagggtcaggcgtcctctctggtcttaacctggcccctgcagggctggtgattctgagcagcttctccatcctctcagggcctgcatgtgtccagtgagaagtgagtggacagggggaagctggttggagctgcaggaacctctgtcaggtttgtggtgtacatgaaaggtttaggaatccacacaacatcacatggccccagatgtaatcacacatcacacaggggaggaaagagctgtcgcagagggtacagtcctgtggaatttctcttttccttgggtataagcagcttagtggaagctccagaggctgtgtctcctctggtttccagatgagttcagttgacctccgcattctaaaggggtgcctgaggcctgaggaggactggagacccagccccttttggccccagggccctttctgtgctgacatttcacagaaactgaagaggaagaacagacactacctttcatcccacctggggactgtctttggggcacgctgaactcccatggcccccaaagtcccatcaccttccccaggtaggtcagacctgactggatgtccctctagtgccctgatagtgtggattttatctttgggctctgggctgctttctgaggagctcactaagaacccttgatgccaagtccaggacctgcccctctgctccatgtcccaggggctgcaagcatgacgggaaggtcctgctgggtgaggatggtgcccttttccagaagagatgtctgattccagtctctagggccaggtttgttgggctttttttctcacttggaaggtctcagtctctttattaccttctttaaaagtacaattggtttaatcgtgaaatcatgtgcatgcactaaagtttacagactatggtcatcagcacatatgtacactctttctggatgggacaactgtggacacggccatactggggtctctgtctctctcattatcacaagggaggataccaacagctctctcctatgcagaccgtagtcatgtttcccaattgcacaagaatgtctcttacagttgtttaatttccttcccagccaggacgcttaagtttcccatgctgatacttggttgctatttctctctgatccaacatttttcaaacagtattgcttgcaacccaaggcttatgaaacactttaccaaaagttccacaagaaaagctcaagtttctcatgcaccgttggaccaggttcattgcgtgcagtaggaccttgctcaagtgatgagtccatttgatgttttcaccatcaaggtgaagggtattatgacttttgggcactgagttgatagaaggaagacagcagctgatgatggccctgcccaccgatgtgtgtgtgtgggcaggacctatcgatggatttagaagttgagggaactgtttattctgcagatggaatttccagcactgaatctccaccaaccagacactagcactcagcaggtgctctgtaagaagaagcccttcactgccaatcacggccattacacaggtgaaggagaggatgatttttaacagccattgaccctcacagtaaactgaggtcaaaactctggtacacaaagtgactttgagagaacaggctgaggaagcaggttaattagtagcagaaggctttgccgagagcaggaacaaaacagggttggtgaggaactagtgatgccatggtgtggaaggaacaaggcctgtaccaggagcaggaaggggcatgggaaagaccacactgccacatgtgatgagtcagcacatggaaggcacagcaaatgttgcacaaaggtttttgtgtaataacctggcaaacagctgcttctctatcaagattgatgagtcaaaaaatgttactgatgcattgctgtcacatgtgaaggtgtgtgaagaatggtgacattcaaggaaacctgttctctgcagacacctacccaccagtacagcagacaccccagctatgccaagggctttgtcttcctctggggtaagagcctgggaacaacaagttggcccctgaaaggggtgccccatcatgcgctcttcatggctgagttaagtggggagctcccagagaactttccagtaaatggtcaatctgtttgttctgggtgcattgagcatgacccaggatcaatggaagtgacagaagcttaatttccccaaggctgcaaggcgggcactgggaggacggctgaagcagtttagccaccaccccctagtggctccagccccaggtaagcagggacagttgaagggcctgcctgagcccacctgtgtctaattagttccagcatcagcagctgcatcctgtagaccaccaaggagtgtgtgtgcccagcccctcacagatcacctgagcataaacaggaaattctccttcttacacctgactgcaccacacatctgccccttgctcttcatttacaagacgctatcacatcagacacggactgatctgagtcccgggttccctcaggtttctgctgtcctctcagatccccacacacaaaagactcttcaccacagggcgttgagccagctcttcccctaacactgcctcttacaggttactcttctccaatatgatgcgggtttgatttcagtgtttctacatatatacttttgtattttattgggtaagctgagccccttgtacctgatcttgagtcaggcaggggccacacagagaagaggtgttcctcccctgggaccagcagtcctcggatcagggcatcagggacctgaacagcaggttctgaatccacacctagacccaggaagtccctgagcccccagcccacagtgtggagcggccaccagggggaagcagagagttacctggcaaagccacctggcgatggggcgggcctgggtgacagggagacgctgacatgcagcaggagccagtgaccatgatctcacacctggaatgaaagggtctttattttcatagagtattgtccttgtgtacttgacactcatgtagaaattctagaataggattttaccttcagctcttgcagatgctgcctctttctctgccacagctccaggcacttgacttctcacagtgccctctcctcacacacccagttgtgctaaaatggtgtccctgccatgtgcagtgtcctccctgaggtcacaggtgtcccctttatctcccctttgctctgggagcccctgtcctgcagacacagtggcttctcctttcctggctgctcctccactttcattgtccctggtctttccggactctctcctggggaagctgccaaatcatggctcttgatttcctggtgagtcacaaaatagttgctcattaacctttagttgacttaagttcttaatcattgatacattttccccaacaactgacgacaacttagttataataaacattcacttctgggggtcttggagtttgcagccccctctcattctctcatggagcaaacatttccttcgcctcctcatctgtctctgatcctgacagcatcctggagatactgaggcacagcagctatgacctacccaggagcttgcagccaaggcagaaacttccatcacctcatggatcttccagcactctgtgtgcacttgacaaataagaaattccattgtcctctaccactcaggagctgtgccctgcggtgggacctgcacctttccaaggtgtgtgttatcatctgcacagtggagatgaagagggaacctgcattgggttctggaaagtaccatctaaaaatatatttagacctgcaacagaaatctcctctctaacataaaatatttatgatcaggacacactgagaggcctagaccaaaattaagcactgccctcctgagccaggatagaatggaggaggggactggggaccccagataattccacagttaccagcatgactctatgatcacctcctggaccagatcaaagatcatcccatatgaaggacttcatattccttaggaaatacaaagtcacctctgagctctgctgtgaccaagtgagcccaggaatgaggctgagcacagtgtgatgtggagatgtctgcagagaatatggaatcaattgataaaggagatcctgtgggcaaagggtgggagggcaaggccacccctaacctctttgggtcccttggggctgagtccttctggaaaccacaaagctcctccagcagcagcccctgactctgctgattggcatcacgggctgttctctccaacaaggggttaagagagacctgggaggagcctgcccagcctcagacttgagaagcagcattggaggcacttcagccatggcctggcccctcttttccttggtctcctgactcactgcccaggtgctgcccccagggtctcacccacctgcccagccccaggcctccaggttcagcctggccatcagtctgagctcagcagggccctgtgtgtggtgggcaggatgctcgtgaccctgctgcagggggaggggctggttgggctgaaatgcccccactctgtgctcctgtgctcatgggtgccctgagagctcttttattcctggggctcactccagccctggcaagtagcaagatatcctggggttgagcctctcagtttcaaattttttatctcccctttccttcttgcaggctctgtcacctcctgtgagctgacacagccaccctcagtgtcagtagctccaggacagatgactaggatcacctgtggggaaaacagtattggaagtaaaagtgcttaatggtaccagcagaagccaggacaggcccctgtgtgggtcatctatggggatagcaggcggccttcagggatctctgagattctctggctcaaactcagggaacaggaccaccctggccatcaacagggcccaggctggggaccaggctattactgtaagatgtgggacattaggactcctcatcccacagtgacagaggtagatggggaagtgagacacaaaccccttccccatacgtgtcactcttgtcctccagcccaggaagactgtggacaaagccatgagcatgggtttcccaattcacctggatctgagaccccccaggctgccctttccacaggccctccaggcaggctctgcagaggggacatcaagactgaatttagggcagaggtgaccaggatatattgaggtttgggggactcagttgtgatttggggaaatggggccagaatggaaggtcaggccaaggtcaacatccttagttggtctctggatttccatagggggtgaaggccagtccttgggctgaatatcctgagtcagtttccagaactgcccagctcaggctcccatggcatcctgccattctctgaaaagggccctggcatgccaggtgctctgggttctgagggagagttggaatcagatcctcctgcaggaatccagggtcaggagaagcagcctcacctgacacagggaccacagatgcacccccacagggtgagctgcaggatggatgctgctcatctccaatcctcacatcctatgcaaaaaatcattcttttcacccctccttcagtgtatcaaagttgacacttaaaaagccttaagagcccactcttgtcaacagaaaacccattcacatctccatcagccacacaatctccacagaatgattcttcaaaaaacgataacagtagacatgaaaaggtatctaaaatgttacataaataattgaacttagattacatatgaaaatgatactatttttggtatgctaggtaaataaaatatattatttggactcctttactttcttctctttgtatttctaatgtggtgactagacattgggattccaatgaggctcacatcatattgtgattgaacagtgctggtctgcacctcttcaggtaacaggggctgtggagtgacctggtgcaggaagccccatctccaatcataggacatcagtgtgaacccagggagaggcactggtgcaagagaaatgagaacaggagtgtggaccatctgcttgtacaggggactgagccctcactttgagccaaataaactttttttctattttcaattctgaagaagaagactttcctggacttctttccgttttcagatttgtgccccttcaggtttggcctgtctggatcccagccaggggacaccgaggaaatccaggagtctcacactgactctgttgtatttcatctgctggggtcatcccaaactgctgcgtatcgtttcctttcctggtgctcaaatagctgctccatgcacttgtcacggtttcatagctcagtctaggtgggaagacaggatagtgtatgttataatatttaaatggaacctgaatccattcattgtttttgtttttttgtgtttttgtttgtttttgttttgtttcgtttttgagagagagagagagtcttgctctgtcgcccaggctggagtgcaatggtatgatctcggctcactgcaacctctacctcccaggttcaagcgattctcctgcctcagcctcctgggcagctgggattacaggcccccgccaccacatccagctagtttttgtattttagtagagatgaagtttcaccattttggtcaggctggtctcaaactcttgacctcaggtgacccacctgtcttagcctcctaaagtgctgggattataaaggtgagccaccacgcccgacccaatagtttttttaaaatatgaaatgttaaaagagttttgtcataggcattgggaaaggtgaaaatagattaaaaacattttaagaaaaaaaccaaaaatgtacttgtagactgtctgtgtgtcttcagtgttgcagggttcagagaggtcagttttatggttcactaaggaggggctaagatggaggaaaccaagaaagccaaaaacacacatctctgccactcaaaacataaatcaaagtaaaatggaaaaaatctttcaataaatcattcccaataaatatcactctggtgcacatagaaaggcctgttagcaaactttccctttcccctgctggctcatatccccatggatcacctgtgtgcagagtggactctgtggtccccatttctcaggctgagaaccagagactgggaaggacaagtcacctgctcatgagtgggaagggcaggattgggagcagctggcttgggttcaggactgtggccctggtcggtgctctgtgtccctccagagggtccctcccacatgtgccccgtgtggatgtgggtgcactgcctggggtggctgatgtgctccagggattcgatggtgcagatgcttcagcacaaaacgtggaggtggggatgggatgaggctgcagctggggagaccagagaccagcgccacccagcagaggtttccacggggtgggcagccccatttcctgacagtagagacaggctggaggtgggtgccaagcagagggcgctgtggggtatgcccaggcctagagagtcacagagacacaggcactacacagcagaggcactgagggccaggagctcactcaggtgagagacttcagcagatccttctctcctgagcaaatcaggtacaaaaaaaattaagttcctgccatcagcatgcacaaacaagaacattcatctcttcagctgagccctgctgtccagggaagcaaaagtctctgagcccaggcccacgtgagggtggggtgaggagaggagcccaggatgctgattttcatggaggccccgccctcctctgaggcaaaggggataagacagggctggggcagggccagtgctggggtcacaagaggcagcgctctcgggacgtctccaccatggcctgggctctgctgctcctcactctcctcactcaggacacaggtgacgcctccagggaaggggtcttggggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttccacagtggtccaagttcatggggaactgagaccaaaacctgcccagggccttcagacttcctccttgctctgaagatgcttcctcacccggtgcaagaggcttgctgcagcgcggccttgagaattcttctctctcagctccttccctttccaccatgaattccaacaggaaacctgccctgtggtttcccatccaggacagggacagcttcctgatgcttgtgtgctgtggtccctgaatgtgcaactcttcccagctcttcaaatgcagggacagtgacaaggagctgcctgattggtgcagtcactgcttttttcagggatgtcttcaccctacatgtatcatcatcccctacactgtgggtagaattttagcaactacattctaatggttatcgccacaactttgatcttagaaataacagtgcagtgaacatccctatgcaggctcctttgagttcctgtgtgaatacgaccataggattcatttctaaaagtgaaattgcgggtcagaaagatgtgtgtttgtgattttcacccaatgttgtcagattcccctccagagggattgtaccaattttcaatgccagctggaagtacttgttcagagtacattgttgaatgtggaaatttttgccaacgtatcagagtgaaaaatggtaccttgttacagttttatttttcagtctcccgttctgcttaaggttgggccttttcacaaatagttcagtactcttcatttttcatgatttggtaaactttataaaaaatatccagataagaagaattttagtctttgtggccagacacggtggctcatgcctgtaatcccagcattttggaagactaagacgggtgaatcgcttgatcccaggagtttgggattagcctgggccacacagtgaaccctcatctcaattaaattaaagaaaataaaaataatttttaaaaaaatcctttgtggtccaaggatcaactttggggatattacctatggacttatatcaccatttacaatgcaaacatttaaaatgataacaactactgtcagctgcagaactaatttgactccatcaaaaaaaaaaaagctaaaagattataattctgcatttccacatgttctggtggtcagagaccacttccttgacaagcagtgagtacggggatctgaagggtagttagcatttaggcaggtattgggtgaagaatagggatatacacaagaaactttcaaagagaaaaacacatggaagttggaacacagaagagaacataatatgtctgagaaataaggaaagtccagactcactggagctgagtgagaacaagaaaaatggcataagccatgtatttctctctggatatctcattaaaatattgtctcctccccaacacaccacccatgtgaattataaaaatgcccgttttaaatttttgtttgcatgtcgtgacagagtcaagcacgtgaatcaagctgagtttgatgagtccagggctgttaagccccagacccaggtggcctcagaaggacttggtggaacgagggcttgttgtcaaaagcagaggaagtgagattttccattgtggctgagaccagtttcttaaattccagtggacacacaaggccccttaaggatcggttaagatgcagatgcagcctcagcagttctggatgtggccccaaattctctgtgtctggcaactcccaggtgaggctgctgctgctggtcctcccaggaccacactttgagtggctgaactcttattcacccacctcactcaagccacgggtgagactcacacaaggagagcatattctagaagcacaggtcacttctcactcctccccttgtgtcttagatccttttctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggggagccagtgtgtgcagatgtcaatgggggagaggaagcaagagagaagacaaagatgccaggctctttttaataaccagctctttcggaaacaggggaattcactcaccccaagtgagggcattaatctattcatgagagatccactcccatcaccctaaaagctcccattagttcccacctccaatactggggatccaatttcaacataagatttggaggtgacaaagatcaaagccatagcaccctgaggtttggccacacacttgctcatctccacatttgtccctcccctcaggactagggtcctgactgctctgacttagtctccctccaccttatgggcacctggcagtcggtcatcatcagctttgctgaatcagcagcaacattgagggtaaaaattgtgtctcctggttccaccagaaataaagtagagccccacacagctgaggtgtggggtcaaaaattaaaactaagagacataagactcattctcaggctccaagtctggccagtgagcttctttgagactccctgggatcccagcagtgacactgatcactattgctgtcccacacatcccaagtgatgaggaagtaagaccaaaaccctcctgagattcctggcttgtgtcctgacactggggctgttgggattcctgtctttccttcaagattgttcaaataagcaccgacaatcacttccatgtgagatatgaggagagaataattccacatgaaccaaatccacgaagcctacactgaagcctgccaagttctctgcagtccagcacgatgaagggagcattttcatgggaacttttgggaatatgaggggagccaggctcagctatgggttccagagacaaagctcctggatgtttccccctggccttggtccatcacctgctacctctcctcactctttccacagatgctgccccaggttaagcccccacaggactctaagcctattcctgaccctgagctcagcccaagtgatgcttcaggagatgggatcctgagaatgagcgccaacgtctctttaacctgaggtgtgaggtcatgagacacctgttggccataagacacctgtcccccacctgctcaggagacagtggagcaggcaacagtgcagagagaaccagcaggagccaggccaggccctgcatccaaagcaggccccaatcccacagattctccagctccagcctggggtacagccccaactttctgtaggctgaaatgggcttctcaggatgggcaggccatgatgggggatggcagtgtgtccacaggacacagccctgctgcctgcctggccctcatgcccactccttccccaccctggttaatctccacccaaaagggcccaggctcagaactcaggacacctggatcagctcctggacttgcccccactgctttctgttcccctgagccacttagtctcttttggcctcagtgttacctgctgtgaagtgaggaggcttatactgaactgaggaagctcttttcttcattcaaaattaaaagacagaaacaataaagtcatgtgaattaaagccttctaaggggatgtcatttaatgggctccaatgggcttcagacatggaacttcttgtctttcctctgcagagattccaagaaagggactcaaaagggcttgctttctgtatgatgggaacagtgatctccagctgagtataagcaggagagtcctagtttcatcagcaagacagacaaggctagggtagaaatcctcctggcacaagctctgagaggtgtggaatgaaataaagataaacatgaaattaatgtgcctatgatggtgatgttagctcacaactaagctgcagaaccagaaacctggtgattgcagtgaatcatagctgctcttactgggtgggaggtgcaccagtttgcttcctaagtgcatagaaagcctgggtccctgtaggatggcatgcacatctctctggactttgaaagtgttgcagaagagcttcagttgactcactctaattagacctgactgaacaaaaccattagaggagggcatttcaaccctgagacacttctatagcaattgcacctgccccaccccactgaactgcgtgtgttacctctctgtgctgggctgggcagggcagattgggtcacactggcacagaatggggctggactctctggtcctcaacttctgaggtgacaggtgctgtggggtcacctggaagaagaaagctcctgggctgagtctcctccaccagttgggggcagcagagctgcagccaggagcagtgaggagagaggctggggctgcccagctggggcgaagaggaaggccagcctggggttcaacaggtgtccaagagtcagtcttcagactgaaaatgaagacagttcatcctatcccctcgggctgcagtgaccacgttctgagggtcagattcatacagtgtcacccaaggacaccgacagaagcccggcacagtgaaggcctcacctgggaaatgcaactagaagaggctgggcccaggtgtcagcttgggcagcttccttaggaaggggattccctgggagaagtcctgaggccgaggtgctctaggaggggcacaatgtgaggtgacagggctcccagggcccaggttcttcacccaggatggcggcctgagcctcctgccactctcagggccttgtccctccctgtccagcagtgtcctggggagctgagccctctatcgtgggcacttccagatacacccgacccctcctgcctctgcctttccttccagctccaggtggactctgactcaggacgcagctcctgtgctcaggggagattcaggtgggtggcgtgaagcattttggggccctggtccctgcatgaggcatcaccagcctccttcaggagatgctgtccagaggaacagggcttctcacctgcctcaggccacagctctcaccacggggctgtcctttgatcagtggcaggatctgcatggctggagggactactgaccacatgctctctggagctcatgtcttgtgtggagaccatgacctggggaccctcagaaagaccaagcagcctaaagttagattttcagtccagtgtgattctctggttcttttcgcaagtttacgtaaaacgttgatgagaaaaagtgaataaataaaggaagagttgaggatggcaattgctggtctactgtggggctgggggataccatggaaagagcagcaccacatgtcaaatgagactagagattgggatgcatccgaaatatgtgtggttgctcaaatgacaaaactcttccaactgcaatgattcataagtgtcctacagacacagtacatcatgtacataacattaccaggatggggccaagtgactcgggggtatcaggagcagggatgaaagaggagaaagatgatgcatctttggtgtacttgctgctgagtcaggcgtcatcagtgatttctcaacagggcccagctcagccccaggccaggctcctggaaggtccatagtcctgctcaatgcagcccaggacaggccacatgacacagaggtttgagacagggaccatgttgtcaatccccaggacggtgactgtgatcacaggccttggaggccaaggctgattttctgactggagaagcagacgaaggaagctggggattcaccccttcattttaagtttctcatgctgcccccagagctggcttgagggatatcccgccatgaggagtcccagagaagtaaatttgcataaacaccaaggatgcactgccccagtgggcctgagaggaaataagagaggcctgggaagcccagctgtgctgtgggctcaggaggcagagctgtgggtgtctcaccatggcatgggccacactcctgctcccactcctcaacctctacacaggtgctgcccccagaccctgccccaggctcagccctcctaagcccctggtcttaccctgaaccctgagctcagcccaggcatagcctcagggcgatactactggaatgggtttgttatcttcaagccccctctcttgtcctctcttgcaggctctgttgcctcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatccctcagtgacacaggcagatggggaagtgagacacaaactcctttttcatctgtgttgtgttcttcctccagcaccaggaagactgtggaccaagcaatgagcaggtctggccaagttctactggatctgagacctccaggccatccttttttccagctgtccaggttggctctgcagagggtggagcaggagtggatttaaggctgctataatcagaatttatggtgttttggggcctcatgagtgacttggggaaataagaactggatggaagatgaaagagatgtagagaaccatcacttgaccttagatttccatacgatggtgattgggtcactccttcttcaaaatatcctacatcagtcccgaaaaatacccacctcagctcaacacctgagcttccaggcttccatggcagcctgggattttgaacaggaaaagccaaggaggggacactgtggcatctgcctcaatacccttttctgagctcacccaacctcaactgctgggagcttctaggagctcagagctgtgccctcactgggaagtgctattagctccaaagaaaacttccttcctcatatttaggcccagttttgagagttttggtttgatgactgcctgagccaagaacccaaggccctgtcctaatagaggatgacactgaaaggccttccagatccagacatcccagtatggatgcctgaggcctcagttgcaaccctattgtgggtcagggtctccttctggtgggcgatgcctccctcactccttccagatcctctgtgcatgcacatctttttctcagagtctacttccaggaaacccaaactaagatggctggctatcaccaaaataaactaccatagacctgaggtggaaacaccagcgaatttcccaaatttccattgtgaacatccaaatgcccatttatatctgagtgttccttgtattcttataaaatgaaaatggagcctgacataccaggtttttggagtcctgaaggagatgtggagacagatccttctgcaaggaatccaccgaaaggggagcagcctcaccccatgcaggggctggagatgctcccacaggggcagctgtagcatggacgctaccaacctccaccctgcacatcctgcacaaacaatcactctttcacccctccttcagcttatcaaagttgacacttacgaagccagcacagctcacccttgtcaatcagactccttcaaacctccatcaaccacacaatctcaacataaagaatctccccaacataataataggaacagtagctatgaaaatggctataaaatatctcataaataattttagattgtgttcatgtgtaaatattatttttcacactttgggttaaataaaatatattactgaaactagtttacctttttattttttatgtctagtatggtgactagacagtaggattcacatgagactcacatcatgtgattgtacaatgctggtcttgtcttaccccttgaggtggcaggtgctttggagtaacctgcttcagcaagccccatctccacccgtaggacatatgtgtgaagccatggagaggcactggtggaagagaaatgagaacacagatgtggaccagctgtttatgcaggtgactgagtcctggagccctgatcctgttctaacctagatgtgtcacatccatctcaccagagaccgctgctggcctgccttagctcataactggggggatctggcagttcatgaaacatggtcgcttgatgtccagtgttatcctgtctctctcagggcccaataagacaaaaggagctgcttttagaaagggaagtaacactctactgcacatgacatggccttattccaaaaccccatgagtctacgttgggattctccagtggggtttgccatgtacaggaggtttcagttcccacagtagagtcagctggattctctggacccaacagcaggacactcacaaccctgcctgcacctgctgcagagcctcaatgctctgggcctggaaaacaatgggtgatatttgtggctcctgatatatgggttggagccacatccccaagtgtaaaatatgctactcctagacctttatagaccttgtgtctgtttcttcctggagggaattgaagggtataataacatgttctttaatttgtaggagactctcagctgctccagacaactgaagtcccaatttctgctaatacagaagagggaacagtttatttcccactcttaaaagtgcatggatctcacaaaagcttccagtaggccatgcccatcatgtatatgtgattcaactatgatatcaagatggtctgaaccctcatgatgatatcatgatagagataagagagctaatgatgctgggcagagaaagtgtgaatgtatactgtcgtccattccacctgaatgcacactgattctgatcctattctctgagggaaatagacaagacctcagtatctgcttcagtgaggtaactgtgcacctgcagccatagcattctgttcccagagatccccatctggcacagatattgctaatgccactattgcccatctgggtctgtacaaatccaaattcatcttccaggatcattcaactattgtagagatcagtccagtaaactgaaaacaaaaccccagaagtaatcacacgtactgcgggagaggagagagctgtctcagagggcacagtcttgttgaaattcctctgctccttgggaagaaacagcccagaaaaggccccaggggctgcgtctcatctgggttcctggatgaggcacaccccctactgcactgagattccacagaagctgggggtgaagtgcaaataccgtctttggttcatccttgggattttctttttatcacacactcgtcattttgtccacaatgtccaaagtttctaaagtgctgtctaatagatagaggttctttgtgcgctgaactaaaagctcttgggttggacaatggtgatgtttgcacaacatttttactgtacttactgccgcttaattacacacttaaaaatgattaaaaggatgaaacattttgttatgtttattttaccataataaaaatattgcatgctcaggaagcaaagtaattttgcaattatacaactgttaaaaatggaagaattatgtactgagcaccattttctctgttgtttatgctacaattcaactttctctctctctcactctttctctaattagcaatgatcttctgtctggtccaaggtcacacatttccagtcttccagaaatgtctgttgaatctgttaatttgttgccaggaagaatactcaaacttctcatgctcatatttgagtgttagctgtctccagccagcatttctaagccagaccctttgtcaaggcttttgaataattttgtgaaaagtacccccaaagatgacagtgttcactgttggcagcaggactgtttccatgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctattggacactgagtcacatagagggacagaaggtggctgaggacaccttatctctgatgagcataaggggattagatctgctggtggaacaggaagctgaagaaacctgtggctctaaacatggaatttccagccctgagtctctgctgtccgtgcccctctcatctgtatgttcctgggagatgtggaccacgggggttagaggtgaaggggattgggaagctttcatgttctctctcaccatctcccttgcttatctaacacactcttacacacctactttattggagcttctgctctacaaacatggctgagctctaaattagagacttttgaaagtgcagacggatgcaggaactcgtccatctggagactttccaccacttgaagcagtgaacacgtctgtgcaaggctcagaatttcaagtgacaggatgttgggatttcaaagaaaactaaatctttggatgaaccacgacagaagagggaaggttcacacatttccctgctgcttgggcctcagtgaggactgactcagccagtctcaggctcctggagaccgcctgggagatctgcactaggaaaccattttcagcacagcctggggctggtaaggggcccttactctgttattctgctgcctgataattttgcatccagagaagaattaggacctgtgagtccaggaatttcaaagcccatagacaaggtcccctcattctgccgtgacagcctcagctctgctttcccaaaaaaagagcatcttcccagcatgaagaaccaggagcaaagagggagcttctcccaggggtgagcagggcagaagccaccttggtcagtgggaaggaaacatgctcagctcacatctgacccagaatgactcagtcacacctgtgcagggtcacctgtgtgtgagcatcatctatttgctccatgagaaaataccttgtgtggctcttgggtaaaatcataccataggtgacatttctctgcctattgcttcagccgatgcttttcgtgattccctttaggacactggcataaggtaagcatgtcaggtgtgggacgtattgaacaggaaaagcagaggcttctcatatcaatgctcgtggcttgtatttgggcccatacctcatggaaatgggaaaaacagaaaagaaaatgatactctgctcaaaaaagcactgagaaatgctatagtattaatatatcgacaactcatttattgagctaatgaaatattaacatagatagatcatttttatagggggatccctaatccttaaacattatattaaaaatttgtcagcttaaaggatcattaaaaggcctatgtttgattgaaacctggagtactgtactttgagtcttctaatcagccaatgagtgcagggagctggctgccctcccaggtcctgactggctccatgtccaggtagagcagcgctccccacaggcagctggaggaactgacgaggggaagctgttggcatcagggcctcaaaaatttgactcaggattttcccacgtcccctccccaagtccaggcgggttccaggacactcagaagagctcatcattatgggtctaggacttccctggtcctgctcttctttcttccttccccagtggccttaagattgtcactccctgtcacaggcccttcctttccttgtcaagtgcactccctgaattctctgctcctgggtcaggaaagctctggaacttcagggaaagcagtgctgggtgacccaatggggacccagaaagctggcccagggccagatacacaggcagcagggtgggtccctacagtgctgcctggtgggcatcaggtagaggggagtgaccaggaccaactcccctgagtgtcttcagggccaggtgaactagggagggtctgggacctggtgtggacccatgcactgacccaggaataggacaggaaactcctcagagcaaggactgtgttttcctcatgctgagctcctgaaaagcagtcttgccaggatagagtgggccagggtggatatatgttgggtgaatgagcttctgtctctgttttattgcaggagtcactacgaaggtacgctggccctgtatttgtatccagaaccagtcaaagccacctgtgagtcctgcatccctcagtaccaagccccagtcccccttcaggaccacccaccacacagagagacagacgtgcagggagcctgaggaagaacctgaaacctcctctactacatggagtgtttgtatttccatcaggaatcttgagcaccttgtgccgggtcttgaggcaggaaggggccacacagagaagaggagtttcttccctgaggtcagcagtccatgaacgaagggatcagggacttgagcagcagattctgaagcaacacctggacccaggaggcccctgagcctccagcagcccgcgtagagtggccaccagggggcagcagagagtaacctggcagaagcacctggagatggggtgggcctgggcatcagggagatgcccacatgcagggagggtcggtgaccatgacctgagatctggagggaaagaggttcttcttttcttagagtatttgtccttgacaccgatgtttacattcttctggcttcctggttctcagatctgactcttggagatgatccttatttttctgacacacattcaggcactttgcctcttcccatcgacctggcccccatctcactgtcacacatgccatcccatcctgtagtcagacgtgtcccacctccctgcctttgctctgggagcccctgtcctgcagacacagccacttctccttccctggccacccctcaacgtccactgtccccggtctttcctgactctgttctggggaacctgccaattcgtagttcttgatttccttatgagacacacaatacttactcattaatcttttgttgacttaagtttttatccattgttacattttcccagcaacagaagacaacttagttataataaacacttacttcctgggtcttggagtttgcagccccctctcattttctcatgaagcaaacatttccttcacctcctgatctgtccctggtcctgacagcaccctggtgatactgaggcacagcacccatgacctgacactagaactcgcagccaaggtagaaacttaccgcatcccatggatcttccaaaattctatgtgcccttggcaaccaagaattgcattctcctctagcacagaggagctgtgccctggaatggggcctgtacctgtccaaggcttgtgccgtcccctgtgggagatgagaagcgtccctgcattgggctcttggggacccgtcttggacatgagtgagaatgaagagggtccctgcattgggctctggcatgtgactttaaatggatttaggcctgtaccagacatctcatgtctgacataaaatatttacaatcaggacattactagagaagcagaaaaaagctaaccacctccctcctgagccaggatggaatgaaggaggggactgtggaccccagataattcccctgtcaccactgtgactctaacaacctcttaaatcacggccaacatctatcccataggaaggtctttatatcccctagaaaatacagaggaagtcagctctgagcttttccacgaccaacccagccaaggagcaaggctgggcacaacctgggtaaagatgtgagcccagaccatgggaccagtgggtgaaggaaaatcgcatgggctgagggggtgggtaagcaggggccagccctcctctctctgtttcctttggggctgagtccttctctggaaaccacagatctcctccagcagcagcctctgactctgctgatttgcatcatgggccgctctctccagcaaggggataagagaggcctgggaggaacctgctcagtctgggcctaaggaagcagcactggtggtgcctcagccatggcctggaccgttctcctcctcggcctcctctctcactgcacaggtgatccccccagggtctcaccaacctgcccagcccaagggttctgggtccagcgtgtccttgattctgagctcaggagggcccttcctgtggtgggcaggatgctcatgaccctgctgcagggtgggaggctggtggggctgaactccccccaaactgtgctcaaaggcttgtgagagcctgagggactgcacctgccaggagagagtagtgagttttcagttcaaagtctccatacaacaggaaagtcatgggccactggggctggggctgattgcaggggataccctgagggttcacagactctctggagcttgtctgggacagcagggcaagggatttcataagaagcatctttcacctgcaagccaacctctctcttatttatttatttatttatttatttatttatttatttatttttatctttgcaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatcccacggtgacacaggcagatgaggaagtgagacaaaaacaccctcccagcctcggtcaccctcttgctccagccccgggaagcctgttgataaagccatgagtgaatctggcccagttcacctggatctgagcctttcaggttgcccttccctccagccccctccaggagtctctacagaagatacatcaggcataaatatggcctggaagggccagaatcatctggtgacttggggctgttgtgtgagttagagaatgaaggcttgggtggaaagacagacagaggcaacctctgtccactgtcctacccctggatggtcatatggtggggacagggcaagtccttagaccaactgtctggatcaggccccagaactactgcccagttctgctgaggtcctggcccccaggctgtgtggcagcctgtgattcccaacagagcaaaccagaggaatggacactgtgaagtctgcccagatcccctcctcaatgtgacccacctggcactgctgagaagcccagcagctcagagctgtgccctcactgggaagtgctgttggttgcagaaagcttcctcaagtttgtgtcccttttcagaggggttcggtttaatcaaccaagatctcaaatccttgcctcaatttaagatgccactgaatgaagggcctcccagctccagagctccctgtgtggatacctgaggcctcaatgtcaactccatcacgagtcagggtctccttctgccccgtgttgcctcccccactcccttctgaatcttctgtgcatggacatctctattgcagagttagcttccagagaaccccatctaagatggccagctgtccccaacatgggtcatcagggacctgagtaggccactataaactgaaaactctggtttctgtccaaatttgcagagtaaatgttgaaatgcccaatctgatggttccttgaatttttatggaatgaaaagggagcctgacatgccaggtgctctgggttgagggattgttggagtcagatctccctgcaggaaagcccggggcagggggagcagcctcacccctcacaggaaccacagatacacccacaaggtgagctgcaggatggatgctgcccacctccaccctccacatcctctgtaaatgttgctcctttctacaactccaaccagatatgtagatgtggcgaactacgtaaaatacggatcattcatcacatcaaaacccactgcaggacaccctggtcaacaaagaacccaatcacatccccatcaactacatagtttccaaattttccatctccagaaaaataacaataacaatatacatgaaaatcgatgtaatttatctcatacataatttcatgttgataacgtgaaaatgatagtattttgctctactgaaataaataaaatatatatatatatctgaatttatttgtcttatcttttcatatttaatgtggtgactagacactagggggtcacaggaggatcgtgtcataccactatgggacagagctcctcacaactctttcaggtgacaggtactgttgagtaacctgctgcaagcatccccatctccaccagaccatataagtgtgaacccaggaagaggcactggaacaatagagagaaaaacctgcttgtgcagaagacggtgcccttgagccctgctcctgctccatcctacgggtgccacattcatctcatggtgtaatatttcgtgccctgcctgagcttatgaccgaggggatatggcaggtctgactgtgtggttactggtgtctcatgaggttctggatgtaacaaagccctcgaatatagaagaggttgttttcaaaaggaaataattatctactgcacatgacatagacttgttgctaaatcccatgcgtctacactaggattctcctctgaagccttgccttaagcacaaggtttcagttcctatgtccagttcctctattatggtagagtctgctagtttctctggcccaatagcaggacactcactcccccacctgcacctgctgcagagcctttctactcttggccccaaaacactgggtgacacagttctcagacccatgatttatagtgtcagtattcaggcctcaggggtccctgatggcttctctggctccaagtctggaaacacagcctccatgaccatctctgggttccaggctgaggatgaggctgattattactgcaactcacataggagaggtggcactttccaccgtggtccaagttcatggggaattgagacccaaacctgccctgggctctcagcctctctcttgttctgaagatgcttcctcaccctgtgcaaggggcttcttgcagcactgccttgagaatttcccctctcccagctcctctcctttctcaccaggaagtccaaaaggaaacctgctctgtgatttctcatccaggacagtgacagcttcctgatgcttgtgtgctgtggtccctgaatgtgcaactcttcctagctcttcaaatgcaggcacatagtgagaaaagctgcctgactggtgcattcactgctgtttttaaggatgtcctcacccaaaatgcatcctcctcccaaattgtgaagaacaatctggacagaggtcattacagggagtttcaagaaactgcatcttattcaattgtgtccaccatggtctggtaaagatggccctcctggatggactattcctctgcatgtctgtcctgaagcagtgaccactgtgagaagatctgaacatgtttgtgaggtattaaggacgagaggaaactgttgtttttattattcttttgtttttgtttttgaaacaaacttttgctttgtcgccaggctggagtgcagtggcagaatcttggcttactgaaatctcagcctcccaggctctaccaatgctccctgcctcagcctcccgaagagctgggataacaggtgaccaccaccatgcctggctgatttttgtatatttagtagagacgggatttcaccatgttggccaggctggtcttgaactcctgatctcaggtgatgcacccacctcggcctctcaaagggatgggaatacacacaggagccactgcatctggcagtgttttttttatttttgctcctcctctttgcctcaatacctcaggttgctgagctggggagattttgcgtgacaggctcagtgctccctcaaaatcctcccgtctcaattcgctggggccctgtcctggaaactccccaaaagtggatggtgtccctataggttgggagtttccaaaatggccccacagggaagagttaacgtgagtccattccttcttcctcattgacatccagcatttgtaatttccatgggtgtcaatacttttgtagctgaaatctttcttaatctactaaaggtgagaatgaatttaataaatattcagacattagttgcatccaatatttaaattttatgagtcaattggtagacatagccattattatatataatttaggcttcataaactttgattaaataggttttattaaaaacaaagtaaccattttattatgtgtttagactatatcaacatgttgtgtacctgaaatatccacaagaaaatatatttcaaaaaccaaattgtatttattgtctattgttgcataaaaattgctccctaatatttagcatggtaagagaacacgtgtttgtgatcttgtcacttcggtgcatctggaattgagagcagcttagttttgtggttctggttctgggttggtcatgaagttgcagccaagctgtcaggccaggctgcattcagaggccagagcaggtggccaggcccagcctgaggggcttccactgtccctaacctgtttgtctgatgtggaaaatctcagaggaaaaggagagagtgaagtgtaaggcacctgtcccagtcccccttgtcaaaggccatcccatacctgcaccatttcttattctttcctggggcgtcataggcatagagcactgcccattcattctaacgctgtagagtattctgtagtaggattttagccatgcagcctctaatggttatcaccatgattttgatcttacaaatcacactgcagcaagcatccctgtgcagactcctttgagttcatgtgtgcatatcaccataggataaatttccagaagtggaattgctgggtcaaaaggatgtgcatttttaacttttatccattgttttcatattcccctccagttctaccagtttacaataccagccctaaatattgattggaattcattggtgaaagtgcaagtttgtgccaacctatcagatatacaaagttatcttgttacacatttatttttgatttctcctattttgcttgaggttgagcatttactcaaatatttcagtgctcattatgttttaggatttggtaaaccgtttcttcaatgcctcggtaagaggtattttagtctttgccatgcacaagacaacgttgggataatatgtatgttctgatacaccatctacaacgtaatcattaaaacatataaaaaccactatcagttctggggccattaaaaaaattggtggcaggccagggatgtcccacaggatgtggtttaacggtctctggtttctagggttatttgaagtttgaacattgcacccgcatatgttctatgtggagatctctttgtgagggacactgtaattcacctcctctaggggcctgaggtctttctttggataagaacctacctgtaccatgtgtttgattggatcttgtgtctgctcaagacagccctgtgtcacaagctcatgactttcatcttcatccatttgctctgttttgtgagagcttcagtatatcaggaatagagattcctccgaggtgaaaaattagaggcagagggaggggcaaatgggcaaggaagcttgcaccaagtcgggagtgatccagtgtaggctgagagaaaaaaggtcttaaaatcagccttgtagctgaaaccaaaaacacacaagatggttggtgttctgagcatcattaacaaatgataaatgaagttgaacttttaaatgtattgcaaatttttataaagcaagtagatcgttaaactcagaatgcaacaatggaataaagaagagagtttgagatgtttttaaaatttatttatttatttatttatttttgagatggagtctcactctgttgccaggctggagtgcagtggcacaatcgcggctcactgcaacatccacctcccgggttcaagaaattctcctgcctcagcctcccaagtagctgggattacaagctctcgccatcatgccaggctaatttttgtattttttgtagagacatggtttcacaatgttgaccaggatggtgtcaatctcctgacctcatgatccacccgtctcggcctcccaaagtgctgggattacaggcatgaactaccgtgcctggctgagtttgagattttaactgtaagtcctccaactaagttgccatgacaagaacagggatgatgagagtggaaatatgttatcctgcaaattatcgttttatgtaaaagaatattttccctcttttaggtaaaggaagcatcttctggagcaccttctctctgactatcaaagcaccattaagccacaaataaactgtaacatgaagtaggaaacaactgcccttttatataaccattgagaggtggctttatatgcataccaaaatgttgatgctcaatgctaaaattggatttagtaatttaatatgcctacaagaaattaattttctttggattatattatttctgtgtacgatttatcttagttaacttggaaatattctgctctaaaaacaactcttgttttttgggttatattttctgtatcaactatagctcttttccaaatgctgtcagagatagcccatggctactgatcacaaaattcaattttatggcatttaaattattctatactctaaattattttaaaagtgcacagatgtgaatttttcacatctgactcaaaaatgttgctgatgttgactcacttttttatttcaatcttattgaagtaggagtttacttttctggaacctggatgataacaggagactggagaggaaaccccccaaattgttttcctttaaaccctcaggatgaatcatcctggataatcacccacacttgatttgggtgatatctaaatgagagttgggtcttagagtaggtgctgagttagtttaggacttgcgctgttggaatgagttgaatgtttttacaagtgagaaagacatgagttttttggagtccagagggtggggggttattggctgaattaagtcccccaaaatgtatgcattgaagctgtaacacacaatatgtgactgaaattgtgcatagggtctttaaagaggtgactaagtgaaaatgaaaaaattagggtggattcttctcaaattggactgatgtcctcctaggaagaagaaatttgcacacacagaaatgaggcaccagaggtgagcgtgcagagaaaagaccaggtgaggattcagcaaggaggtagcaacctgcaagccaaggagagagtcctcaggggaaaccaaacccactaccacctttatcttgggttttccagcttcagaactgtgagaaaatatgtttctgccatttcggtcactaattctttcctatcttcttgtgggagctctagcaaaaacaagagggaccccaaagaccttggatgagggagaaggaggagatggagcagggtgcaggaggcggtgcaggaaggggctggaaggtcgggctctgaggtgcatctcctgggtggaatcttgactccactccctattgtctggaggacttgggaaaaacatttaacctcctaatattcactcactaataaagatgggcttgaagcacaaggctccccatcatcctattctatattacaaaagtcttcttgaggtaacacttgtaaaactctcgctaatgcatctggcatgtattatggactcataagtagcccttctgagtgatctagtgatgtgcagaaaatggcattcatgctgtgtgcaccagggggcactgtgaggtttagtctgaggcccctaatgagtccaagcccctagtaatgctcaagggcgaagagcctgactgttgcttcctatgaggcccc
